(12) United States Patent
Horscroft et al.

(10) Patent No.: US 11,542,490 B2
(45) Date of Patent: Jan. 3, 2023

(54) RNAS FOR WOUND HEALING

(71) Applicant: CureVac SE, Tübingen (DE)

(72) Inventors: Nigel Horscroft, Tübingen (DE);
Marion Pönisch, Tübingen (DE);
Christine Weinl-Tenbruck, Tübingen (DE)

(73) Assignee: CureVac SE, Tübingen (DE)

( * ) Notice: Subject to any disclaimer, the term of this patent is extended or adjusted under 35 U.S.C. 154(b) by 299 days.

(21) Appl. No.: 16/466,634

(22) PCT Filed: Dec. 8, 2017

(86) PCT No.: PCT/EP2017/082108
§ 371 (c)(1),
(2) Date: Jun. 4, 2019

(87) PCT Pub. No.: WO2018/104540
PCT Pub. Date: Jun. 14, 2018

(65) Prior Publication Data
US 2020/0149026 A1 May 14, 2020

(30) Foreign Application Priority Data

Dec. 8, 2016 (WO) .................. PCT/EP2016/080260

(51) Int. Cl.
| | | |
|---|---|---|
| A61K 48/00 | (2006.01) | |
| C12N 9/64 | (2006.01) | |
| A61K 38/18 | (2006.01) | |
| A61K 38/48 | (2006.01) | |
| C12N 15/117 | (2010.01) | |

(52) U.S. Cl.
CPC ............ *C12N 9/6491* (2013.01); *A61K 38/18* (2013.01); *A61K 38/4886* (2013.01); *C12N 15/117* (2013.01); *C12Y 304/24007* (2013.01); *A61K 48/00* (2013.01); *C12N 2310/531* (2013.01); *C12N 2320/30* (2013.01)

(58) Field of Classification Search
CPC .................................................... A61K 48/00
See application file for complete search history.

(56) References Cited

U.S. PATENT DOCUMENTS

| | | |
|---|---|---|
| 2002/0071834 A1 | 6/2002 | Murray et al. |
| 2005/0032730 A1 | 2/2005 | von der Mülbe et al. |
| 2005/0059624 A1 | 3/2005 | Hoerr et al. |
| 2005/0250723 A1 | 11/2005 | Hoerr et al. |
| 2006/0188490 A1 | 8/2006 | Hoerr et al. |
| 2007/0066935 A1* | 3/2007 | Morishita .......... A61K 38/1833 604/68 |
| 2008/0025944 A1 | 1/2008 | Hoerr et al. |
| 2008/0026446 A1* | 1/2008 | Ni ....................... A61K 38/484 435/219 |
| 2008/0267873 A1 | 10/2008 | Hoerr et al. |
| 2009/0324584 A1 | 12/2009 | Hoerr et al. |
| 2010/0048883 A1 | 2/2010 | Ketterer et al. |
| 2010/0189729 A1 | 7/2010 | Hoerr et al. |
| 2010/0203076 A1 | 8/2010 | Fotin-Mleczek et al. |
| 2010/0291156 A1 | 11/2010 | Barner et al. |
| 2010/0305196 A1 | 12/2010 | Probst et al. |
| 2011/0053829 A1 | 3/2011 | Baumhof et al. |
| 2011/0250225 A1 | 10/2011 | Fotin-Mleczek et al. |
| 2012/0021043 A1 | 1/2012 | Kramps et al. |
| 2012/0258046 A1 | 10/2012 | Mutzke |
| 2013/0129754 A1 | 5/2013 | Thess et al. |
| 2013/0142818 A1 | 6/2013 | Baumhof et al. |
| 2013/0259879 A1 | 10/2013 | Baumhof et al. |
| 2013/0280283 A1 | 10/2013 | Lorenz et al. |
| 2013/0295043 A1 | 11/2013 | Kallen et al. |
| 2013/0336998 A1 | 12/2013 | Kallen et al. |
| 2015/0037326 A1 | 2/2015 | Butler-Ransohoff et al. |
| 2015/0050302 A1 | 2/2015 | Thess |
| 2015/0057340 A1* | 2/2015 | Thess ..................... A61K 39/00 514/44 R |
| 2015/0093413 A1 | 4/2015 | Thess et al. |
| 2015/0118183 A1 | 4/2015 | Baumhof |
| 2015/0118264 A1 | 4/2015 | Baumhof et al. |
| 2015/0165006 A1 | 6/2015 | Thess et al. |

(Continued)

FOREIGN PATENT DOCUMENTS

| | | |
|---|---|---|
| WO | WO 2004/060476 | 7/2004 |
| WO | WO 2009/134967 | 11/2009 |

(Continued)

OTHER PUBLICATIONS

Kunugiza et al., Acceleration of wound healing by combined gene transfer of hepatocyte growth factor and prostacyclin synthase with Shima Jet (Gene Therapy, 2006, 13:1143-1152) (Year: 2006).*
Caley et al., "Metalloproteinases and Wound Healing", *Adv. Wound Care*, 4(4):225-234, 2015.
International Preliminary Report on Patentability issued in corresponding PCT Application No. PCT/EP2017/082108, dated Jun. 11, 2019.
International Search Report and Written Opinion issued in corresponding PCT Application No. PCT/EP2017/082108, dated May 15, 2018.
Lyngstadaas et al., "Enamel matrix proteins: old molecules for new applications", *Orthodont. Craniofac. Res.*, 12(3):243-253, 2009.
Vowden et al., "The effect of amelogenins (Xelma(TM)) on hard-to-heal venous leg ulcers", *Wound Repair and Regen.*, 14(3):240-246, 2006.

*Primary Examiner* — Arthur S Leonard
(74) *Attorney, Agent, or Firm* — Parker Highlander PLLC

(57) ABSTRACT

The present invention relates to an RNA encoding a therapeutic protein, in particular a collagenase, growth factor, cytokine, receptor, chaperone or signal transduction inhibitor. In particular, the present invention relates to RNA suitable for treatment of wounds, specifically for promoting wound healing. The present invention concerns such RNA as well as pharmaceutical compositions and kits and combinations comprising the RNA. Furthermore, the present invention relates to the RNA, pharmaceutical compositions, kits as disclosed herein for use in the treatment of wounds, specifically for promoting wound healing.

20 Claims, 9 Drawing Sheets

Figure 1:
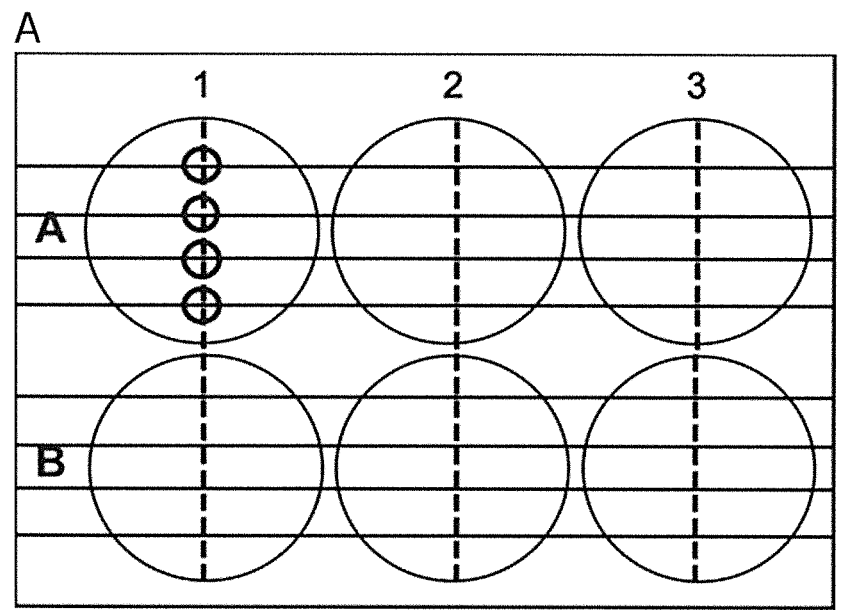
Figure 1:
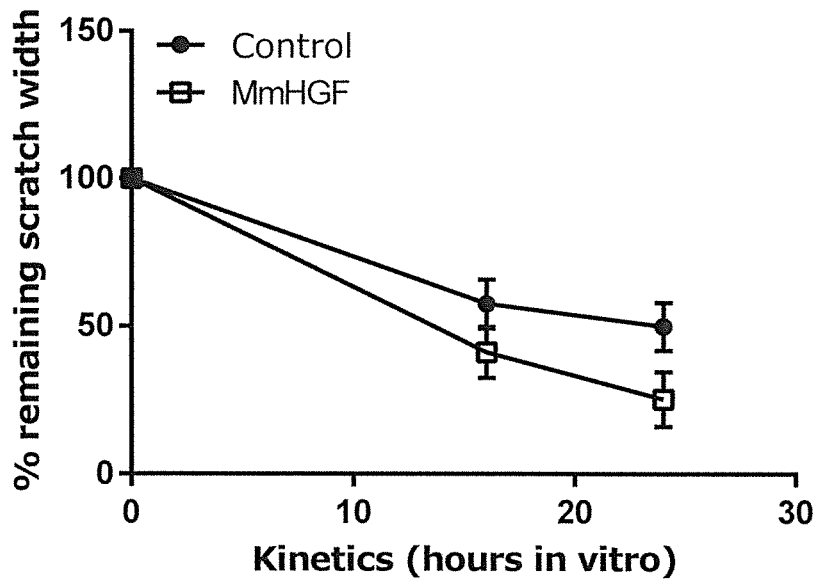
Figure 1:
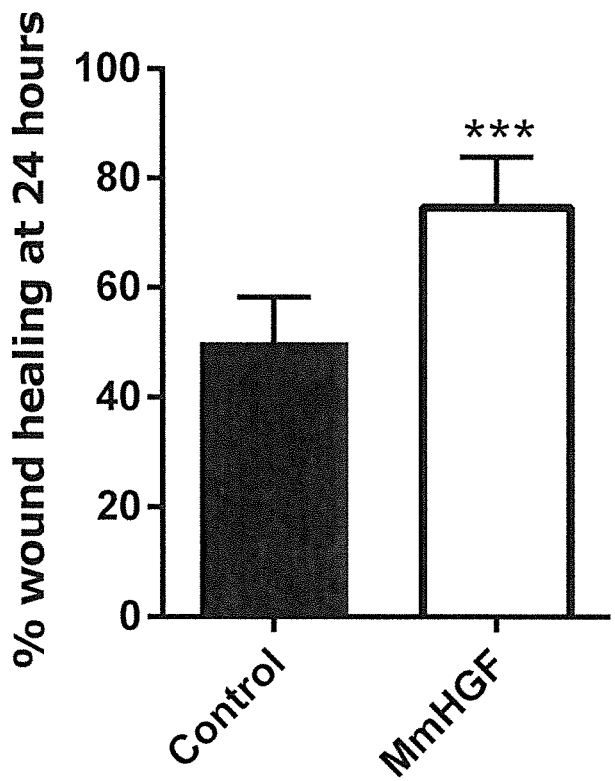

Specification includes a Sequence Listing.

(56) References Cited

U.S. PATENT DOCUMENTS

| | | |
|---|---|---|
| 2015/0184195 A1 | 7/2015 | Thess et al. |
| 2015/0218554 A1 | 8/2015 | Thess |
| 2015/0306249 A1 | 10/2015 | Baumhof et al. |
| 2015/0320847 A1 | 11/2015 | Thess et al. |
| 2016/0130345 A1 | 5/2016 | Fotin-Mleczek et al. |
| 2016/0166668 A1 | 6/2016 | Kallen et al. |
| 2016/0166678 A1 | 6/2016 | Kallen et al. |
| 2016/0166710 A1 | 6/2016 | Baumhof |
| 2016/0166711 A1 | 6/2016 | Schnee et al. |
| 2016/0168207 A1 | 6/2016 | Kramps et al. |
| 2016/0168227 A1 | 6/2016 | Kallen et al. |
| 2016/0199513 A1* | 7/2016 | Bancel ............... A61K 38/1816 514/44 R |
| 2016/0235864 A1 | 8/2016 | Schlake et al. |
| 2016/0304883 A1 | 10/2016 | Grund et al. |
| 2016/0304938 A1 | 10/2016 | Wochner |
| 2016/0326575 A1 | 11/2016 | von der Mülbe et al. |
| 2016/0331844 A1 | 11/2016 | Fotin-Mleczek et al. |
| 2017/0014496 A1 | 1/2017 | Fotin-Mleczek et al. |
| 2017/0029847 A1 | 2/2017 | Thess |
| 2017/0114378 A1 | 4/2017 | Wochner et al. |
| 2017/0252430 A1 | 9/2017 | Fotin-Mleczek et al. |
| 2017/0326225 A1 | 11/2017 | Rauch et al. |
| 2018/0044687 A1 | 2/2018 | Thess et al. |
| 2018/0125952 A1 | 5/2018 | Fotin-Mleczek et al. |
| 2018/0126003 A1 | 5/2018 | Hoerr |
| 2018/0142275 A1 | 5/2018 | Roos et al. |
| 2018/0147146 A1 | 5/2018 | Eber et al. |
| 2018/0148727 A1 | 5/2018 | Grund et al. |
| 2018/0201967 A1 | 7/2018 | Eber et al. |
| 2018/0208957 A1 | 7/2018 | Roos et al. |
| 2018/0214537 A1 | 8/2018 | Mutzke et al. |
| 2018/0237786 A1 | 8/2018 | Schlake et al. |
| 2018/0237817 A1 | 8/2018 | Roos et al. |
| 2018/0243219 A1 | 8/2018 | Ketterer et al. |
| 2018/0296663 A1 | 10/2018 | Hipp et al. |
| 2018/0298372 A1 | 10/2018 | Funkner et al. |
| 2018/0312545 A1 | 11/2018 | Baumhof et al. |
| 2018/0371392 A1 | 12/2018 | Mayer et al. |
| 2019/0010485 A1 | 1/2019 | Yazdan Panah et al. |
| 2019/0017100 A1 | 1/2019 | Wochner et al. |
| 2019/0024096 A1 | 1/2019 | Schmid et al. |
| 2019/0040378 A1 | 2/2019 | Fotin-Mleczek et al. |
| 2019/0049414 A1 | 2/2019 | Wochner et al. |
| 2019/0083602 A1 | 3/2019 | Roos et al. |
| 2019/0100784 A1 | 4/2019 | Eber et al. |
| 2019/0125857 A1 | 5/2019 | Rauch et al. |
| 2019/0133950 A1 | 5/2019 | Eber et al. |
| 2019/0160164 A1 | 5/2019 | Rauch et al. |
| 2019/0177714 A1 | 6/2019 | Kunze et al. |
| 2019/0185859 A1 | 6/2019 | Fotin-Mleczek et al. |

FOREIGN PATENT DOCUMENTS

| | | |
|---|---|---|
| WO | WO 2013/090186 | 6/2013 |
| WO | WO 2013/106510 | 7/2013 |
| WO | WO 2013/120497 | 8/2013 |
| WO | WO 2013/151666 | 10/2013 |
| WO | WO 2013/151671 | 10/2013 |
| WO | WO 2015/024667 | 2/2015 |
| WO | WO 2015/061467 | 4/2015 |
| WO | WO 2016/091391 | 6/2016 |
| WO | WO 2016/094675 | 6/2016 |
| WO | WO 2016/131052 | 8/2016 |
| WO | WO 2017/021546 | 2/2017 |
| WO | WO 2017/025447 | 2/2017 |
| WO | WO 2017/064146 | 4/2017 |
| WO | WO 2017/137095 | 8/2017 |
| WO | WO 2017/140905 | 8/2017 |
| WO | WO 2017/182634 | 10/2017 |
| WO | WO 2017/186928 | 11/2017 |
| WO | WO 2017/191258 | 11/2017 |
| WO | WO 2017/191274 | 11/2017 |
| WO | WO 2017/203008 | 11/2017 |
| WO | WO 2017/212006 | 12/2017 |
| WO | WO 2017/212007 | 12/2017 |
| WO | WO 2017/212008 | 12/2017 |
| WO | WO 2017/212009 | 12/2017 |
| WO | WO 2018/078053 | 5/2018 |
| WO | WO 2018/096179 | 5/2018 |
| WO | WO 2018/104538 | 6/2018 |
| WO | WO 2018/115507 | 6/2018 |
| WO | WO 2018/115525 | 6/2018 |
| WO | WO 2018/115527 | 6/2018 |

\* cited by examiner

B

C

A

B

RNAS FOR WOUND HEALING

This application is a national phase application under 35 U.S.C. § 371 of International Application No. PCT/EP2017/082108, filed Dec. 8, 2017, which claims benefit of International Application No. PCT/EP2016/080260, filed Dec. 8, 2016, the entire contents of each of which are hereby incorporated by reference.

INTRODUCTION

The present invention relates to an RNA encoding a therapeutic protein, in particular a collagenase, growth factor, cytokine, receptor, chaperone or signal transduction inhibitor. In particular, the present invention relates to RNAs, (pharmaceutical) compositions and combinations comprising the same suitable for treatment of wounds, specifically for promoting wound healing. The present invention concerns such RNA as well as pharmcautical compositions and kits and combinations comprising said RNA. Furthermore, the present invention relates to the RNA, pharmaceutical compositions, kits as disclosed herein for use in the treatment of wounds, specifically for promoting wound healing.

The skin forms a barrier between the body and the environment, protecting the body from invasion by potentially hazardous materials and organisms. Any rupture or breach to the skin barrier is usually readily repared in order to restore its integrity.

Wound healing involves a complex series of consecutive, but overlapping, stages, characterised by the sequential movement of different cell populations into the wound site. This complex process, relying on the collaboration of many different extracellular matrix components, cell types and soluble mediators, ultimately leads to the restoration of injured tissue. Simplified, the process of wound healing is often subdivided into three phases: i) inflammation, ii) granulation formation, and iii) matrix formation and remodelling.

Wound repair is initiated with the aggregation of platelets, formation of a fibrin-based provisional matrix, and release of growth factors from the activated coagulation pathways, injured cells, platelets, and extracellular matrix (ECM), followed by migration of inflammatory cells to the wound site. Thereafter, keratinocytes migrate into the wound and the growth of new blood vessels from pre-existing ones (angiogenesis) is initiated. During the process of angiogenesis, fibroblasts reposit and remodel the granulation tissue. Cell migration, angiogenesis, degradation of provisional matrix, and remodelling of newly formed granulation tissue, all require co-ordinated breakdown, synthesis and remodelling of the ECM (Riedel et al. Int J Mol Med 17: 183-193, 2006).

Although effective wound healing mechanisms usually exist in otherwise healthy individuals, the repair process for even minor breaches or ruptures takes a period of time extending from hours and days to weeks. Moreover, it is estimated that at any given time, approximately 1.5% of the population have chronic wounds that require treatment. Chronic wounds that fail to close and re-epithelialize include pressure sores, lower-extremity diabetic and venous stasis ulcers, and wounds in immunocompromised subjects. The latter group comprises patients with uncontrolled diabetes mellitus, chronic steroid use, sepsis, and those undergoing systemic chemotherapy and/or radiation therapy. Although many reasons for why these wounds fail to heal have been proposed, no unifying theory exists, and the cause is most likely multifactorial. Importantly, the potential for invasion by pathogenic organisms or foreign substances, and the risk of inflammation continues until new tissue has been generated to fully close the wound.

Acute and chronic wounds represent major clinical problems. There have been several attempts to encounter the problems associated with slow wound healing. Many clinical trials conducted so far employ growth factors in order to promote wound healing.

Growth factors are cytokines whose primary role is directing the maturation of cells during normal turnover and in the post-injury tissue repair response. They are a major part of the process of wound healing, being involved in cell infiltration, cell proliferation, matrix deposition and scar formation. Several growth factors that are released at the wound site are presumed to be necessary for wound healing. Over the past two decades, much research has been conducted in characterizing the role and potential treatment applications of individual growth factors in impaired wound healing states.

The administration of several recombinant growth factors has shown clinical improvement in wound-healing rates in preclinical animal models. Particularly PDGF, TGFß1, bFGF, FGF-2, EGF, VEGF, KGF-1, KGF-2 and IGF-1 were tested in preclinical models of wound healing. Based upon promising preclinical results using administration of growth factors in the treatment of acute and chronic wounds, various clinical trials have been conducted.

The PDGF-BB isomer is the most widely clinically studied. In fact, becaplermin (Regranex, Ortho-McNeil Pharmaceutical, Inc., Raritan, N.J.), a recombinant human PDGF-BB, is the first FDA-approved growth factor available for the treatment of diabetic neuropathic ulcers.

Even if a lot of trials are ongoing to date only PDGF has been approved by the US Food and Drug Administration (FDA) and the European authorities (EMEA) for clinical application in patients.

To circumvent the problems associated with recombinant protein (e.g. short half-life, low bioavailability, enzymatic inactivation, and the need for carrier molecules) gene therapy approaches were also used for wound healing. Viral vector or DNA plasmid encoding e.g. the particular growth factor was used for wound healing. Branski et al summarizes the gene therapy approaches already conducted for wound healing (Gene Therapy (2007) 14, 1-10; JBUR-2793; doi: 10.1016/j.burns.2008.03.009).

In this context liposomal gene transfer of IGF-1 in combination with KGF is described (Jeschke and Klein, Gene Therapy (2004) 11, 847-855).

Also the use of recombinant Chlostridial collegenases are described for wound healing (KATHLEEN N. RILEY AND IRA M. HERMAN). A mixture of proteases derived from the fermentation of *Chlostridium histolyticum* (SANTYL® Ointment) is already approved for wound healing.

WO2013090186 discloses mRNA encoding specific factors for the use in wound healing. But it does not disclose the use of RNAs encoding all of the particular therapeutic proteins as described herein, or combinations thereof.

Despite the above attempts, there is still an urgent need in the art for novel and improved therapeutics that are capable of effectively promoting wound healing of acute and chronic wounds.

The object underlying the present invention is solved by the claimed subject matter.

The present application is filed together with a sequence listing in electronic format. The sequence listing is provided

Definitions

For the sake of clarity and readability the following definitions are provided. Any technical feature mentioned for these definitions may be read on each and every embodiment of the invention. Additional definitions and explanations may be specifically provided in the context of these embodiments.

Artificial nucleic acid molecule: An artificial nucleic acid molecule may typically be understood to be a nucleic acid molecule, e.g. a DNA or an RNA, that does not occur naturally. In other words, an artificial nucleic acid molecule may be understood as a non-natural nucleic acid molecule. Such nucleic acid molecule may be non-natural due to its individual sequence (which does not occur naturally) and/or due to other modifications, e.g. structural modifications of nucleotides, which do not occur naturally. An artificial nucleic acid molecule may be a DNA molecule, an RNA molecule or a hybrid-molecule comprising DNA and RNA portions. Typically, artificial nucleic acid molecules may be designed and/or generated by genetic engineering methods to correspond to a desired artificial sequence of nucleotides (heterologous sequence). In this context an artificial sequence is usually a sequence that may not occur naturally, i.e. it differs from the wild type sequence by at least one nucleotide. The term "wild type" may be understood as a sequence occurring in nature. Further, the term "artificial nucleic acid molecule" is not restricted to mean "one single molecule" but is, typically, understood to comprise an ensemble of identical molecules. Accordingly, it may relate to a plurality of identical molecules contained in an aliquot.

Bicistronic RNA, multicistronic RNA: A bicistronic or multicistronic RNA is typically an RNA, preferably an mRNA, that typically may have two (bicistronic) or more (multicistronic) open reading frames (ORF). An open reading frame in this context is a sequence of codons that is translatable into a peptide or protein.

Carrier/polymeric carrier: A carrier in the context of the invention may typically be a compound that facilitates transport and/or complexation of another compound (cargo). A polymeric carrier is typically a carrier that is formed of a polymer. A carrier may be associated to its cargo by covalent or non-covalent interaction. A carrier may transport nucleic acids, e.g. RNA or DNA, to the target cells. The carrier may—for some embodiments—be a cationic component.

Cationic component: The term "cationic component" typically refers to a charged molecule, which is positively charged (cation) at a pH value typically from 1 to 9, preferably at a pH value of or below 9 (e.g. from 5 to 9), of or below 8 (e.g. from 5 to 8), of or below 7 (e.g. from 5 to 7), most preferably at a physiological pH, e.g. from 7.3 to 7.4. Accordingly, a cationic component may be any positively charged compound or polymer, preferably a cationic peptide or protein, which is positively charged under physiological conditions, particularly under physiological conditions in vivo. A "cationic peptide or protein" may contain at least one positively charged amino acid, or more than one positively charged amino acid, e.g. selected from Arg, His, Lys or Orn. Accordingly, "polycationic" components are also within the scope exhibiting more than one positive charge under the conditions given.

5'-cap: A 5'-cap is an entity, typically a modified nucleotide entity, which generally "caps" the 5'-end of a mature mRNA. A 5'-cap may typically be formed by a modified nucleotide, particularly by a derivative of a guanine nucleotide. Preferably, the 5'-cap is linked to the 5'-terminus via a 5'-5'-triphosphate linkage. A 5'-cap may be methylated, e.g. m7GpppN, wherein N is the terminal 5' nucleotide of the nucleic acid carrying the 5'-cap, typically the 5'-end of an RNA. Further examples of 5'-cap structures include glyceryl, inverted deoxy abasic residue (moiety), 4',5' methylene nucleotide, 1-(beta-D-erythrofuranosyl) nucleotide, 4'-thio nucleotide, carbocyclic nucleotide, 1,5-anhydrohexitol nucleotide, L-nucleotides, alpha-nucleotide, modified base nucleotide, threo-pentofuranosyl nucleotide, acyclic 3',4'-seco nucleotide, acyclic 3,4-dihydroxybutyl nucleotide, acyclic 3,5 dihydroxypentyl nucleotide, 3'-3'-inverted nucleotide moiety, 3'-3'-inverted abasic moiety, 3'-2'-inverted nucleotide moiety, 3'-2'-inverted abasic moiety, 1,4-butanediol phosphate, 3'-phosphoramidate, hexylphosphate, aminohexyl phosphate, 3'-phosphate, 3' phosphorothioate, phosphorodithioate, or bridging or non-bridging methylphosphonate moiety.

DNA: DNA is the usual abbreviation for deoxy-ribonucleic acid. It is a nucleic acid molecule, i.e. a polymer consisting of nucleotides. These nucleotides are usually deoxy-adenosine-monophosphate, deoxy-thymidine-monophosphate, deoxy-guanosine-monophosphate and deoxy-cytidine-monophosphate monomers which are—by themselves—composed of a sugar moiety (deoxyribose), a base moiety and a phosphate moiety, and polymerise by a characteristic backbone structure. The backbone structure is, typically, formed by phosphodiester bonds between the sugar moiety of the nucleotide, i.e. deoxyribose, of a first and a phosphate moiety of a second, adjacent monomer. The specific order of the monomers, i.e. the order of the bases linked to the sugar/phosphate-backbone, is called the DNA sequence.

DNA may be single stranded or double stranded. In the double stranded form, the nucleotides of the first strand typically hybridize with the nucleotides of the second strand, e.g. by A/T-base-pairing and G/C-base-pairing.

Fragment of a sequence: A fragment of a sequence may typically be a shorter portion of a full-length sequence of e.g. a nucleic acid molecule or an amino acid sequence. Accordingly, a fragment, typically, consists of a sequence that is identical to the corresponding stretch within the full-length sequence. A preferred fragment of a sequence in the context of the present invention, consists of a continuous stretch of entities, such as nucleotides or amino acids corresponding to a continuous stretch of entities in the molecule the fragment is derived from, which represents at least 20%, preferably at least 30%, more preferably at least 40%, more preferably at least 50%, even more preferably at least 60%, even more preferably at least 70%, and most preferably at least 80% of the total (i.e. full-length) molecule from which the fragment is derived.

G/C modified: A G/C-modified nucleic acid may typically be a nucleic acid, preferably an artificial nucleic acid molecule as defined herein, based on a modified wild type sequence comprising a preferably increased number of guanosine and/or cytosine nucleotides as compared to the wild type sequence. Such an increased number may be generated by substitution of codons containing adenosine or thymidine nucleotides by codons containing guanosine or cytosine nucleotides. If the enriched G/C content occurs in a coding region of DNA or RNA, it makes use of the degeneracy of the genetic code. Accordingly, the codon substitutions preferably do not alter the encoded amino acid residues, but exclusively increase the G/C content of the nucleic acid molecule. As used herein, the term "G/C modification" comprises, in particular, the modifications of the number of guanosine and/or cytosine nucleotides in the RNA according to the invention, such as GC optimization of sequences, adaptation of sequences to human codon usage, codon optimization, or C-optimization of sequences.

Gene therapy: Gene therapy may typically be understood to mean a treatment of a patient's body or isolated elements of a patient's body, for example isolated tissues/cells, by nucleic acids encoding a peptide or protein. It typically may comprise at least one of the steps of a) administration of a nucleic acid, preferably an RNA as defined herein, directly to the patient—by whatever administration route—or in vitro to isolated cells/tissues of the patient, which results in transfection of the patient's cells either in vivo/ex vivo or in vitro; b) transcription and/or translation of the introduced nucleic acid molecule; and optionally c) re-administration of isolated, transfected cells to the patient, if the nucleic acid has not been administered directly to the patient.

Heterologous sequence: Two sequences are typically understood to be "heterologous" if they are not derivable from the same gene. I.e., although heterologous sequences may be derivable from the same organism, they naturally (in nature) do not occur in the same nucleic acid molecule, such as in the same mRNA.

Cloning site: A cloning site is typically understood to be a segment of a nucleic acid molecule, which is suitable for insertion of a nucleic acid sequence, e.g., a nucleic acid sequence comprising an open reading frame. Insertion may be performed by any molecular biological method known to the one skilled in the art, e.g. by restriction and ligation. A cloning site typically comprises one or more restriction enzyme recognition sites (restriction sites). These one or more restrictions sites may be recognized by restriction enzymes which cleave the DNA at these sites. A cloning site which comprises more than one restriction site may also be termed a multiple cloning site (MCS) or a polylinker.

Nucleic acid molecule: A nucleic acid molecule is a molecule comprising, preferably consisting of nucleic acid components. The term "nucleic acid molecule" preferably refers to DNA or RNA molecules. It is preferably used synonymous with the term "polynucleotide". Preferably, a nucleic acid molecule is a polymer comprising or consisting of nucleotide monomers, which are covalently linked to each other by phosphodiester-bonds of a sugar/phosphate-backbone. The term "nucleic acid molecule" also encompasses modified nucleic acid molecules, such as base-modified, sugar-modified or backbone-modified etc. DNA or RNA molecules.

Open reading frame: An open reading frame (ORF) in the context of the invention may typically be a sequence of several nucleotide triplets, which may be translated into a peptide or protein. An open reading frame preferably contains a start codon, i.e. a combination of three subsequent nucleotides coding usually for the amino acid methionine (ATG), at its 5'-end and a subsequent region, which usually exhibits a length which is a multiple of 3 nucleotides. An ORF is preferably terminated by a stop-codon (e.g., TAA, TAG, TGA). Typically, this is the only stop-codon of the open reading frame. Thus, an open reading frame in the context of the present invention is preferably a nucleotide sequence, consisting of a number of nucleotides that may be divided by three, which starts with a start codon (e.g. ATG) and which preferably terminates with a stop codon (e.g., TAA, TGA, or TAG). The open reading frame may be isolated or it may be incorporated in a longer nucleic acid sequence, for example in a vector or an mRNA. An open reading frame may also be termed "(protein) coding region" or, preferably, "coding sequence".

Peptide: A peptide or polypeptide is typically a polymer of amino acid monomers, linked by peptide bonds. It typically contains less than 50 monomer units. Nevertheless, the term "peptide" is not a disclaimer for molecules having more than 50 monomer units. Long peptides are also called polypeptides, typically having between 50 and 600 monomeric units.

Pharmaceutically effective amount: A pharmaceutically effective amount in the context of the invention is typically understood to be an amount that is sufficient to induce a pharmaceutical effect.

Protein: A protein typically comprises one or more peptides or polypeptides. A protein is typically folded into 3-dimensional form, which may be required for the protein to exert its biological function.

Poly(A) sequence: A poly(A) sequence, also called poly(A) tail or 3'-poly(A) tail, is typically understood to be a sequence of adenosine nucleotides, e.g., of up to about 400 adenosine nucleotides, e.g. from about 20 to about 400, preferably from about 50 to about 400, more preferably from about 50 to about 300, even more preferably from about 50 to about 250, most preferably from about 60 to about 250 adenosine nucleotides. As used herein, a poly(A) sequence may also comprise about 10 to 200 adenosine nucleotides, preferably about 10 to 100 adenosine nucleotides, more preferably about 40 to 80 adenosine nucleotides or even more preferably about 50 to 70 adenosine nucleotides. A poly(A) sequence is typically located at the 3'-end of an mRNA. In the context of the present invention, a poly(A) sequence may be located within an mRNA or any other nucleic acid molecule, such as, e.g., in a vector, for example, in a vector serving as template for the generation of an RNA, preferably an mRNA, e.g., by transcription of the vector.

Polyadenylation: Polyadenylation is typically understood to be the addition of a poly(A) sequence to a nucleic acid molecule, such as an RNA molecule, e.g. to a premature mRNA. Polyadenylation may be induced by a so-called polyadenylation signal. This signal is preferably located within a stretch of nucleotides at the 3'-end of a nucleic acid molecule, such as an RNA molecule, to be polyadenylated. A polyadenylation signal typically comprises a hexamer consisting of adenine and uracil/thymine nucleotides, preferably the hexamer sequence AAUAAA. Other sequences, preferably hexamer sequences, are also conceivable. Polyadenylation typically occurs during processing of a pre-mRNA (also called premature-mRNA). Typically, RNA maturation (from pre-mRNA to mature mRNA) comprises the step of polyadenylation.

Restriction site: A restriction site, also termed restriction enzyme recognition site, is a nucleotide sequence recognized by a restriction enzyme. A restriction site is typically a short, preferably palindromic nucleotide sequence, e.g. a sequence comprising 4 to 8 nucleotides. A restriction site is preferably specifically recognized by a restriction enzyme. The restriction enzyme typically cleaves a nucleotide sequence comprising a restriction site at this site. In a double-stranded nucleotide sequence, such as a double-stranded DNA sequence, the restriction enzyme typically cuts both strands of the nucleotide sequence.

RNA, mRNA: RNA is the usual abbreviation for ribonucleic-acid. It is a nucleic acid molecule, i.e. a polymer consisting of nucleotides. These nucleotides are usually adenosine-monophosphate, uridine-monophosphate, guanosine-monophosphate and cytidine-monophosphate monomers which are connected to each other along a so-called backbone. The backbone is formed by phosphodiester bonds between the sugar, i.e. ribose, of a first and a phosphate moiety of a second, adjacent monomer. The specific succession of the monomers is called the RNA-sequence. Usually RNA may be obtainable by transcription of a DNA-sequence, e.g., inside a cell. In eukaryotic cells, transcription is typically performed inside the nucleus or the mitochondria. In vivo, transcription of DNA usually results in the so-called premature RNA which has to be processed into so-called messenger-RNA, usually abbreviated as mRNA. Processing of the premature RNA, e.g. in eukaryotic organisms, comprises a variety of different posttranscriptional-modifications such as splicing, 5'-capping, polyadenylation, export from the nucleus or the mitochondria and the like. The sum of these processes is also called maturation of RNA. The mature messenger RNA usually provides the nucleotide sequence that may be translated into an amino-acid sequence of a particular peptide or protein. Typically, a mature mRNA comprises a 5'-cap, a 5'-UTR, an open reading frame, a 3'-UTR and a poly(A) sequence. Aside from messenger RNA, several non-coding types of RNA exist which may be involved in regulation of transcription and/or translation.

Sequence of a nucleic acid molecule: The sequence of a nucleic acid molecule is typically understood to be the particular and individual order, i.e. the succession of its nucleotides. The sequence of a protein or peptide is typically understood to be the order, i.e. the succession of its amino acids.

Sequence identity: Two or more sequences are identical if they exhibit the same length and order of nucleotides or amino acids. The percentage of identity typically describes the extent to which two sequences are identical, i.e. it typically describes the percentage of nucleotides that correspond in their sequence position with identical nucleotides of a reference-sequence. For determination of the degree of identity, the sequences to be compared are considered to exhibit the same length, i.e. the length of the longest sequence of the sequences to be compared. This means that a first sequence consisting of 8 nucleotides is 80% identical to a second sequence consisting of 10 nucleotides comprising the first sequence. In other words, in the context of the present invention, identity of sequences preferably relates to the percentage of nucleotides of a sequence which have the same position in two or more sequences having the same length. Gaps are usually regarded as non-identical positions, irrespective of their actual position in an alignment.

Stabilized nucleic acid molecule: A stabilized nucleic acid molecule is a nucleic acid molecule, preferably a DNA or RNA molecule that is modified such, that it is more stable to disintegration or degradation, e.g., by environmental factors or enzymatic digest, such as by an exo- or endonuclease degradation, than the nucleic acid molecule without the modification. Preferably, a stabilized nucleic acid molecule in the context of the present invention is stabilized in a cell, such as a prokaryotic or eukaryotic cell, preferably in a mammalian cell, such as a human cell. The stabilization effect may also be exerted outside of cells, e.g. in a buffer solution etc., for example, in a manufacturing process for a pharmaceutical composition comprising the stabilized nucleic acid molecule.

Transfection: The term "transfection" refers to the introduction of nucleic acid molecules, such as DNA or RNA (e.g. mRNA) molecules, into cells, preferably into eukaryotic cells. In the context of the present invention, the term "transfection" encompasses any method known to the skilled person for introducing nucleic acid molecules into cells, preferably into eukaryotic cells, such as into mammalian cells. Such methods encompass, for example, electroporation, lipofection, e.g. based on cationic lipids and/or liposomes, calcium phosphate precipitation, nanoparticle based transfection, virus based transfection, or transfection based on cationic polymers, such as DEAE-dextran or polyethylenimine etc. Preferably, the introduction is non-viral.

Vector: The term "vector" refers to a nucleic acid molecule, preferably to an artificial nucleic acid molecule. A vector in the context of the present invention is suitable for incorporating or harboring a desired nucleic acid sequence, such as a nucleic acid sequence comprising an open reading frame. Such vectors may be storage vectors, expression vectors, cloning vectors, transfer vectors etc. A storage vector is a vector, which allows the convenient storage of a nucleic acid molecule, for example, of an mRNA molecule. Thus, the vector may comprise a sequence corresponding, e.g., to a desired mRNA sequence or a part thereof, such as a sequence corresponding to the coding sequence and the 3'-UTR of an mRNA. An expression vector may be used for production of expression products such as RNA, e.g. mRNA, or peptides, polypeptides or proteins. For example, an expression vector may comprise sequences needed for transcription of a sequence stretch of the vector, such as a promoter sequence, e.g. an RNA polymerase promoter sequence. A cloning vector is typically a vector that contains a cloning site, which may be used to incorporate nucleic acid sequences into the vector. A cloning vector may be, e.g., a plasmid vector or a bacteriophage vector. A transfer vector may be a vector, which is suitable for transferring nucleic acid molecules into cells or organisms, for example, viral vectors. A vector in the context of the present invention may be, e.g., an RNA vector or a DNA vector. Preferably, a vector is a DNA molecule. Preferably, a vector in the sense of the present application comprises a cloning site, a selection marker, such as an antibiotic resistance factor, and a sequence suitable for multiplication of the vector, such as an origin of replication. Preferably, a vector in the context of the present application is a plasmid vector.

Vehicle: A vehicle is typically understood to be a material that is suitable for storing, transporting, and/or administering a compound, such as a pharmaceutically active compound. For example, it may be a physiologically acceptable liquid, which is suitable for storing, transporting, and/or administering a pharmaceutically active compound. 3'-untranslated region (3'-UTR): Generally, the term "3'-UTR" refers to a part of the artificial nucleic acid molecule, which is located 3' (i.e. "downstream") of an open reading frame and which is not translated into protein. Typically, a 3'-UTR is the part of an mRNA which is located between the protein coding region (open reading frame (ORF) or coding sequence (CDS)) and the poly(A) sequence of the mRNA. In the context of the invention, the term "3'-UTR" may also comprise elements, which are not encoded in the template, from which an RNA is transcribed, but which are added after transcription during maturation, e.g. a poly(A) sequence. A 3'-UTR of the mRNA is not translated into an amino acid sequence. The 3'-UTR sequence is generally encoded by the gene, which is transcribed into the respective mRNA during the gene expression process. The genomic sequence is first transcribed into pre-mature mRNA, which comprises optional introns. The pre-mature mRNA is then further processed into mature mRNA in a maturation process. This maturation process comprises the steps of 5'-capping, splicing the pre-mature mRNA to excise optional introns and modifications of the 3'-end, such as polyadenylation of the 3'-end of the pre-mature mRNA and optional endo-/or exonuclease cleavages etc. In the context of the present invention, a 3'-UTR corresponds to the sequence of a mature mRNA, which is located between the stop codon of the protein coding region, preferably immediately 3' to the stop codon of the protein coding region, and the poly(A) sequence of the mRNA. The term "corresponds to" means that the 3'-UTR sequence may be an RNA sequence, such as in the mRNA sequence used for defining the 3'-UTR sequence, or a DNA sequence, which corresponds to such RNA sequence. In the context of the present invention, the term "a 3'-UTR of a gene", such as "a 3'-UTR of a ribosomal protein gene", is the sequence, which corresponds to the 3'-UTR of the mature mRNA derived from this gene, i.e. the mRNA obtained by transcription of the gene and maturation of the pre-mature mRNA. The term "3'-UTR of a gene" encompasses the DNA sequence and the RNA sequence (both sense and antisense strand and both mature and immature) of the 3'-UTR.

5'-untranslated region (5'-UTR): A 5'-UTR is typically understood to be a particular section of messenger RNA (mRNA). It is located 5' of the open reading frame of the mRNA. Typically, the 5'-UTR starts with the transcriptional start site and ends one nucleotide before the start codon of the open reading frame. The 5'-UTR may comprise elements for controlling gene expression, also called regulatory elements. Such regulatory elements may be, for example, ribosomal binding sites. The 5'-UTR may be post-transcriptionally modified, for example by addition of a 5'-cap. In the context of the present invention, a 5'-UTR corresponds to the sequence of a mature mRNA, which is located between the 5'-cap and the start codon. Preferably, the 5'-UTR corresponds to the sequence, which extends from a nucleotide located 3' to the 5'-cap, preferably from the nucleotide located immediately 3' to the 5'-cap, to a nucleotide located 5' to the start codon of the protein coding region, preferably to the nucleotide located immediately 5' to the start codon of the protein coding region. The nucleotide located immediately 3' to the 5'-cap of a mature mRNA typically corresponds to the transcriptional start site. The term "corresponds to" means that the 5'-UTR sequence may be an RNA sequence, such as in the mRNA sequence used for defining the 5'-UTR sequence, or a DNA sequence, which corresponds to such RNA sequence. In the context of the present invention, the term "a 5'-UTR of a gene" is the sequence, which corresponds to the 5'-UTR of the mature mRNA derived from this gene, i.e. the mRNA obtained by transcription of the gene and maturation of the pre-mature mRNA. The term "5'-UTR of a gene" encompasses the DNA sequence and the RNA sequence of the 5'-UTR. By the inventive embodiments such a 5'-UTR may be provided 5'-terminal to the coding sequence. Its length is typically less than 500, 400, 300, 250 or less than 200 nucleotides. In other embodiments its length may be in the range of at least 10, 20, 30 or 40, preferably up to 100 or 150, nucleotides.

5'-Terminal Oligopyrimidine Tract (TOP): The 5'-terminal oligopyrimidine tract (TOP) is typically a stretch of pyrimidine nucleotides located in the 5'-terminal region of a nucleic acid molecule, such as the 5'-terminal region of certain mRNA molecules or the 5'-terminal region of a functional entity, e.g. the transcribed region, of certain genes. The sequence starts with a cytidine, which usually corresponds to the transcriptional start site, and is followed by a stretch of usually about 3 to 30 pyrimidine nucleotides. For example, the TOP may comprise 3, 4, 5, 6, 7, 8, 9, 10, 11, 12, 13, 14, 15, 16, 17, 18, 19, 20, 21, 22, 23, 24, 25, 26, 27, 28, 29, 30 or even more nucleotides. The pyrimidine stretch and thus the 5' TOP ends one nucleotide 5' to the first purine nucleotide located downstream of the TOP. Messenger RNA that contains a 5'-terminal oligopyrimidine tract is often referred to as TOP mRNA. Accordingly, genes that provide such messenger RNAs are referred to as TOP genes. TOP sequences have, for example, been found in genes and mRNAs encoding peptide elongation factors and ribosomal proteins.

TOP motif: In the context of the present invention, a TOP motif is a nucleic acid sequence which corresponds to a 5'TOP as defined above. Thus, a TOP motif in the context of the present invention is preferably a stretch of pyrimidine nucleotides having a length of 3-30 nucleotides. Preferably, the TOP-motif consists of at least 3 pyrimidine nucleotides, preferably at least 4 pyrimidine nucleotides, preferably at least 5 pyrimidine nucleotides, more preferably at least 6 nucleotides, more preferably at least 7 nucleotides, most preferably at least 8 pyrimidine nucleotides, wherein the stretch of pyrimidine nucleotides preferably starts at its 5'-end with a cytosine nucleotide. In TOP genes and TOP mRNAs, the TOP-motif preferably starts at its 5'-end with the transcriptional start site and ends one nucleotide 5' to the first purin residue in said gene or mRNA. A TOP motif in the sense of the present invention is preferably located at the 5'-end of a sequence, which represents a 5'-UTR, or at the 5'-end of a sequence, which codes for a 5'-UTR. Thus, preferably, a stretch of 3 or more pyrimidine nucleotides is called "TOP motif" in the sense of the present invention if this stretch is located at the 5'-end of a respective sequence, such as the artificial nucleic acid molecule, the 5'-UTR element of the artificial nucleic acid molecule, or the nucleic acid sequence which is derived from the 5'-UTR of a TOP gene as described herein. In other words, a stretch of 3 or more pyrimidine nucleotides, which is not located at the 5'-end of a 5'-UTR or a 5'-UTR element but anywhere within a 5'-UTR or a 5'-UTR element, is preferably not referred to as "TOP motif".

TOP gene: TOP genes are typically characterised by the presence of a 5'-terminal oligopyrimidine tract. Furthermore, most TOP genes are characterized by a growth-associated translational regulation. However, also TOP genes with a tissue specific translational regulation are known. As defined above, the 5'-UTR of a TOP gene corresponds to the sequence of a 5'-UTR of a mature mRNA derived from a TOP gene, which preferably extends from the nucleotide located 3' to the 5'-cap to the nucleotide located 5' to the start codon. A 5'-UTR of a TOP gene typically does not comprise any start codons, preferably no upstream AUGs (uAUGs) or upstream open reading frames (uORFs). Therein, upstream AUGs and upstream open reading frames are typically understood to be AUGs and open reading frames that occur 5' of the start codon (AUG) of the open reading frame that should be translated. The 5'-UTRs of TOP genes are generally rather short. The lengths of 5'-UTRs of TOP genes may vary between 20 nucleotides up to 500 nucleotides, and are typically less than about 200 nucleotides, preferably less than about 150 nucleotides, more preferably less than about 100 nucleotides. Exemplary 5'-UTRs of TOP genes in the sense of the present invention are the nucleic acid sequences extending from the nucleotide at position 5 to the nucleotide located immediately 5' to the start codon (e.g. the ATG) in the sequences according to SEQ ID Nos. 1-1363 of the patent application WO2013/143700, whose disclosure is incorporated herewith by reference. In this context, a particularly preferred fragment of a 5'-UTR of a TOP gene is a 5'-UTR of a TOP gene lacking the 5'TOP motif. The terms "5'-UTR of a TOP gene" or "5'TOP-UTR" preferably refer to the 5'-UTR of a naturally occurring TOP gene.

DETAILED DESCRIPTION OF THE INVENTION

The inventors surprisingly discovered that the RNA according to the invention is capable of providing sufficient expression of the therapeutic protein, in particular a collagenase, growth factor, cytokine, chaperone or signal transduction inhibitor as defined herein, encoded in the at least one coding region upon administration of the RNA to cells or to a patient suffering from a wound, so as to effectively promote wound healing.

The present invention thus provides an RNA comprising at least one coding sequence encoding a a therapeutic protein, in particular a collagenase, growth factor, cytokine, chaperone or signal transduction inhibitor as defined herein, or a fragment or variant of said therapeutic protein. Said RNA is in particular envisaged for use in a method of treating wounds. Preferably, said RNA is used in a method for promoting or inducing wound healing.

The present disclosure thus relates to an RNA as such, and an RNA for use in the methods defined herein. When referring to "an RNA according to the invention", the disclosure also relates to an "RNA for the use according to the invention", and vice versa.

The RNA according to the present invention preferably comprises at least one coding sequence encoding at least one therapeutic protein, or a fragment or variant thereof, wherein the therapeutic protein is selected from a collagenase as defined herein or a fragment or variant thereof, a growth factor as defined herein or a fragment or variant thereof, a cytokine as defined herein or a fragment or variant thereof, a chaperone as defined herein or a fragment or variant thereof, or a signal transduction inhibitor as defined herein or a fragment or variant thereof. According to a preferred embodiment, the RNA according to the present invention comprises at least one coding sequence encoding at least one collagenase as defined herein or a fragment or variant thereof.

Preferably, said collagenase is selected from MMP1; ColG; ColH; MMP8; MMP9; or MMP13 or a fragment or variant thereof; said growth factor is selected from AMELX; AMELY; ssAMELX; ssAMELX-001-1; ssAMELX-001-2; ssAMELX-002; ssAMELX-003; ssAMELX-004; ssAMELX-201; BMP1; BMP2; BMP4; BMP6; BMP7; EGF; EREG; FGF1; FGF2; FGF7; FGF21, HBEGF; HGF; IGF1; IGF2; INHBA; INHBB; PDGFA; PDGFB; PDGFC; PDGFD; TGFA; TGFB1; TGFB2; TGFB3; PGF; VEGFA; VEGFA; VEGFB; VEGFC or VEGFD or a fragment or variant thereof; said cytokine is selected from IL6 or CCL7 or a fragment or variant thereof; said receptor is selected from ITGAM, CCR1 or TNFRSF1B or a fragment or variant thereof; said chaperone is selected from HSPA1A; HSPA1B; HSPA1L; HSPA2; HSPA4; HSPA4L; HSPA5; HSPA6; HSPA7; HSPA8; HSPA9; HSPA12A; HSPA12B; HSPA13; HSPA14; HSPH1; HSP90AA1; HSP90AA3P; HSP90AB1; HSP90B1; HYOU1 or TRAP1 or a fragment or variant thereof; or said signal transduction inhibitor is selected from SOCS3.

Unless denoted otherwise, human forms of the proteins and peptidesn are particularly envisaged herein and may be identified by a prefixed "hs" or "Hs" (*Homo sapiens*). However, orthologs derived from other species are generally also encompassed. Specifically, proteins and peptides derived from the pig may be identified by a prefixed "ss" (*Sus scrofa*). Proteins and peptides derived from the mouse may be identified by a prefixed "mm" or "Mm" (*Mus musculus*).

In the context of the present invention, "fragments" and "variants" are preferably functional, i.e. capable of exerting the same desired biological functions as the "parent" sequences or molecules that the fragment or variant is derived from. A "biological function" is the desired activity that is mediated by a given entity in its native environment. Desired biological functios of the therapeutic proteins envisaged herein are described below.

As used herein, the term "therapeutic protein" preferably refers to any one of the peptides or proteins described herein, more preferably to any one of the peptides or proteins specified in Table 1 herein. The at least one coding sequence of the RNA according to the invention thus preferably encodes a peptide or protein comprising or consisting of a therapeutic protein selected from the peptides or proteins provided in Table 1, or a fragment or variant thereof. In particular, the at least one coding sequence of the RNA according to the thus preferably encodes a peptide or protein comprising or consisting of a collagenase, growth factor, cytokine, chaperone or a signal transduction inhibitorselected from the peptides or proteins provided in Table 1.

The present invention provides at least one RNA, in particular at least one RNA sequence, comprising at least one coding sequence encoding a collagenase, growth factor, cytokine, chaperone or a signal transduction inhibitor as defined herein. Said RNA is particularly envisaged for use in a method of treating wounds and specifically, for promoting wound healing.

RNA

In the context of the present invention, the therapeutic protein encoded by the at least one coding sequence of the RNA, in particular RNA sequence, is preferably a collagenase, growth factor, cytokine, chaperone or a signal transduction inhibitor as defined herein.

Collagenases

"Collagenases" are endoproteases (i.e., proteinases) which are capable of cleaving collagen molecules at its triple-helical main structure.

As used herein, the term "collagenase" preferably refers to any one of the MMP1, ColH, ColG, MMP8, MMP9 or MMP13 polypeptides provided in Table 1 herein. The at least one coding sequence of the RNA according to the invention thus preferably encodes a collagenase, particularly a collagenase selected from the MMP1, ColH, ColG, MMP8, MMP9 or MMP13 collagenases provided in Table 1, or a fragment or variant thereof. Particularly preferred collagenases include the collagenases selected from the MMP1, ColH, ColG collagenases provided in Table 1, or a fragment or variant thereof.

Matrix metalloproteinases (MMPs), also known as matrixins, are calcium-dependent zinc-containing endopeptidases. MMPs are initially synthesized as inactive zymogens with a pro-peptide domain that is removed before the enzyme is active. Some MMPs have collagenase activity, including MMP1, MMP8, MMP9, and MMP13. Said MMPs are therefore referred to as "collagenases" herein.

The term "MMP1" as used herein refers to the (preferably human) "matrix metalloproteinase-1" or "interstitial collagenase" encoded by the MMP1 gene or an allelic variant or ortholog thereof. In a preferred embodiment, the RNA according to the invention comprises at least one coding sequence encoding a MMP-1 collagenase or a fragment or variant thereof. In a preferred embodiment, said MMP1 collagenase comprises or consists of an amino acid sequence according to SEQ ID NO: 7 or a fragment or variant thereof. Said RNA may preferably comprise or consist of a RNA sequence according to SEQ ID NO: 106 or 107 or a fragment or variant thereof (e.g. SEQ ID NO: 217). In a preferred embodiment, the RNA according to the invention comprises at least one coding sequence encoding a MMP1 collagenase lacking the activation peptide sequence (amino acids 20 to 99 of SEQ ID NO: 7). Said MMP1 copllagenase preferably comprises or consists of an amino acid sequence according to SEQ ID NO: 8. Said RNA may preferably comprise or consist of a RNA sequence according to SEQ ID NO: 108 or a fragment or variant thereof (e.g. SEQ ID NO: 218).

The term "ColG" as used herein refers to the *Clostridium histolyticum* (Hatheway *histolytica*) collagenase G encoded by the colG gene or a variant thereof. In a preferred embodiment, the RNA according to the invention comprises at least one coding sequence encoding a ColG collagenase or a fragment or variant thereof. In a preferred embodiment, said ColG collagenase comprises or consists of an amino acid sequence according to SEQ ID NO: 9 or a fragment or variant thereof. Said RNA may preferably comprise or consist of a RNA sequence according to SEQ ID NO: 109 or 110 or a fragment or variant thereof (e.g. SEQ ID NO: 219). In a preferred embodiment, the ColG collagenase may be modified to comprise a signal peptide selected from HLA-A2; PLAT; sEPO; ALB; PLAT(1-21); PLAT(1-22); IgE-leader; CD5(1-24); IL2(1-20); CTRB2(1-18); IgG-HC(1-19); Ig-HC(1-19); Ig-LC(1-19); GpLuc(1-17); Igkappa or a fragment or variant thereof, preferably the human ALB signal peptide according to SEQ ID NO: 4 or a fragment or variant thereof. In a preferred embodiment, the RNA according to the invention therefore encodes a ColG collagenase comprising or consisting of an amino acid sequence according to SEQ ID NO: 10 or a fragment or variant thereof. Said RNA may preferably comprise or consist of a RNA sequence according to SEQ ID NO: 111 or 112 or a fragment or variant thereof (e.g. SEQ ID NO: 220). Preferably, said ColG collagenase may further comprise a Furin cleavage site according to SEQ ID NO: 103. In a further preferred embodiment, the RNA according to the invention therefore encodes a ColG collagenase comprising or consisting of an amino acid sequence according to SEQ ID NO: 11 or a fragment or variant thereof. Said RNA may preferably comprise or consist of a RNA sequence according to SEQ ID NO: 113 or 114 or a fragment or variant thereof (e.g. SEQ ID NO: 221).

The term "ColH" as used herein refers to the *Clostridium histolyticum* (Hatheway *histolytica*) collagenase H encoded by the colH gene or a variant thereof.

In a preferred embodiment, the RNA according to the invention comprises at least one coding sequence encoding a ColH collagenase or a fragment or variant thereof. In a preferred embodiment, said ColH collagenase comprises or consists of an amino acid sequence according to SEQ ID NO: 12 or 13 or a fragment or variant thereof. RNA may preferably comprise or consist of a RNA sequence according to SEQ ID NO: 115, 116, 117 or 118 or a fragment or variant thereof (e.g. SEQ ID NO: 222 or 223). In a preferred embodiment, the ColH collagenase may be modified to comprise a signal peptide selected from HLA-A2; PLAT; sEPO; ALB; PLAT(1-21); PLAT(1-22); IgE-leader; CD5(1-24); IL2(1-20); CTRB2(1-18); IgG-HC(1-19); Ig-HC(1-19); Ig-LC(1-19); GpLuc(1-17); Igkappa or a fragment or variant thereof, preferably the human ALB signal peptide according to SEQ ID NO: 4 or a fragment or variant thereof. In a preferred embodiment, the RNA according to the invention therefore encodes a ColH collagenase comprising or consisting of an amino acid sequence according to SEQ ID NO: 14 or a fragment or variant thereof. Said RNA may preferably comprise or consist of a RNA sequence according to SEQ ID NO: 119 or 120 or a fragment or variant thereof (e.g. SEQ ID NO: 224). Preferably, said ColH collagenase may further comprise a Furin cleavage site according to SEQ ID NO: 103. In a further preferred embodiment, the RNA according to the invention therefore encodes a ColH collagenase comprising or consisting of an amino acid sequence according to SEQ ID NO: 15 or a fragment or variant thereof. Said RNA may preferably comprise or consist of a RNA sequence according to SEQ ID NO: 121 or 122 or a fragment or variant thereof (e.g. SEQ ID NO: 225).

In the context of the present invention, the term "extracellular matrix protease" refers to an enzyme capable of catalyzing the degradation of extracellular matrix protein. As used herein, an "extracellular matrix protein" is preferably any type of extracellular matrix protein, more preferably a collagen, even more preferably selected from an interstitial collagen and a basement membrane collagen, most preferably selected from a type I, type III and type IV collagen. The term "extracellular matrix protease" as used herein preferably refers to collagenases, more preferably to bacterial collagenases or mammalian matrix metalloproteinases (also referred to herein as "mammalian collagenases") as described herein. Examples of bacterial collagenase include clostridial collagenases, more preferably a clostridial type II collagenase, most preferably a type II collagenase from *Clostridium histolyticum* (such as ColG or ColH). An exemplary mammalian matrix metalloproteinase is, for instance, human matrix metalloproteinase-1 (MMP1).

Extracellular matrix proteases, such as bacterial or mammalian collagenases, are typically expressed as precursor protein, which is usually inactive. Said precursor protein can be activated by cellular enzymes, which remove a regulatory domain, e.g. by proteolytic cleavage at a determined cleavage site. According to a preferred embodiment of the present invention, the at least one coding sequence of the RNA encodes at least one peptide or protein comprising or consisting a collagenase, preferably a bacterial collagenase or a mammalian matrix metalloproteinase, or a fragment or variant thereof, lacking said regulatory domain. Collagenases lacking the regulatory domain are preferably active upon expression, even without prior activation.

Growth Factors

"Growth factors" are proteins that regulate (typically: promote) cell proliferation, differentiation and/or survival. The term is used herein to refer to all polypeptides, particularly those provided in Table 1, which have a growth factor-like activity as defined above.

As used herein, the term "growth factor" preferably refers to any one of the growth factors provided in Table 1 herein. The at least one coding sequence of the RNA according to the invention may thus encode a growth factor selected from the growth factors provided in Table 1, or a fragment or variant thereof.

Preferably, said growth factor is preferably selected from the group consisting of AMELX; AMELY; ssAMELX; ssAMELX-001-1; ssAMELX-001-2; ssAMELX-002; ssA-MELX-003; ssAMELX-004; ssAMELX-201; BMP1; BMP2; BMP4; BMP6; BMP7; EGF; EREG; FGF1; FGF2; FGF7; FGF21; HBEGF; HGF; IGF1; IGF2; INHBA; INHBB; PDGFA; PDGFB; PDGFC; PDGFD; TGFA; TGFB1; TGFB2; TGFB3; PGF; VEGFA; VEGFA; VEGFB; VEGFC or VEGFD, or a fragment or variant of any of said polypeptides, preferably as defined in table 1.

Cytokines

"Cytokines" are small proteins (~5-20 kDa) implicated in cell signalling. Cytokines are involved in autocrine signalling, paracrine signalling and endocrine signalling as immunomodulating agents. Cytokines include chemokines, interferons, interleukins, lymphokines, and tumour necrosis factors but generally not hormones or growth factors (despite some overlap in the terminology).

As used herein, the term "cytokine" preferably refers to any one of the cytokines provided in Table 1 herein. The at least one coding sequence of the RNA according to the invention may thus encode a cytokine selected from the cytokines provided in Table 1, or a fragment or variant thereof.

Preferably, said cytokine is selected from the group consisting of CCL7 or IL6, or a fragment or variant of any of said polypeptides, preferably as defined in table 1.

Chaperones

"Chaperones" are proteins that assist the covalent folding or unfolding and the assembly or disassembly of other macromolecular structures. Many chaperones are heat shock proteins, i.e., proteins expressed in response to elevated temperatures or other cellular stresses.

Cytokines include chemokines, interferons, interleukins, lymphokines, and tumour necrosis factors but generally not hormones or growth factors (despite some overlap in the terminology).

As used herein, the term "chaperone" preferably refers to any one of the cytokines provided in Table 1 herein. The at least one coding sequence of the RNA according to the invention may thus encode a chaperone selected from the cytokines provided in Table 1, or a fragment or variant thereof.

Preferably, said chaperone is selected from the group consisting of HSPA1A; HSPA1B; HSPA1L; HSPA2; HSPA4; HSPA4L; HSPA5; HSPA6; HSPA7; HSPA8; HSPA9; HSPA12A; HSPA12B; HSPA13; HSPA14; HSPH1; HSP90AA1; HSP90AA3P; HSP90AB1; HSP90131; HYOU1 or TRAP1 or a fragment or variant of any of said polypeptides, preferably as defined in table 1.

Receptors

Receptors are molecule on the cell surface (cell-surface or membrane receptor) or within a cell, usually in its nucleus (nuclear receptor) that are capable of recognizing and specifically binding with their ligands, usually resulting in receptor-mediated signaling within the cell.

As used herein, the term "receptor" preferably refers to any one of the cytokines provided in Table 1 herein. The at least one coding sequence of the RNA according to the invention may thus encode a receptor selected from the cytokines provided in Table 1, or a fragment or variant thereof.

Preferably, said receptor is selected from the group consisting of ITGAM, CCR1 or TNFRSF1B or a fragment or variant of any of said polypeptides, preferably as defined in table 1.

Signal Transduction Inhibitors

Signal transduction inhibitors are molecules capable of negatively regulating the signaling function of signaling molecules (such as receptor ligands).

As used herein, the term "signal transduction inhibitor" preferably refers to SOCS3 provided in Table 1 herein. The at least one coding sequence of the RNA according to the invention may thus encode a SOCS3 as provided in Table 1, or a fragment or variant thereof.

It is further preferred that the at least one coding sequence of the RNA of the present invention encodes a therapeutic protein selected from a collagenase, growth factor, cytokine, chaperone or a signal transduction inhibitor as defined herein, or a fragment or variant of said therapeutic protein, wherein the therapeutic protein is selected from the proteins and pepties listed in Table 1. Therein, each row corresponds to a therapeutic protein as identified by the respective gene name (first column "Gene Name") and the database accession number of the corresponding protein (second column "Protein Accession No."). The third column ("A") in Table 1 indicates the SEQ ID NO: corresponding to the respective amino acid sequence as provided herein. The SEQ ID NO: corresponding to the nucleic acid sequence of the (wild type) RNA encoding the therapeutic protein as indicated in the fourth column ("B"). The fifth column ("C") provides the SEQ ID NO: 's corresponding to modified nucleic acid sequences of the RNAs as described herein that encode the therapeutic protein preferably having the amino acid sequence as defined by the SEQ ID NO: indicated in the third column ("A") or by the database entry indicated in the second column ("Protein Accession No.").

For example, the at least one coding region of the RNA according to the invention may encode the collagenase "ColH" (see Table 1, fourth row), as referenced in the GenBank database under "BAA34542.1" (see Table 1, fourth row, third column). The full-length amino acid sequence of the ColH collagenase as used herein is indicated in the third column and is defined by SEQ ID NO: 12, 13, 14 or 15. In the case of an RNA encoding ColH or a fragment or variant thereof, the at least one coding region of the RNA may thus comprise or consist of, for example, the nucleic acid sequence according to SEQ ID NO: 115; 116; 117; 118; 119; 120; 121 or 122 (see Table 1, fourth row, fourth column) or a fragment or variant thereof, or, alternatively, any one of the nucleic acid sequences according to SEQ ID NO: 222 to 1292, or a fragment or variant of any one of these sequences.

TABLE 1

List of therapeutic proteins

| # | Gene name | Protein Acc. No. | A | B | C |
|---|---|---|---|---|---|
| | | | Collagenases | | |
| 1 | MMP1 | P03956 | 7; 8 | 106; 107; 108 | 217; 218; 314; 315; 411; 412; 508; 509; 605; 606; 702; 703; 799; 800; 896; 897; 993; 994; 1090; 1091; 1187; 1188; 1284; 1285 |
| 2 | ColG | BAA77453.1 | 9; 10; 11; 5192; 5193 | 109; 110; 111; 112; 113 | 219; 220; 221; 316; 317; 318; 413; 414; 415; 510; 511; 512; 607; 608; 609; 704; 705; 706; 801; 802; 803; 898; 899; 900; 995; 996; 997; 1092; 1093; 1094; 1189; 1190; 1191; 1286; 1287; 1288; 5196; 5197; 5198; 5199; 5204; 5205; 5208; 5209; 5212; |

TABLE 1-continued

List of therapeutic proteins

| # | Gene name | Protein Acc. No. | A | B | C |
|---|---|---|---|---|---|
| | | | | 114; | 5213; 5216; 5217; 5220; 5221; 5224; 5225; 5228; 5229; 5232; 5233; 5236; 5237; 5240; 5241; 5244; 5245; 5248; 5249. |
| 3 | ColH | BAA34542.1 | 12; 13; 14; 15; 5194 or 5195 | 115; 116; 117; 118; 119; 120; 121; 122 | 222; 223; 224; 225; 319; 320; 321; 322; 416; 417; 418; 419; 513; 514; 515; 516; 610; 611; 612; 613; 707; 708; 709; 710; 804; 805; 806; 807; 901; 902; 903; 904; 998; 999; 1000; 1001; 1095; 1096; 1097; 1098; 1192; 1193; 1194; 1195; 1289; 1290; 1291; 1292; 5200; 5201; 5202; 5203; 5206; 5207; 5210; 5211; 5214; 5215; 5218; 5219; 5222; 5223; 5226; 5227; 5230; 5231; 5234; 5235; 5238; 5239; 5242; 5243; 5246; 5247; 5250; 5251. |
| 4 | MMP8 | NP_002415.1 P22894 | 78 | 191 | 288; 385; 482; 579; 676; 773; 870; 967; 1064; 1161; 1258; 1355 |
| 5 | MMP9 | NP_004985.2 P14780 | 79 | 192 | 289; 386; 483; 580; 677; 774; 871; 968; 1065; 1162; 1259; 1356 |
| 6 | MMP13 | NP_002418.1 P45452 | 80 | 193 | 290; 387; 484; 581; 678; 775; 872; 969; 1066; 1163; 1260; 1357 |
| | | | | Growth factors | |
| 7 | FGF21 | Q9NSA1 | 6 | 104; 105 | 216; 313; 410; 507; 604; 701; 798; 895; 992; 1089; 1186; 1283 |
| 8 | AMELX | NP_001133.1 Q99217 | 16; 17; 18; 19; 20 | 123; 124; 125; 126; 127; 128; 129 | 226; 227; 228; 229; 230; 323; 324; 325; 326; 327; 420; 421; 422; 423; 424; 517; 518; 519; 520; 521; 614; 615; 616; 617; 618; 711; 712; 713; 714; 715; 808; 809; 810; 811; 812; 905; 906; 907; 908; 909; 1002; 1003; 1004; 1005; 1006; 1099; 1100; 1101; 1102; 1103; 1196; 1197; 1198; 1199; 1200; 1293; 1294; 1295; 1296; 1297; |
| 9 | AMELY | NP_001134.1 Q99218 | 21; 22; 23; 24; 25 | 130; 131; 132; 133; 134; 135; 136 | 231; 232; 233; 234; 235; 328; 329; 330; 331; 332; 425; 426; 427; 428; 429; 522; 523; 524; 525; 526; 619; 620; 621; 622; 623; 716; 717; 718; 719; 720; 813; 814; 815; 816; 817; 910; 911; 912; 913; 914; 1007; 1008; 1009; 1010; 1011; 1104; 1105; 1106; 1107; 1108; 1201; 1202; 1203; 1204; 1205; 1298; 1299; 1300; 1301; 1302 |
| 10 | AMELX-001-1 | NP_998965.1 P45561-3 | 26; 27; 28; 29; 30 | 137; 138; 139; 140; 141; 142; 143 | 236; 237; 238; 239; 240; 333; 334; 335; 336; 337; 430; 431; 432; 433; 434; 527; 528; 529; 530; 531; 624; 625; 626; 627; 628; 721; 722; 723; 724; 725; 818; 819; 820; 821; 822; 915; 916; 917; 918; 919; 1012; 1013; 1014; 1015; 1016; 1109; 1110; 1111; 1112; 1113; 1206; 1207; 1208; 1209; 1210; 1303; 1304; 1305; 1306; 1307; |
| 11 | AMELX-001-2 | P45561-2 | 31 | 144 | 241; 338; 435; 532; 629; 726; 823; 920; 1017; 1114; 1211; 1308 |
| 12 | AMELX-001-3 | NP_998965.1 P45561-3 | 32 | 145 | 242; 339; 436; 533; 630; 727; 824; 921; 1018; 1115; 1212; 1309 |
| 13 | AMELX-002 | K7GPB2 | 33 | 146 | 243; 340; 437; 534; 631; 728; 825; 922; 1019; 1116; 1213; 1310 |
| 14 | AMELX-003 | K7GLD0 | 34 | 147 | 244; 341; 438; 535; 632; 729; 826; 923; 1020; 1117; 1214; 1311 |
| 15 | AMELX-004 | K7GPE9 | 35 | 148 | 245; 342; 439; 536; 633; 730; 827; 924; 1021; 1118; 1215; 1312 |
| 16 | AMELX-201 | J9JIM4 | 36 | 149 | 246; 343; 440; 537; 634; 731; 828; 925; 1022; 1119; 1216; 1313 |
| 17 | BMP1 | NP_006120.1 P13497 | 37 | 150 | 247; 344; 441; 538; 635; 732; 829; 926; 1023; 1120; 1217; 1314 |
| 18 | BMP2 | NP_001191.1 P12643 | 38 | 151 | 248; 345; 442; 539; 636; 733; 830; 927; 1024; 1121; 1218; 1315 |
| 19 | BMP4 | NP_001193.2 P12644 | 39 | 152 | 249; 346; 443; 540; 637; 734; 831; 928; 1025; 1122; 1219; 1316 |
| 20 | BMP6 | NP_001709.1 P22004 | 40 | 153 | 250; 347; 444; 541; 638; 735; 832; 929; 1026; 1123; 1220; 1317 |
| 21 | BMP7 | NP_001710.1 P18075 | 41 | 154 | 251; 348; 445; 542; 639; 736; 833; 930; 1027; 1124; 1221; 1318 |
| 22 | EGF | NP_001954.2 P01133 | 43 | 156 | 253; 350; 447; 544; 641; 738; 835; 932; 1029; 1126; 1223; 1320 |
| 23 | EREG | NP_001423.1 O14944 | 44 | 157 | 254; 351; 448; 545; 642; 739; 836; 933; 1030; 1127; 1224; 1321 |
| 24 | FGF1 | NP_000791.1 P05230 | 45 | 158 | 255; 352; 449; 546; 643; 740; 837; 934; 1031; 1128; 1225; 1322 |
| 25 | FGF2 | NP_001997.5 P09038 | 46 | 159 | 256; 353; 450; 547; 644; 741; 838; 935; 1032; 1129; 1226; 1323 |
| 26 | FGF7 | NP_002000.1 P21781 | 47 | 160 | 257; 354; 451; 548; 645; 742; 839; 936; 1033; 1130; 1227; 1324 |

TABLE 1-continued

List of therapeutic proteins

| # | Gene name | Protein Acc. No. | A | B | C |
|---|---|---|---|---|---|
| 27 | HBEGF | NP_001936.1 Q99075 | 48 | 161 | 258; 355; 452; 549; 646; 743; 840; 937; 1034; 1131; 1228; 1325 |
| 28 | HGF | NP_000592.3 P14210 | 49 | 162 | 259; 356; 453; 550; 647; 744; 841; 938; 1035; 1132; 1229; 1326 |
| 29 | IGF1 | NP_000609.1 P05019 | 72 | 185 | 282; 379; 476; 573; 670; 767; 864; 961; 1058; 1155; 1252; 1349 |
| 30 | IGF2 | NP_000603.1 P01344 | 73 | 186 | 283; 380; 477; 574; 671; 768; 865; 962; 1059; 1156; 1253; 1350 |
| 31 | INHBA | NP_002183.1 P08476 | 75 | 188 | 285; 382; 479; 576; 673; 770; 867; 964; 1061; 1158; 1255; 1352 |
| 32 | INHBB | NP_002184.2 P09529 | 76 | 189 | 286; 383; 480; 577; 674; 771; 868; 965; 1062; 1159; 1256; 1353 |
| 33 | PDGFA | NP_002598.4 P04085 | 82 | 195 | 292; 389; 486; 583; 680; 777; 874; 971; 1068; 1165; 1262; 1359 |
| 34 | PDGFB | NP_002599.1 P01127 | 83 | 196 | 293; 390; 487; 584; 681; 778; 875; 972; 1069; 1166; 1263; 1360 |
| 35 | PDGFC | NP_057289.1 Q9NRA1 | 84 | 197 | 294; 391; 488; 585; 682; 779; 876; 973; 1070; 1167; 1264; 1361 |
| 36 | PDGFD | NP_149126.1 Q9GZP0 | 85 | 198 | 295; 392; 489; 586; 683; 780; 877; 974; 1071; 1168; 1265; 1362 |
| 37 | TGFA | NP_003227.1 P01135 | 87 | 200 | 297; 394; 491; 588; 685; 782; 879; 976; 1073; 1170; 1267; 1364 |
| 38 | TGFB1 | NP_000651.3 P01137 | 88 | 201 | 298; 395; 492; 589; 686; 783; 880; 977; 1074; 1171; 1268; 1365 |
| 39 | TGFB2 | NP_003229.1 P61812 | 89 | 202 | 299; 396; 493; 590; 687; 784; 881; 978; 1075; 1172; 1269; 1366 |
| 40 | TGFB3 | NP_003230.1 P10600 | 90 | 203 | 300; 397; 494; 591; 688; 785; 882; 979; 1076; 1173; 1270; 1367 |
| 41 | PGF | NP_002623.2 P49763 | 92 | 205 | 302; 399; 496; 593; 690; 787; 884; 981; 1078; 1175; 1272; 1369 |
| 42 | VEGFA | NP_001020537.2 P15692 | 93 | 206 | 303; 400; 497; 594; 691; 788; 885; 982; 1079; 1176; 1273; 1370 |
| 43 | VEGFA | NP_001165094.1 | 94 | 207 | 304; 401; 498; 595; 692; 789; 886; 983; 1080; 1177; 1274; 1371 |
| 44 | VEGFB | NP_003368.1 P49765 | 95 | 208 | 305; 402; 499; 596; 693; 790; 887; 984; 1081; 1178; 1275; 1372 |
| 45 | VEGFC | NP_005420.1 P49767 | 96 | 209 | 306; 403; 500; 597; 694; 791; 888; 985; 1082; 1179; 1276; 1373 |
| 46 | VEGFD | NP_004460.1 O43915 | 97 | 210 | 307; 404; 501; 598; 695; 792; 889; 986; 1083; 1180; 1277; 1374 |
| Cytokines | | | | | |
| 47 | CCL7 | NP_006264.2 P80098 | 42 | 155 | 252; 349; 446; 543; 640; 737; 834; 931; 1028; 1125; 1222; 1319 |
| 48 | IL6 | NP_000591.1 P05231 | 74 | 187 | 284; 381; 478; 575; 672; 769; 866; 963; 1060; 1157; 1254; 1351 |
| Chaperones | | | | | |
| 49 | HSPA1A | NP_005336.3 P0DMV8 | 50 | 163 | 260; 357; 454; 551; 648; 745; 842; 939; 1036; 1133; 1230; 1327 |
| 50 | HSPA1B | NP_005337.2 P0DMV9 | 51 | 164 | 261; 358; 455; 552; 649; 746; 843; 940; 1037; 1134; 1231; 1328 |
| 51 | HSPA1L | NP_005518.3 P34931 | 52 | 165 | 262; 359; 456; 553; 650; 747; 844; 941; 1038; 1135; 1232; 1329 |
| 52 | HSPA2 | NP_068814.2 P54652 | 53 | 166 | 263; 360; 457; 554; 651; 748; 845; 942; 1039; 1136; 1233; 1330 |
| 53 | HSPA4 | NP_002145.3 P34932 | 54 | 167 | 264; 361; 458; 555; 652; 749; 846; 943; 1040; 1137; 1234; 1331 |
| 54 | HSPA4L | NP_055093.2 O95757 | 55 | 168 | 265; 362; 459; 556; 653; 750; 847; 944; 1041; 1138; 1235; 1332 |
| 55 | HSPA5 | NP_005338.1 P11021 | 56 | 169 | 266; 363; 460; 557; 654; 751; 848; 945; 1042; 1139; 1236; 1333 |
| 56 | HSPA6 | NP_002146.2 P17066 | 57 | 170 | 267; 364; 461; 558; 655; 752; 849; 946; 1043; 1140; 1237; 1334 |
| 57 | HSPA7 | P48741 | 58 | 171 | 268; 365; 462; 559; 656; 753; 850; 947; 1044; 1141; 1238; 1335 |
| 58 | HSPA8 | NP_006588.1 P11142 | 59 | 172 | 269; 366; 463; 560; 657; 754; 851; 948; 1045; 1142; 1239; 1336 |
| 59 | HSPA9 | NP_004125.3 P38646 | 60 | 173 | 270; 367; 464; 561; 658; 755; 852; 949; 1046; 1143; 1240; 1337 |
| 60 | HSPA12A | NP_079291.2 O43301 | 61 | 174 | 271; 368; 465; 562; 659; 756; 853; 950; 1047; 1144; 1241; 1338 |
| 61 | HSPA12B | NP_443202.3 Q96MM6 | 62 | 175 | 272; 369; 466; 563; 660; 757; 854; 951; 1048; 1145; 1242; 1339 |

TABLE 1-continued

List of therapeutic proteins

| # | Gene name | Protein Acc. No. | A | B | C |
|---|---|---|---|---|---|
| 62 | HSPA13 | NP_008879.3 P48723 | 63 | 176 | 273; 370; 467; 564; 661; 758; 855; 952; 1049; 1146; 1243; 1340 |
| 63 | HSPA14 | NP_057383.2 Q0VDF9 | 64 | 177 | 274; 371; 468; 565; 662; 759; 856; 953; 1050; 1147; 1244; 1341 |
| 64 | HSPH1 | NP_006635.2 Q92598 | 65 | 178 | 275; 372; 469; 566; 663; 760; 857; 954; 1051; 1148; 1245; 1342 |
| 65 | HYOU1 | NP_006380.1 Q9Y4L1 | 66 | 179 | 276; 373; 470; 567; 664; 761; 858; 955; 1052; 1149; 1246; 1343 |
| 66 | HSP90AA1 | NP_005339.3 P07900 | 67 | 180 | 277; 374; 471; 568; 665; 762; 859; 956; 1053; 1150; 1247; 1344 |
| 67 | HSP90AA3P |  | 68 | 181 | 278; 375; 472; 569; 666; 763; 860; 957; 1054; 1151; 1248; 1345 |
| 68 | HSP90AB1 | NP_031381.2 P08238 | 69 | 182 | 279; 376; 473; 570; 667; 764; 861; 958; 1055; 1152; 1249; 1346 |
| 69 | HSP90B1 | NP_003290.1 P14625 | 70 | 183 | 280; 377; 474; 571; 668; 765; 862; 959; 1056; 1153; 1250; 1347 |
| 70 | TRAP1 | NP_057376.2 Q12931 | 71 | 184 | 281; 378; 475; 572; 669; 766; 863; 960; 1057; 1154; 1251; 1348 |
| Receptor | | | | | |
| 71 | ITGAM | NP_000623.2 P11215 | 77 | 190 | 287; 384; 481; 578; 675; 772; 869; 966; 1063; 1160; 1257; 1354 |
| 72 | CCR1 | NP_001286.1 P32246 | 81 | 194 | 291; 388; 485; 582; 679; 776; 873; 970; 1067; 1164; 1261; 1358 |
| 73 | TNFRSF1B | NP_001057.1 P20333 | 91 | 204 | 301; 398; 495; 592; 689; 786; 883; 980; 1077; 1174; 1271; 1368 |
| Signal transduction inhibitor | | | | | |
| 74 | SOCS3 | NP_003946.3 O14543 | 86 | 199 | 296; 393; 490; 587; 684; 781; 878; 975; 1072; 1169; 1266; 1363 |

Legend to Table 1:
Column "A": amino acid sequence SEQ ID NO:;
column "B": (wild type) RNA sequence SEQ ID NO: (RNA) encoding the amino acid sequence(s) in column A;
column "C": RNA sequence SEQ ID NO: (modified RNA) encoding the amino acid sequence(s) in column A.

It is thus further preferred that the at least one coding sequence of the RNA for the use of the present invention encodes a therapeutic protein (in particular a collagenase, growth factor, cytokine, receptor, chaperone or signal transduction inhibitor as defined herein) or a fragment or variant of said therapeutic protein, wherein the therapeutic protein is a peptide or protein listed in Table 1, preferably a peptide or protein selected from the peptides and proteins defined by the database accession number provided under the respective column in Table 1. More preferably, the at least one coding sequence of the RNA according to the invention comprises or consists any one of the nucleic acid sequences provided in Table 1, or a fragment or variant of any one of these sequences, preferably as defined herein.

In a further preferred embodiment, the at least one coding sequence of the RNA of the present invention encodes a MMP1 collagenase or a fragment or variant thereof, and more preferably comprising or consisting of an amino acid sequence selected from the group consisting of SEQ ID NO: 7 or 8 or a fragment or variant of any one of said amino acid sequences. Accordingly, the at least one coding sequence of the RNA of the present invention may preferably comprise or consist of an RNA sequence according to SEQ ID NO: 106; 107; 108; 217; 218; 314; 315; 411; 412; 508; 509; 605; 606; 702; 703; 799; 800; 896; 897; 993; 994; 1090; 1091; 1187; 1188; 1284 or 1285 or a fragment of variant of any of said nucleic acid sequences.

In a further preferred embodiment, the at least one coding sequence of the RNA of the present invention encodes a ColG collagenase or a fragment or variant thereof, and more preferably comprising or consisting of an amino acid sequence selected from the group consisting of SEQ ID NO: 9 or a fragment or variant of any one of said amino acid sequences, in particular fragments or variants comprising or consisting of an amino acid sequence according to SEQ ID NO: 10, 11, 5192 or 5193. Accordingly, the at least one coding sequence of the RNA of the present invention may preferably comprise or consist of an RNA sequence according to SEQ ID NO: 109 or 110 a fragment or variant of said RNA sequence comprising or consisting of a RNA sequence according to SEQ ID NO: 111; 112; 113; 114; 219; 220; 221; 316; 317; 318; 413; 414; 415; 510; 511; 512; 607; 608; 609; 704; 705; 706; 801; 802; 803; 898; 899; 900; 995; 996; 997; 1092; 1093; 1094; 1189; 1190; 1191; 1286; 1287; 1288; 5196; 5197; 5198; 5199; 5204; 5205; 5208; 5209; 5212; 5213; 5216; 5217; 5220; 5221; 5224; 5225; 5228; 5229; 5232; 5233; 5236; 5237; 5240; 5241; 5244; 5245; 5248 or 5249.

In a further preferred embodiment, the at least one coding sequence of the RNA of the present invention encodes a ColH collagenase or a fragment or variant thereof, and more preferably comprising or consisting of an amino acid sequence selected from the group consisting of SEQ ID NO: 12 or 13 or a fragment or variant of any one of said amino acid sequences, in particular fragments or variants comprising or consisting of an amino acid sequence according to SEQ ID NO: 14, 15, 5194 or 5195. Accordingly, the at least one coding sequence of the RNA of the present invention may preferably comprise or consist of an RNA sequence according to SEQ ID NO: 115, 116, 117 or 118 or a fragment or variant of said RNA sequence comprising or consisting of a RNA sequence according to SEQ ID NO: 119; 120; 121;

122; 222; 223; 224; 225; 319; 320; 321; 322; 416; 417; 418; 419; 513; 514; 515; 516; 610; 611; 612; 613; 707; 708; 709; 710; 804; 805; 806; 807; 901; 902; 903; 904; 998; 999; 1000; 1001; 1095; 1096; 1097; 1098; 1192; 1193; 1194; 1195; 1289; 1290; 1291; 1292; 5200; 5201; 5202; 5203; 5206; 5207; 5210; 5211; 5214; 5215; 5218; 5219; 5222; 5223; 5226; 5227; 5230; 5231; 5234; 5235; 5238; 5239; 5242; 5243; 5246; 5247; 5250 or 5251.

In a further preferred embodiment, the at least one coding sequence of the RNA of the present invention encodes a MMP8 collagenase, preferably a human MMP8 collagenase, or a fragment or variant thereof, and more preferably comprising or consisting of an amino acid sequence selected from the group consisting of SEQ ID NO: 78 or a fragment or variant of any one of said amino acid sequences. Accordingly, the at least one coding sequence of the RNA of the present invention may preferably comprise or consist of an RNA sequence according to SEQ ID NO: 191 or a fragment of variant of said nucleic acid sequences, preferably an RNA sequence selected from the group of SEQ ID NO: 288; 385; 482; 579; 676; 773; 870; 967; 1064; 1161; 1258 or 1355.

In a further preferred embodiment, the at least one coding sequence of the RNA of the present invention encodes a MMP9 collagenase, preferably a human MMP9 collagenase, or a fragment or variant thereof, and more preferably comprising or consisting of an amino acid sequence selected from the group consisting of SEQ ID NO: 79 or a fragment or variant of any one of said amino acid sequences. Accordingly, the at least one coding sequence of the RNA of the present invention may preferably comprise or consist of an RNA sequence according to SEQ ID NO: 192 or a fragment of variant of said nucleic acid sequences, preferably an RNA sequence selected from the group of SEQ ID NO: 289; 386; 483; 580; 677; 774; 871; 968; 1065; 1162; 1259; 1356.

In a further preferred embodiment, the at least one coding sequence of the RNA of the present invention encodes a MMP13 collagenase, preferably a human MMP13 collagenase, or a fragment or variant thereof, and more preferably comprising or consisting of an amino acid sequence selected from the group consisting of SEQ ID NO: 80 or a fragment or variant of any one of said amino acid sequences. Accordingly, the at least one coding sequence of the RNA of the present invention may preferably comprise or consist of an RNA sequence according to SEQ ID NO: 193 or a fragment of variant of said nucleic acid sequences, preferably an RNA sequence selected from the group of SEQ ID NO: 290; 387; 484; 581; 678; 775; 872; 969; 1066; 1163; 1260 or 1357.

In some embodiments, the at least one coding sequence of the RNA of the present invention does not encode a growth factor, in particular a Platelet Derived Growth Factor (PDGF), in particular PDGFA, PDGFB, PDGFC or PDGFD, an Epidermal Growth Factor (EGF), a Vascular Endothelial Growth Factor (VEGF), in particular VEGFA, VEGFB, VEGFC or VEGFD, a Keratinocyte Growth Factor (KGF), in particular KGF-1, a Fibroblast Growth Factor (FGF), in particular FGF1, FGF2, FGF9, FGF7, FGF15, FGF19, FGF21 or FGF23, a Transforming Growth Factor (TGF), in particular TGFA, TGFB1, TGFB2 or TGFB3, a bone morphogeic protein (BMP), in particular BMP1, BMP2 or BMP6, a hepatocyte growth factor (HGF), PlGF, AMELY or AMELX or any combination thereof.

In some embodiments, the at least one coding sequence of the RNA of the present invention does not encode a collagenase, in particular a matrix metalloproteinase, more specifically MMP-1, MMP-8, MMP-9 or MMP-13.

Polypeptide Sequences

According to preferred embodiments, the present invention concerns an RNA comprising at least one coding sequence encoding a therapeutic protein (in particular a collagenase, growth factor, cytokine, receptor, chaperone or signal transduction inhibitor as defined herein), or a fragment or variant of a therapeutic protein (in particular a collagenase, growth factor, cytokine, receptor, chaperone or signal transduction inhibitor as defined herein), wherein the therapeutic protein preferably comprises or consists of any one of the amino acid sequences defined in the third column (column "A") of Table 1, or a fragment or variant of any one of these sequences.

In other words, the at least one coding sequence preferably encodes a therapeutic protein (in particular a collagenase, growth factor, cytokine, receptor, chaperone or signal transduction inhibitor as defined herein) comprising or consisting of an amino acid sequence selected from the group consisting of SEQ ID NO: 6, 7; 8; 9; 10; 11; 12; 13; 14; 15; 16; 17; 18; 19; 20; 21; 22; 23; 24; 25; 26; 27; 28; 29; 30; 31; 32; 33; 34; 35; 36; 37; 38; 39; 40; 41; 42; 43; 44; 45; 46; 47; 48; 49; 50; 51; 52; 53; 54; 55; 56; 57; 58; 59; 60; 61; 62; 63; 64; 65; 66; 67; 68; 69; 70; 71; 72; 73; 74; 75; 76; 77; 78; 79; 80; 81; 82; 83; 84; 85; 86; 87; 88; 89; 90; 91; 92; 93; 94; 95; 96; 97; 5192; 5193; 5194 or 5195 or a fragment or variant of any one of said amino acid sequences.

The at least one coding sequence of the RNA according to the invention preferably comprises a nucleic acid sequence encoding a full-length therapeutic protein (in particular a collagenase, growth factor, cytokine, receptor, chaperone or signal transduction inhibitor as defined herein) or a full-length variant of a therapeutic protein (in particular a collagenase, growth factor, cytokine, receptor, chaperone or signal transduction inhibitor) as defined herein. The term "full-length therapeutic protein" as used herein typically refers to a therapeutic protein that substantially comprises the entire amino acid sequence of the naturally occuring therapeutic protein. As used herein, the term "full-length therapeutic protein" preferably relates to the full-length sequence of a therapeutic protein indicated in Table 1. More preferably, the term "full-length therapeutic protein" preferably refers to an amino acid sequence as defined by any one of the SEQ ID NO: 's listed under the third column ("A") of Table 1 or to an amino acid provided in the database under the respective database accession number.

Alternatively, the at least one coding sequence of the RNA according to the invention may also comprise a nucleic acid sequence encoding a fragment of a therapeutic protein (in particular a collagenase, growth factor, cytokine, receptor, chaperone or signal transduction inhibitor as defined herein) or a fragment of a variant of a therapeutic protein as defined herein.

Fragments

In the context of the present invention, a "fragment" of a therapeutic protein (in particular a collagenase, growth factor, cytokine, receptor, chaperone or signal transduction inhibitor as defined herein) or of a variant thereof may comprise a sequence of a therapeutic protein (in particular a collagenase, growth factor, cytokine, receptor, chaperone or signal transduction inhibitor as defined herein) or of a variant thereof as defined above, which is, with regard to its amino acid sequence (or its encoded nucleic acid sequence), N-terminally, C-terminally and/or intrasequentially truncated compared to the amino acid sequence of the naturally occuring protein or a variant thereof (or its encoded nucleic acid sequence). Such truncation may thus occur either on the amino acid level or on the nucleic acid level, respectively. A sequence identity with respect to such a fragment as defined herein therefore preferably refers to the entire therapeutic protein (in particular a collagenase, growth factor, cytokine, receptor, chaperone or signal transduction inhibitor as defined herein) or a variant thereof as defined herein or to the entire (coding) nucleic acid sequence of such a therapeutic protein or of a variant thereof.

Variants

According to a preferred embodiment of the invention, the RNA, in particular the RNA sequence, comprises at least one coding sequence encoding a variant of a therapeutic protein (in particular a collagenase, growth factor, cytokine, receptor, chaperone or signal transduction inhibitor) as defined herein, or a fragment of a variant of a therapeutic protein (in particular a collagenase, growth factor, cytokine, receptor, chaperone or signal transduction inhibitor as defined herein).

Preferably, a "variant" of a therapeutic protein (in particular a collagenase, growth factor, cytokine, receptor, chaperone or signal transduction inhibitor as defined herein) or a fragment thereof as defined herein may be encoded by the RNA comprising at least one coding sequence as defined herein, wherein the amino acid sequence encoded by the at least one coding sequence differs in at least one amino acid residue from the naturally occuring amino acid sequence. In this context, the "change" in at least one amino acid residue may consist, for example, in a mutation of an amino acid residue to another amino acid, a deletion or an insertion. More preferably, the term "variant" as used in the context of the amino acid sequence encoded by the at least one coding sequence of the RNA according to the invention comprises any homolog, isoform or transcript variant of a collagenase, growth factor, cytokine, chaperone or a signal transduction inhibitor or a fragment thereof as defined herein, wherein the homolog, isoform or transcript variant is preferably characterized by a degree of identity or homology, respectively, as defined herein.

Preferably, a variant of a therapeutic protein (in particular a collagenase, growth factor, cytokine, receptor, chaperone or signal transduction inhibitor as defined herein) or a fragment thereof may be encoded by the RNA comprising at least one coding sequence as defined herein, wherein at least one amino acid residue of the amino acid sequence encoded by the at least one coding sequence is substituted. Substitutions, wherein amino acids, which originate from the same class, are exchanged for one another, are called conservative substitutions. In particular, these are amino acids having aliphatic side chains, positively or negatively charged side chains, aromatic groups in the side chains or amino acids, the side chains of which can form hydrogen bridges, e.g. side chains which have a hydroxyl function. By conservative constitution, e.g. an amino acid having a polar side chain may be replaced by another amino acid having a corresponding polar side chain, or, for example, an amino acid characterized by a hydrophobic side chain may be substituted by another amino acid having a corresponding hydrophobic side chain (e.g. serine (threonine) by threonine (serine) or leucine (isoleucine) by isoleucine (leucine)). In a preferred embodiment, a variant of a collagenase, growth factor, cytokine, chaperone or a signal transduction inhibitor or a fragment thereof may be encoded by the RNA according to the invention, wherein at least one amino acid residue of the amino acid sequence encoded by the at least one coding sequence comprises at least one conservative substitution compared to the respective naturally occuring sequence. These amino acid sequences as well as their encoding nucleic acid sequences in particular are comprised by the term "variant" as defined herein.

In the context of the present invention, a "fragment" or a "variant" of a protein or peptide may have at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% amino acid identity over a stretch of at least 10, at least 20, at least 30, at least 50, at least 75 or at least 100 amino acids of such protein or peptide. More preferably, a "fragment" or a "variant" of a protein or peptide as used herein is at least 40%, preferably at least 50%, more preferably at least 60%, more preferably at least 70%, even more preferably at least 80%, even more preferably at least 90%, most preferably at least 95% identical to the protein or peptide, from which the variant is derived.

Insertions, deletions and/or non-conservative substitutions are also possible, in particular, at those sequence positions, which cause no modification to the three-dimensional structure or do not affect the binding region. Modifications to a three-dimensional structure by insertion(s) or deletion(s) can easily be determined e.g. using CD spectra (circular dichroism spectra) (Urry, 1985, Absorption, Circular Dichroism and ORD of Polypeptides, in: Modern Physical Methods in Biochemistry, Neuberger et al. (ed.), Elsevier, Amsterdam).

In order to determine the percentage, to which two sequences (nucleic acid sequences, e.g. RNA or mRNA sequences as defined herein, or amino acid sequences, preferably the amino acid sequence encoded by the RNA according to the invention) are identical, the sequences can be aligned in order to be subsequently compared to one another. For this purpose, e.g. gaps can be inserted into the sequence of the first sequence and the component at the corresponding position of the second sequence can be compared. If a position in the first sequence is occupied by the same component as is the case at a corresponding position in the second sequence, the two sequences are identical at this position. The percentage, to which two sequences are identical, is a function of the number of identical positions divided by the total number of positions. The percentage, to which two sequences are identical, can be determined using a mathematical algorithm. A preferred, but not limiting, example of a mathematical algorithm, which can be used is the algorithm of Karlin et al. (1993), PNAS USA, 90:5873-5877 or Altschul et al. (1997), Nucleic Acids Res., 25:3389-3402. Such an algorithm is integrated, for example, in the BLAST program. Sequences, which are identical to the sequences of the present invention to a certain extent, can be identified by this program.

A fragment of a therapeutic protein (in particular a collagenase, growth factor, cytokine, receptor, chaperone or signal transduction inhibitor as defined herein) or a variant thereof encoded by the at least one coding sequence of the RNA according to the invention may typically comprise an amino acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, (a) with an amino acid sequence of the respective naturally occuring full-length therapeutic protein (in particular a collagenase, growth factor, cytokine, receptor, chaperone or signal transduction inhibitor as defined herein) or a variant thereof, or (b) more preferably with an amino acid sequence of a therapeutic protein (in particular a collagenase, growth factor, cytokine, receptor, chaperone or signal transduction inhibitor as defined herein) selected from the therapeutic proteins (in particular a collagenase, growth factor, cytokine, chaperone or a signal transduction inhibitor) indicated in Table 1 or a variant thereof, or (c) even more preferably with any one of the amino acid sequences defined in the third column (column "A") of Table 1, or a fragment or variant of any one of these sequences.

Most preferably, a fragment of a therapeutic protein (in particular a collagenase, growth factor, cytokine, receptor, chaperone or signal transduction inhibitor as defined herein) or a variant thereof encoded by the at least one coding sequence of the RNA according to the invention typically comprises or consists of an amino acid sequence having a sequence identity of at least 80% with any one of the amino acid sequences defined in the third column (column "A") of Table 1, or a fragment or variant of any one of these sequences.

Polynucleotide Sequences

Preferably, therapeutic proteins (in particular collagenases, growth factors, cytokines, chaperones or signal transduction inhibitors as defined herein) encoded by the at least one coding sequence of the RNA are therapeutic proteins (in particular collagenases, growth factors, cytokines, chaperones or signal transduction inhibitors) as defined herein, which is encoded by a nucleic acid sequence comprising or consisting of any one of the nucleic acid sequences defined in Table 1, preferably in the fourth or fifth column (column "B" or "C", respectively) of Table 1, or a fragment or variant of any one of these sequences. In other words the therapeutic protein (in particular collagenases, growth factors, cytokines, receptors, chaperones or signal transduction inhibitors as defined herein) encoded by the at least one coding sequence of the RNA is preferably a therapeutic protein (in particular a collagenase, growth factor, cytokine, receptor, chaperone or signal transduction inhibitor) as defined herein, which is preferably encoded by a nucleic acid sequence comprising or consisting of a nucleic acid sequence selected from the group consisting of SEQ ID NO: 104; 105; 106; 107; 108; 109; 110; 111; 112; 113; 114; 115; 116; 117; 118; 119; 120; 121; 122; 123; 124; 125; 126; 127; 128; 129; 130; 131; 132; 133; 134; 135; 136; 137; 138; 139; 140; 141; 142; 143; 144; 145; 146; 147; 148; 149; 150; 151; 152; 153; 154; 155; 156; 157; 158; 159; 160; 161; 162; 163; 164; 165; 166; 167; 168; 169; 170; 171; 172; 173; 174; 175; 176; 177; 178; 179; 180; 181; 182; 183; 184; 185; 186; 187; 188; 189; 190; 191; 192; 193; 194; 195; 196; 197; 198; 199; 200; 201; 202; 203; 204; 205; 206; 207; 208; 209; 210; 5196; 5197; 5198; 5199; 5200; 5201; 5202 or 5203 or a fragment or variant of any of these sequence.

Preferably, the present invention thus provides an RNA comprising at least one coding sequence, wherein the coding sequence comprises or consists any one of the nucleic acid sequences defined in Table 1, preferably in the fourth or fifth column (column "B" or "C", respectively) of Table 1, or a fragment or variant of any one of these sequences.

Fragments

In certain embodiments, the RNA according to the invention, preferably the at least one coding sequence of the RNA according to the invention, may comprise or consist of a fragment of a nucleic acid sequence encoding a therapeutic protein (in particular a collagenase, growth factor, cytokine, receptor, chaperone or signal transduction inhibitor as defined herein) or a variant thereof as defined herein. Preferably, the at least one coding sequence of the RNA according to the invention comprises or consists of a fragment, preferably as defined herein, of any one of the nucleic acid sequences defined in Table 1, preferably in the fourth or fifth column (column "B" or "C", respectively) of Table 1, or a fragment or variant of any one of these sequences.

In this context, a "fragment of a nucleic acid sequence" is preferably a nucleic acid sequence encoding a fragment of a collagenase or of a variant thereof as described herein. More preferably, the expression "fragment of a nucleic acid sequence" refers to a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with a respective full-length nucleic acid sequence.

Variants

In another preferred embodiment, the RNA according to the invention, preferably the at least one coding sequence of the RNA according to the invention, may comprise or consist of a variant of a nucleic acid sequence as defined herein, preferably of a nucleic acid sequence encoding a therapeutic protein (in particular a collagenase, growth factor, cytokine, receptor, chaperone or signal transduction inhibitor as defined herein) or a fragment thereof as defined herein.

The expression "variant of a nucleic acid sequence" as used herein in the context of a nucleic acid sequence encoding a therapeutic protein (in particular a collagenase, growth factor, cytokine, receptor, chaperone or signal transduction inhibitor as defined herein) or a fragment thereof, typically refers to a nucleic acid sequence, which differs by at least one nucleic acid residue from the respective naturally occuring nucleic acid sequence encoding a collagenase or a fragment thereof. More preferably, the expression "variant of a nucleic acid sequence" refers to a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with a nucleic acid sequence, from which it is derived.

Preferably, the RNA according to the invention, more preferably the at least one coding sequence of the RNA according to the invention, encodes a variant of a therapeutic protein (in particular a collagenase, growth factor, cytokine, receptor, chaperone or signal transduction inhibitor as defined herein) or a fragment thereof, preferably as defined herein.

Preferably, the RNA according to the invention, more preferably the at least one coding sequence of the RNA according to the invention, comprises or consists of a variant of a nucleic acid sequence encoding a therapeutic protein (in particular a collagenase, growth factor, cytokine, receptor, chaperone or signal transduction inhibitor as defined herein) or a fragment thereof as defined herein.

In a preferred embodiment, the RNA according to the invention, more preferably the at least one coding sequence of the RNA according to the invention, comprises or consists of a variant of a nucleic acid sequence encoding a therapeutic protein (in particular a collagenase, growth factor, cytokine, receptor, chaperone or signal transduction inhibitor as defined herein) or a fragment thereof as defined herein, wherein the variant of the nucleic acid sequence encodes an amino acid sequence comprising at least one conservative substitution of an amino acid residue.

In another embodiment, the RNA according to the invention, more preferably the at least one coding sequence of the RNA according to the invention, comprises or consists of a variant of a nucleic acid sequence encoding a therapeutic protein (in particular a collagenase, growth factor, cytokine, receptor, chaperone or signal transduction inhibitor as defined herein) or a fragment thereof as defined herein, wherein the nucleic acid sequence of the variant differs from the respective naturally occuring nucleic acid sequence in at least one nucleic acid residue, preferably without resulting—due to the degenerated genetic code—in an alteration of the encoded amino acid sequence, i.e. the amino acid sequence encoded by the variant or at least part thereof may preferably not differ from the naturally occuring amino acid sequence in one or more mutation(s) within the above meaning.

Furthermore, a "variant" of a nucleic acid sequence encoding a therapeutic protein (in particular a collagenase, growth factor, cytokine, receptor, chaperone or signal transduction inhibitor as defined herein) or a fragment or variant thereof as defined herein, may also comprise DNA sequences, which correspond to RNA sequences as defined herein and may also comprise further RNA sequences, which correspond to DNA sequences as defined herein. Those skilled in the art are familiar with the translation of an RNA sequence into a DNA sequence (or vice versa) or with the creation of the complementary strand sequence (i.e. by substitution of U residues with T residues and/or by constructing the complementary strand with respect to a given sequence).

According to preferred embodiments, the at least one coding sequence of the RNA according to the invention comprises or consists of a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, (a) with a nucleic acid sequence encoding a naturally occuring full-length therapeutic protein (in particular a collagenase, growth factor, cytokine, receptor, chaperone or signal transduction inhibitor as defined herein) as defined herein, or a variant thereof or (b) with any one of the nucleic acid sequences defined in Table 1, preferably in the fourth or fifth column (column "B" or "C", respectively) of Table 1, or a fragment or variant thereof.

According to a particularly preferred embodiment, the at least one coding sequence of the RNA according to the invention comprises or consists of a nucleic acid sequence having a sequence identity of at least 80% with any one of the nucleic acid sequences defined in Table 1, preferably in the fourth or fifth column (column "B" or "C", respectively) of Table 1, or a fragment or variant of any one of these sequences.

In a further preferred embodiment, the at least one coding sequence of the RNA according to the invention comprises or consists of a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the nucleic acid sequences defined in the fourth (column "B") of Table 1, or a fragment or variant of any one of these sequences. In other words, the at least one coding sequence of the RNA according to the invention preferably comprises or consists of a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with a nucleic acid sequence selected from the group consisting of SEQ ID NO: 104; 105; 106; 107; 108; 109; 110; 111; 112; 113; 114; 115; 116; 117; 118; 119; 120; 121; 122; 123; 124; 125; 126; 127; 128; 129; 130; 131; 132; 133; 134; 135; 136; 137; 138; 139; 140; 141; 142; 143; 144; 145; 146; 147; 148; 149; 150; 151; 152; 153; 154; 155; 156; 157; 158; 159; 160; 161; 162; 163; 164; 165; 166; 167; 168; 169; 170; 171; 172; 173; 174; 175; 176; 177; 178; 179; 180; 181; 182; 183; 184; 185; 186; 187; 188; 189; 190; 191; 192; 193; 194; 195; 196; 197; 198; 199; 200; 201; 202; 203; 204; 205; 206; 207; 208; 209; 210; 5196; 5197; 5198; 5199; 5200; 5201; 5202 or 5203, or a fragment or variant of any one of said nucleic acid sequences. According to a particularly preferred embodiment, the at least one coding sequence of the RNA according to the invention comprises or consists of a nucleic acid sequence having a sequence identity of at least 80% with any one of the nucleic acid sequences defined in the fourth (column "B") of Table 1, or a fragment or variant of any one of these sequences.

Mono-, Bi- or Multicistronic RNAs

According to certain embodiments of the present invention, the RNA is mono-, bi-, or multicistronic, preferably as defined herein. The coding sequences in a bi- or multicistronic RNA preferably encode distinct therapeutic proteins (in particular collagenases, growth factors, cytokines, receptors, chaperones or signal transduction inhibitors as defined herein) as defined herein or fragments or variants thereof. Preferably, the coding sequences encoding two or more therapeutic proteins (in particular collagenases and/or growth factors) may be separated in the bi- or multicistronic RNA by at least one IRES (internal ribosomal entry site) sequence, as defined below. Thus, the term "encoding two or more therapeutic proteins (in particular collagenases, growth factors, cytokines, chaperones or signal transduction inhibitors)" may mean, without being limited thereto, that the bi- or even multicistronic RNA, may encode e.g. at least two, three, four, five, six or more (preferably different) therapeutic proteins (in particular collagenases, growth factors, cytokines, chaperones or signal transduction inhibitors) of the therapeutic proteins or their fragments or variants within the definitions provided herein. More preferably, without being limited thereto, the bi- or even multicistronic mRNA, may encode, for example, at least two, three, four, five, six or more (preferably different) therapeutic proteins (in particular collagenases, growth factors, cytokines, chaperones or signal transduction inhibitors) as defined herein or their fragments or variants as defined herein. In this context, a so-called IRES (internal ribosomal entry site) sequence as defined above can function as a sole ribosome binding site, but it can also serve to provide a bi- or even multicistronic mRNA as defined above, which encodes several therapeutic proteins (in particular collagenases, growth factors, cytokines, chaperones or signal transduction inhibitors), which are to be translated by the ribosomes independently of one another. Examples of IRES sequences, which can be used according to the invention, are those from picornaviruses (e.g. FMDV), pestiviruses (CFFV), polioviruses (PV), encephalomyocarditis viruses (ECMV), foot and mouth disease viruses (FMDV), hepatitis C viruses (HCV), classical swine fever viruses (CSFV), mouse leukoma virus (MLV), simian immunodeficiency viruses (SN) or cricket paralysis viruses (CrPV). One particular example is the EMCV IRES sequence cmmprising or consisting of a nucleic acid sequence according to SEQ ID NO: 98.

Preferably, the at least one coding sequence of the RNA according to the invention comprises at least two, three, four, five, six, seven, eight or more nucleic acid sequences identical to or having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the nucleic acid sequences disclosed in Table 1 herein, or a fragment or variant of any one of said nucleic acid sequences.

Preferably, the RNA comprising at least one coding sequence as defined herein typically comprises a length of about 50 to about 20000, or 100 to about 20000 nucleotides, preferably of about 250 to about 20000 nucleotides, more preferably of about 500 to about 10000, even more preferably of about 500 to about 5000.

The RNA according to the invention may further be single stranded or double stranded. When provided as a double stranded RNA, the RNA according to the invention preferably comprises a sense and a corresponding antisense strand.

Preferably, the RNA comprising at least one coding sequence as defined herein may be an mRNA, a viral RNA or a replicon RNA.

Modifications

According to a further embodiment, the RNA, preferably an mRNA, according to the invention is a modified RNA, preferably a modified RNA as described herein. In this context, a modification as defined herein preferably leads to a stabilization of the RNA according to the invention. More preferably, the invention thus provides a stabilized RNA comprising at least one coding sequence as defined herein.

According to one embodiment, the RNA of the present invention may thus be provided as a "stabilized mRNA", that is to say as an RNA that is essentially resistant to in vivo degradation (e.g. by an exo- or endo-nuclease). Such stabilization can be effected, for example, by a modified phosphate backbone of the RNA of the present invention. A backbone modification in connection with the present invention is a modification in which phosphates of the backbone of the nucleotides contained in the RNA are chemically modified. Nucleotides that may be preferably used in this connection contain e.g. a phosphorothioate-modified phosphate backbone, preferably at least one of the phosphate oxygens contained in the phosphate backbone being replaced by a sulfur atom. Stabilized RNAs may further include, for example: non-ionic phosphate analogues, such as, for example, alkyl and aryl phosphonates, in which the charged phosphonate oxygen is replaced by an alkyl or aryl group, or phosphodiesters and alkylphosphotriesters, in which the charged oxygen residue is present in alkylated form. Such backbone modifications typically include, without implying any limitation, modifications from the group consisting of methylphosphonates, phosphoramidates and phosphorothioates (e.g. cytidine-5-O-(1-thiophosphate)).

In the following, specific modifications are described, which are preferably capable of "stabilizing" the RNA as defined herein.

Chemical Modifications

The term "RNA modification" as used herein may refer to chemical modifications comprising backbone modifications as well as sugar modifications or base modifications.

In this context, a modified RNA as defined herein may contain nucleotide analogues/modifications, e.g. backbone modifications, sugar modifications or base modifications. A backbone modification in connection with the present invention is a modification, in which phosphates of the backbone of the nucleotides contained in an RNA as defined herein are chemically modified. A sugar modification in connection with the present invention is a chemical modification of the sugar of the nucleotides of the RNA as defined herein. Furthermore, a base modification in connection with the present invention is a chemical modification of the base moiety of the nucleotides of the RNA. In this context, nucleotide analogues or modifications are preferably selected from nucleotide analogues, which are applicable for transcription and/or translation.

Sugar Modifications:

The modified nucleosides and nucleotides, which may be incorporated into a modified RNA as described herein, can be modified in the sugar moiety. For example, the 2' hydroxyl group (OH) can be modified or replaced with a number of different "oxy" or "deoxy" substituents. Examples of "oxy"-2' hydroxyl group modifications include, but are not limited to, alkoxy or aryloxy (—OR, e.g., R=H, alkyl, cycloalkyl, aryl, aralkyl, heteroaryl or sugar); polyethyleneglycols (PEG), —O(CH$_2$CH$_2$O)nCH$_2$CH$_2$OR; "locked" nucleic acids (LNA) in which the 2' hydroxyl is connected, e.g., by a methylene bridge, to the 4' carbon of the same ribose sugar; and amino groups (—O-amino, wherein the amino group, e.g., NRR, can be alkylamino, dialkylamino, heterocyclyl, arylamino, diarylamino, heteroarylamino, or diheteroaryl amino, ethylene diamine, polyamino) or aminoalkoxy.

"Deoxy" modifications include hydrogen, amino (e.g. NH$_2$; alkylamino, dialkylamino, heterocyclyl, arylamino, diaryl amino, heteroaryl amino, diheteroaryl amino, or amino acid); or the amino group can be attached to the sugar through a linker, wherein the linker comprises one or more of the atoms C, N, and O.

The sugar group can also contain one or more carbons that possess the opposite stereochemical configuration than that of the corresponding carbon in ribose. Thus, a modified RNA can include nucleotides containing, for instance, arabinose as the sugar.

Backbone Modifications:

The phosphate backbone may further be modified in the modified nucleosides and nucleotides, which may be incorporated into a modified RNA as described herein. The phosphate groups of the backbone can be modified by replacing one or more of the oxygen atoms with a different substituent. Further, the modified nucleosides and nucleotides can include the full replacement of an unmodified phosphate moiety with a modified phosphate as described herein. Examples of modified phosphate groups include, but are not limited to, phosphorothioate, phosphoroselenates, borano phosphates, borano phosphate esters, hydrogen phosphonates, phosphoroamidates, alkyl or aryl phosphonates and phosphotriesters. Phosphorodithioates have both non-linking oxygens replaced by sulfur. The phosphate linker can also be modified by the replacement of a linking oxygen with nitrogen (bridged phosphoroamidates), sulfur (bridged phosphorothioates) and carbon (bridged methylene-phosphonates).

Base Modifications

The modified nucleosides and nucleotides, which may be incorporated into a modified RNA as described herein can further be modified in the nucleobase moiety. Examples of nucleobases found in RNA include, but are not limited to, adenine, guanine, cytosine and uracil. For example, the nucleosides and nucleotides described herein can be chemically modified on the major groove face. In some embodiments, the major groove chemical modifications can include an amino group, a thiol group, an alkyl group, or a halo group.

In some embodiments of the present invention, the nucleotide analogues/modifications are selected from base modifications, which are preferably selected from 2-amino-6-chloropurineriboside-5'-triphosphate, 2-Aminopurine-riboside-5'-triphosphate; 2-aminoadenosine-5'-triphosphate, 2'-Amino-2 37-deoxycytidine-triphosphate, 2-thiocytidne-5'-triphosphate, 2-thiouridine-5'-triphosphate, 2'-Fluorothymidine-5'-triphosphate, 2'-O-Methyl-inosine-5'-triphosphate 4-thiouridine-5'-triphosphate, 5-aminoallylcytidine-5'-triphosphate, 5-aminoallyluridine-5'-triphosphate, 5-bromocytidine-5'-triphosphate, 5-bromouridine-5'-triphosphate, 5-Bromo-2'-deoxycytidine-5'-triphosphate, 5-Bromo-2'-deoxyuridine-5'-triphosphate, 5-iodocytidne-5-triphosphate, 5-Iodo-2-deoxycytidine-5-triphosphate, 5-iodouridine-5-triphosphate, 5-Iodo-2-deoxyuridine-5-triphosphate, 5-methylcytidine-5'-triphosphate, 5-methyluridine-5'-triphosphate, 5-Propynyl-2'-deoxycytidine-5'-triphosphate, 5-Propynyl-2-deoxyuridine-5-triphosphate, 6-azacytidine-5'-triphosphate, 6-azauridine-5'-triphosphate, 6-chloropurineriboside-5'-triphosphate, 7-deazaadenosine-5'-triphosphate, 7-deazaguanosine-5'-triphosphate, 8-azaadenosine-5'-triphosphate, 8-azidoadenosine-5'-triphosphate, benzimidazole-riboside-5'-triphosphate, N1-methyladenosine-5'-triphosphate, N1-methylguanosine-5'-triphosphate, N6-methyladenosine-5'-triphosphate, O6-methylguanosine-5'-triphosphate, pseudouridine-5'-triphosphate, or puromycin-5'-triphosphate, xanthosine-5'-triphosphate. Particular preference is given to nucleotides for base modifications selected from the group of base-modified nucleotides consisting of 5-methylcytidine-5'-triphosphate, 7-deazaguanosine-5'-triphosphate, 5-bromocytidine-5'-triphosphate, and pseudouridine-5'-triphosphate.

In some embodiments, modified nucleosides include pyridin-4-one ribonucleoside, 5-aza-uridine, 2-thio-5-aza-uridine, 2-thiouridine, 4-thio-pseudouridine, 2-thio-pseudouridine, 5-hydroxyuridine, 3-methyluridine, 5-carboxymethyl-uridine, 1-carboxymethyl-pseudouridine, 5-propynyl-uridine, 1-propynyl-pseudouridine, 5-taurinomethyluridine, 1-taurinomethyl-pseudouridine, 5-taurinomethyl-2-thio-uridine, 1-taurinomethyl-4-thio-uridine, 5-methyl-uridine, 1-methyl-pseudouridine, 4-thio-1-methyl-pseudouridine, 2-thio-1-methyl-pseudouridine, 1-methyl-1-deaza-pseudouridine, 2-thio-1-methyl-1-deaza-pseudouridine, dihydrouridine, dihydropseudouridine, 2-thio-dihydrouridine, 2-thio-dihydropseudouridine, 2-methoxyuridine, 2-methoxy-4-thio-uridine, 4-methoxy-pseudouridine, and 4-methoxy-2-thio-pseudouridine.

In some embodiments, modified nucleosides include 5-aza-cytidine, pseudoisocytidine, 3-methyl-cytidine, N4-acetylcytidine, 5-formylcytidine, N4-methylcytidine, 5-hydroxymethylcytidine, 1-methyl-pseudoisocytidine, pyrrolo-cytidine, pyrrolo-pseudoisocytidine, 2-thio-cytidine, 2-thio-5-methyl-cytidine, 4-thio-pseudoisocytidine, 4-thio-1-methyl-pseudoisocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, and 4-methoxy-1-methyl-pseudoisocytidine.

In other embodiments, modified nucleosides include 2-aminopurine, 2, 6-diaminopurine, 7-deaza-adenine, 7-deaza-8-aza-adenine, 7-deaza-2-aminopurine, 7-deaza-8-aza-2-aminopurine, 7-deaza-2,6-diaminopurine, 7-deaza-8-aza-2,6-diaminopurine, 1-methyladenosine, N6-methyladenosine, N6-isopentenyladenosine, N6-(cis-hydroxyisopentenyDadenosine, 2-methylthio-N6-(cis-hydroxyisopentenyl) adenosine, N6-glycinylcarbamoyladenosine, N6-threonylcarbamoyladenosine, 2-methylthio-N6-threonyl carbamoyladenosine, N6,N6-dimethyladenosine, 7-methyladenine, 2-methylthio-adenine, and 2-methoxy-adenine.

In other embodiments, modified nucleosides include inosine, 1-methyl-inosine, wyosine, wybutosine, 7-deaza-guanosine, 7-deaza-8-aza-guanosine, 6-thio-guanosine, 6-thio-7-deaza-guanosine, 6-thio-7-deaza-8-aza-guanosine, 7-methyl-guanosine, 6-thio-7-methyl-guanosine, 7-methyl-inosine, 6-methoxy-guanosine, 1-methylguanosine, N2-methylguanosine, N2,N2-dimethylguanosine, 8-oxo-guanosine, 7-methyl-8-oxo-guanosine, 1-methyl-6-thio-guanosine, N2-methyl-6-thio-guanosine, and N2,N2-dimethyl-6-thio-guanosine.

In some embodiments, the nucleotide can be modified on the major groove face and can include replacing hydrogen on C-5 of uracil with a methyl group or a halo group. In specific embodiments, a modified nucleoside is 5'-O-(1-thiophosphate)-adenosine, 5'-O-(1-thiophosphate)-cytidine, 5'-O-(1-thiophosphate)-guanosine, 5'-O-(1-thiophosphate)-uridine or 5'-O-(1-thiophosphate)-pseudouridine.

In further specific embodiments, a modified RNA may comprise nucleoside modifications selected from 6-aza-cytidine, 2-thio-cytidine, α-thio-cytidine, Pseudo-iso-cytidine, 5-aminoallyl-uridine, 5-iodo-uridine, N1-methyl-pseudouridine, 5,6-dihydrouridine, α-thio-uridine, 4-thio-uridine, 6-aza-uridine, 5-hydroxy-uridine, deoxy-thymidine, 5-methyl-uridine, Pyrrolo-cytidine, inosine, α-thio-guanosine, 6-methyl-guanosine, 5-methyl-cytdine, 8-oxo-guanosine, 7-deaza-guanosine, N1-methyl-adenosine, 2-amino-6-Chloro-purine, N6-methyl-2-amino-purine, Pseudo-iso-cytidine, 6-Chloro-purine, N6-methyl-adenosine, α-thio-adenosine, 8-azido-adenosine, 7-deaza-adenosine.

In some embodiments of the invention, the RNA may not comprise any chemical modifications.

Lipid Modification

According to a further embodiment, a modified RNA as defined herein can contain a lipid modification. Such a lipid-modified RNA typically comprises an RNA as defined herein. Such a lipid-modified RNA as defined herein typically further comprises at least one linker covalently linked with that RNA, and at least one lipid covalently linked with the respective linker. Alternatively, the lipid-modified RNA comprises at least one RNA as defined herein and at least one (bifunctional) lipid covalently linked (without a linker) with that RNA. According to a third alternative, the lipid-modified RNA comprises an RNA molecule as defined herein, at least one linker covalently linked with that RNA, and at least one lipid covalently linked with the respective linker, and also at least one (bifunctional) lipid covalently linked (without a linker) with that RNA. In this context, it is particularly preferred that the lipid modification is present at the terminal ends of a linear RNA sequence.

G/C Content Modification

According to another embodiment, the RNA of the present invention, preferably an mRNA, may be modified, and thus stabilized, by modifying the guanosine/cytosine (G/C) content of the RNA, preferably of the at least one coding sequence of the RNA of the present invention.

In a particularly preferred embodiment of the present invention, the G/C content of the coding region of the RNA of the present invention is modified, particularly increased, compared to the G/C content of the coding region of the respective wild type RNA, i.e. the unmodified RNA. The amino acid sequence encoded by the RNA is preferably not modified as compared to the amino acid sequence encoded by the respective wild type RNA. This modification of the RNA of the present invention is based on the fact that the sequence of any RNA region to be translated is important for efficient translation of that RNA. Thus, the composition of the RNA and the sequence of various nucleotides are important. In particular, sequences having an increased G (guanosine)/C (cytosine) content are more stable than sequences having an increased A (adenosine)/U (uracil) content.

According to the invention, the codons of the RNA are therefore varied compared to the respective wild type RNA, while retaining the translated amino acid sequence, such that they include an increased amount of G/C nucleotides. In respect to the fact that several codons code for one and the same amino acid (so-called degeneration of the genetic code), the most favourable codons for the stability can be determined (so-called alternative codon usage). Depending on the amino acid to be encoded by the RNA, there are various possibilities for modification of the RNA sequence, compared to its wild type sequence. In the case of amino acids, which are encoded by codons, which contain exclusively G or C nucleotides, no modification of the codon is necessary. Thus, the codons for Pro (CCC or CCG), Arg (CGC or CGG), Ala (GCC or GCG) and Gly (GGC or GGG) require no modification, since no A or U is present. In contrast, codons which contain A and/or U nucleotides can be modified by substitution of other codons, which code for the same amino acids but contain no A and/or U. Examples of these are: the codons for Pro can be modified from CCU or CCA to CCC or CCG; the codons for Arg can be modified from CGU or CGA or AGA or AGG to CGC or CGG; the codons for Ala can be modified from GCU or GCA to GCC or GCG; the codons for Gly can be modified from GGU or GGA to GGC or GGG. In other cases, although A or U nucleotides cannot be eliminated from the codons, it is however possible to decrease the A and U content by using codons which contain a lower content of A and/or U nucleotides. Examples of these are: the codons for Phe can be modified from UUU to UUC; the codons for Leu can be modified from UUA, UUG, CUU or CUA to CUC or CUG; the codons for Ser can be modified from UCU or UCA or AGU to UCC, UCG or AGC; the codon for Tyr can be modified from UAU to UAC; the codon for Cys can be modified from UGU to UGC; the codon for His can be modified from CAU to CAC; the codon for Gln can be modified from CM to CAG; the codons for Ile can be modified from AUU or AUA to AUC; the codons for Thr can be modified from ACU or ACA to ACC or ACG; the codon for Asn can be modified from MU to MC; the codon for Lys can be modified from MA to AAG; the codons for Val can be modified from GUU or GUA to GUC or GUG; the codon for Asp can be modified from GAU to GAC; the codon for Glu can be modified from GAA to GAG; the stop codon UAA can be modified to UAG or UGA. In the case of the codons for Met (AUG) and Trp (UGG), on the other hand, there is no possibility of sequence modification. The substitutions listed above can be used either individually or in all possible combinations to increase the G/C content of the at least one mRNA of the composition of the present invention compared to its particular wild type mRNA (i.e. the original sequence). Thus, for example, all codons for Thr occurring in the wild type sequence can be modified to ACC (or ACG). Preferably, however, for example, combinations of the above substitution possibilities are used:

substitution of all codons coding for Thr in the original sequence (wild type mRNA) to ACC (or ACG) and substitution of all codons originally coding for Ser to UCC (or UCG or AGC); substitution of all codons coding for Ile in the original sequence to AUC and substitution of all codons originally coding for Lys to MG and substitution of all codons originally coding for Tyr to UAC; substitution of all codons coding for Val in the original sequence to GUC (or GUG) and substitution of all codons originally coding for Glu to GAG and substitution of all codons originally coding for Ala to GCC (or GCG) and substitution of all codons originally coding for Arg to CGC (or CGG); substitution of all codons coding for Val in the original sequence to GUC (or GUG) and substitution of all codons originally coding for Glu to GAG and substitution of all codons originally coding for Ala to GCC (or GCG) and substitution of all codons originally coding for Gly to GGC (or GGG) and substitution of all codons originally coding for Asn to MC; substitution of all codons coding for Val in the original sequence to GUC (or GUG) and substitution of all codons originally coding for Phe to UUC and substitution of all codons originally coding for Cys to UGC and substitution of all codons originally coding for Leu to CUG (or CUC) and substitution of all codons originally coding for Gln to CAG and substitution of all codons originally coding for Pro to CCC (or CCG); etc.

Preferably, the G/C content of the coding region of the RNA of the present invention is increased by at least 7%, more preferably by at least 15%, particularly preferably by at least 20%, compared to the G/C content of the coding region of the wild type RNA, which codes for a collagenase as defined herein or a fragment or variant thereof.

According to a specific embodiment at least 5%, 10%, 20%, 30%, 40%, 50%, 60%, more preferably at least 70%, even more preferably at least 80% and most preferably at least 90%, 95% or even 100% of the substitutable codons in the region coding for a collagenase as defined herein or a fragment or variant thereof or the whole sequence of the wild type RNA sequence are substituted, thereby increasing the GC/content of said sequence. In this context, it is particularly preferable to increase the G/C content of the RNA of the present invention, preferably of the at least one coding region of the RNA according to the invention, to the maximum (i.e. 100% of the substitutable codons) as compared to the wild type sequence.

According to the invention, a further preferred modification of the RNA of the present invention is based on the finding that the translation efficiency is also determined by a different frequency in the occurrence of tRNAs in cells. Thus, if so-called "rare codons" are present in the RNA of the present invention to an increased extent, the corresponding modified RNA sequence is translated to a significantly poorer degree than in the case where codons coding for relatively "frequent" tRNAs are present.

According to the invention, in the modified RNA of the present invention, the region which codes for a collagenase as defined herein or a fragment or variant thereof is modified compared to the corresponding region of the wild type RNA such that at least one codon of the wild type sequence, which codes for a tRNA which is relatively rare in the cell, is exchanged for a codon, which codes for a tRNA which is relatively frequent in the cell and carries the same amino acid as the relatively rare tRNA. By this modification, the sequences of the RNA of the present invention is modified such that codons for which frequently occurring tRNAs are available are inserted. In other words, according to the invention, by this modification all codons of the wild type sequence, which code for a tRNA which is relatively rare in the cell, can in each case be exchanged for a codon, which codes for a tRNA which is relatively frequent in the cell and which, in each case, carries the same amino acid as the relatively rare tRNA. Which tRNAs occur relatively frequently in the cell and which, in contrast, occur relatively rarely is known to a person skilled in the art; cf. e.g. Akashi, Curr. Opin. Genet. Dev. 2001, 11(6): 660-666. The codons, which use for the particular amino acid the tRNA which occurs the most frequently, e.g. the Gly codon, which uses the tRNA, which occurs the most frequently in the (human) cell, are particularly preferred.

According to the invention, it is particularly preferable to link the sequential G/C content which is increased, in particular maximized, in the modified RNA of the present invention, with the "frequent" codons without modifying the amino acid sequence of the protein encoded by the coding region of the RNA. This preferred embodiment allows provision of a particularly efficiently translated and stabilized (modified) RNA of the present invention. The determination of a modified RNA of the present invention as described above (increased G/C content; exchange of tRNAs) can be carried out using the computer program explained in WO02/098443—the disclosure content of which is included in its full scope in the present invention. Using this computer program, the nucleotide sequence of any desired RNA can be modified with the aid of the genetic code or the degenerative nature thereof such that a maximum G/C content results, in combination with the use of codons which code for tRNAs occurring as frequently as possible in the cell, the amino acid sequence coded by the modified RNA preferably not being modified compared to the non-modified sequence. Alternatively, it is also possible to modify only the G/C content or only the codon usage compared to the original sequence. The source code in Visual Basic 6.0 (development environment used: Microsoft Visual Studio Enterprise 6.0 with Servicepack 3) is also described in WO02/098443. In a further preferred embodiment of the present invention, the A/U content in the environment of the ribosome binding site of the RNA of the present invention is increased compared to the A/U content in the environment of the ribosome binding site of its respective wild type mRNA. This modification (an increased A/U content around the ribosome binding site) increases the efficiency of ribosome binding to the RNA. An effective binding of the ribosomes to the ribosome binding site (Kozak sequence: SEQ ID NO: 5037; the AUG forms the start codon) in turn has the effect of an efficient translation of the RNA.

According to a further embodiment of the present invention, the RNA of the present invention may be modified with respect to potentially destabilizing sequence elements. Particularly, the coding region and/or the 5' and/or 3' untranslated region of this RNA may be modified compared to the respective wild type RNA such that it contains no destabilizing sequence elements, the encoded amino acid sequence of the modified RNA preferably not being modified compared to its respective wild type RNA. It is known that, for example in sequences of eukaryotic RNAs, destabilizing sequence elements (DSE) occur, to which signal proteins bind and regulate enzymatic degradation of RNA in vivo. For further stabilization of the modified RNA, optionally in the region which encodes a therapeutic protein (in particular a collagenase, growth factor, cytokine, receptor, chaperone or signal transduction inhibitor) as defined herein or a fragment or variant thereof, one or more such modifications compared to the corresponding region of the wild type RNA can therefore be carried out, so that no or substantially no destabilizing sequence elements are contained there. According to the invention, DSE present in the untranslated regions (3'- and/or 5'-UTR) can also be eliminated from the RNA of the present invention by such modifications. Such destabilizing sequences are e.g. AU-rich sequences (AU-RES), which occur in 3'-UTR sections of numerous unstable RNAs (Caput et al., Proc. Natl. Acad. Sci. USA 1986, 83: 1670 to 1674). The RNA of the present invention is therefore preferably modified compared to the respective wild type RNA such that the RNA of the present invention contains no such destabilizing sequences. This also applies to those sequence motifs which are recognized by possible endonucleases, e.g. the sequence GAACAAG, which is contained in the 3'-UTR segment of the gene encoding the transferrin receptor (Binder et al., EMBO J. 1994, 13: 1969-1980). These sequence motifs are also preferably removed in the RNA of the present invention.

GC Optimized Sequences

In a preferred embodiment, the present invention provides an RNA comprising at least one coding sequence, wherein the coding sequence comprises or consists of a nucleic acid sequence selected from the group consisting of SEQ ID NO: 216; 217; 218; 219; 220; 221; 222; 223; 224; 225; 226; 227; 228; 229; 230; 231; 232; 233; 234; 235; 236; 237; 238; 239; 240; 241; 242; 243; 244; 245; 246; 247; 248; 249; 250; 251; 252; 253; 254; 255; 256; 257; 258; 259; 260; 261; 262; 263; 264; 265; 266; 267; 268; 269; 270; 271; 272; 273; 274; 275; 276; 277; 278; 279; 280; 281; 282; 283; 284; 285; 286; 287; 288; 289; 290; 291; 292; 293; 294; 295; 296; 297; 298; 299; 300; 301; 302; 303; 304; 305; 306; 307; 604; 605; 606; 607; 608; 609; 610; 611; 612; 613; 614; 615; 616; 617; 618; 619; 620; 621; 622; 623; 624; 625; 626; 627; 628; 629; 630; 631; 632; 633; 634; 635; 636; 637; 638; 639; 640; 641; 642; 643; 644; 645; 646; 647; 648; 649; 650; 651; 652; 653; 654; 655; 656; 657; 658; 659; 660; 661; 662; 663; 664; 665; 666; 667; 668; 669; 670; 671; 672; 673; 674; 675; 676; 677; 678; 679; 680; 681; 682; 683; 684; 685; 686; 687; 688; 689; 690; 691; 692; 693; 694; 695; 701; 702; 703; 704; 705; 706; 707; 708; 709; 710; 711; 712; 713; 714; 715; 716; 717; 718; 719; 720; 721; 722; 723; 724; 725; 726; 727; 728; 729; 730; 731; 732; 733; 734; 735; 736; 737; 738; 739; 740; 741; 742; 743; 744; 745; 746; 747; 748; 749; 750; 751; 752; 753; 754; 755; 756; 757; 758; 759; 760; 761; 762; 763; 764; 765; 766; 767; 768; 769; 770; 771; 772; 773; 774; 775; 776; 777; 778; 779; 780; 781; 782; 783; 784; 785; 786; 787; 788; 789; 790; 791; 792;

798; 799; 800; 801; 802; 803; 804; 805; 806; 807; 808; 809; 810; 811; 812; 813; 814; 815; 816; 817; 818; 819; 820; 821; 822; 823; 824; 825; 826; 827; 828; 829; 830; 831; 832; 833; 834; 835; 836; 837; 838; 839; 840; 841; 842; 843; 844; 845; 846; 847; 848; 849; 850; 851; 852; 853; 854; 855; 856; 857; 858; 859; 860; 861; 862; 863; 864; 865; 866; 867; 868; 869; 870; 871; 872; 873; 874; 875; 876; 877; 878; 879; 880; 881; 882; 883; 884; 885; 886; 887; 888; 889; 895; 896; 897; 898; 899; 900; 901; 902; 903; 904; 905; 906; 907; 908; 909; 910; 911; 912; 913; 914; 915; 916; 917; 918; 919; 920; 921; 922; 923; 924; 925; 926; 927; 928; 929; 930; 931; 932; 933; 934; 935; 936; 937; 938; 939; 940; 941; 942; 943; 944; 945; 946; 947; 948; 949; 950; 951; 952; 953; 954; 955; 956; 957; 958; 959; 960; 961; 962; 963; 964; 965; 966; 967; 968; 969; 970; 971; 972; 973; 974; 975; 976; 977; 978; 979; 980; 981; 982; 983; 984; 985; 986; 992; 993; 994; 995; 996; 997; 998; 999; 1000; 1001; 1002; 1003; 1004; 1005; 1006; 1007; 1008; 1009; 1010; 1011; 1012; 1013; 1014; 1015; 1016; 1017; 1018; 1019; 1020; 1021; 1022; 1023; 1024; 1025; 1026; 1027; 1028; 1029; 1030; 1031; 1032; 1033; 1034; 1035; 1036; 1037; 1038; 1039; 1040; 1041; 1042; 1043; 1044; 1045; 1046; 1047; 1048; 1049; 1050; 1051; 1052; 1053; 1054; 1055; 1056; 1057; 1058; 1059; 1060; 1061; 1062; 1063; 1064; 1065; 1066; 1067; 1068; 1069; 1070; 1071; 1072; 1073; 1074; 1075; 1076; 1077; 1078; 1079; 1080; 1081; 1082; 1083; 1089; 1090; 1091; 1092; 1093; 1094; 1095; 1096; 1097; 1098; 1099; 1100; 1101; 1102; 1103; 1104; 1105; 1106; 1107; 1108; 1109; 1110; 1111; 1112; 1113; 1114; 1115; 1116; 1117; 1118; 1119; 1120; 1121; 1122; 1123; 1124; 1125; 1126; 1127; 1128; 1129; 1130; 1131; 1132; 1133; 1134; 1135; 1136; 1137; 1138; 1139; 1140; 1141; 1142; 1143; 1144; 1145; 1146; 1147; 1148; 1149; 1150; 1151; 1152; 1153; 1154; 1155; 1156; 1157; 1158; 1159; 1160; 1161; 1162; 1163; 1164; 1165; 1166; 1167; 1168; 1169; 1170; 1171; 1172; 1173; 1174; 1175; 1176; 1177; 1178; 1179; 1180; 1186; 1187; 1188; 1189; 1190; 1191; 1192; 1193; 1194; 1195; 1196; 1197; 1198; 1199; 1200; 1201; 1202; 1203; 1204; 1205; 1206; 1207; 1208; 1209; 1210; 1211; 1212; 1213; 1214; 1215; 1216; 1217; 1218; 1219; 1220; 1221; 1222; 1223; 1224; 1225; 1226; 1227; 1228; 1229; 1230; 1231; 1232; 1233; 1234; 1235; 1236; 1237; 1238; 1239; 1240; 1241; 1242; 1243; 1244; 1245; 1246; 1247; 1248; 1249; 1250; 1251; 1252; 1253; 1254; 1255; 1256; 1257; 1258; 1259; 1260; 1261; 1262; 1263; 1264; 1265; 1266; 1267; 1268; 1269; 1270; 1271; 1272; 1273; 1274; 1275; 1276; 1277; 1283; 1284; 1285; 1286; 1287; 1288; 1289; 1290; 1291; 1292; 1293; 1294; 1295; 1296; 1297; 1298; 1299; 1300; 1301; 1302; 1303; 1304; 1305; 1306; 1307; 1308; 1309; 1310; 1311; 1312; 1313; 1314; 1315; 1316; 1317; 1318; 1319; 1320; 1321; 1322; 1323; 1324; 1325; 1326; 1327; 1328; 1329; 1330; 1331; 1332; 1333; 1334; 1335; 1336; 1337; 1338; 1339; 1340; 1341; 1342; 1343; 1344; 1345; 1346; 1347; 1348; 1349; 1350; 1351; 1352; 1353; 1354; 1355; 1356; 1357; 1358; 1359; 1360; 1361; 1362; 1363; 1364; 1365; 1366; 1367; 1368; 1369; 1370; 1371; 1372; 1373; 1374; 5204; 5205; 5206; 5207; 5220; 5221; 5222; 5223; 5224; 5225; 5226; 5227; 5228; 5229; 5230; 5231; 5232; 5233; 5234; 5235; 5236; 5237; 5238; 5239; 5240; 5241; 5242; 5243; 5244; 5245; 5246; 5247; 5248; 5249; 5250 or 5251 or a fragment or variant of any one of these nucleic acid sequences.

In a further preferred embodiment, the at least one coding sequence of the RNA of the present invention encodes a peptide or protein comprising or consisting of a collagenase as defined herein, preferably MMP-1, ColH or ColG. According to a particularly preferred embodiment, the at least one coding sequence of the RNA of the present invention may thus comprise at least one coding sequence encoding a MMP1 polypeptide, said coding region comprising or consisting of a RNA sequence according to SEQ ID NO: 217; 218; 605; 606; 702; 703; 799; 800; 896; 897; 993; 994; 1090; 1091; 1187; 1188; 1284; 1285 or a fragment or variant of any one of these nucleic acid sequences, with a RNA sequence according to SEQ ID NO: 217 or 218 being particularly preferred. According to a particularly preferred embodiment, the at least one coding sequence of the RNA of the present invention may thus comprise at least one coding sequence encoding a ColG polypeptide, said coding region comprising or consisting of an RNA sequence according to SEQ ID NO: 219; 220; 221; 607; 608; 609; 704; 705; 706; 801; 802; 803; 898; 899; 900; 995; 996; 997; 1092; 1093; 1094; 1189; 1190; 1191; 1286; 1287; 1288; 5204; 5205; 5220; 5221; 5224; 5225; 5228; 5229; 5232; 5233; 5236; 5237; 5240; 5241; 5244; 5245; 5248; 5249 or a fragment or variant of any one of these nucleic acid sequences, with a RNA sequence according to SEQ ID NO: 219, 220 or 221 being particularly preferred. According to a particularly preferred embodiment, the at least one coding sequence of the RNA of the present invention may thus comprise at least one coding sequence encoding a ColH polypeptide, said coding region comprising or consisting of an RNA sequence according to SEQ ID NO: 222; 223; 224; 225; 610; 611; 612; 613; 707; 708; 709; 710; 804; 805; 806; 807; 901; 902; 903; 904; 998; 999; 1000; 1001; 1095; 1096; 1097; 1098; 1192; 1193; 1194; 1195; 1289; 1290; 1291; 1292; 5206; 5207; 5222; 5223; 5226; 5227; 5230; 5231; 5234; 5235; 5238; 5239; 5242; 5243; 5246; 5247; 5250; 5251 or a fragment or variant of any one of these nucleic acid sequences, with a RNA sequence according to SEQ ID NO: 223, 224 or 225 being particularly preferred.

According to a further embodiment, the at least one coding sequence of the RNA according to the invention comprises or consists of a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with a nucleic acid sequence selected from the group consisting of SEQ ID NO: 216; 217; 218; 219; 220; 221; 222; 223; 224; 225; 226; 227; 228; 229; 230; 231; 232; 233; 234; 235; 236; 237; 238; 239; 240; 241; 242; 243; 244; 245; 246; 247; 248; 249; 250; 251; 252; 253; 254; 255; 256; 257; 258; 259; 260; 261; 262; 263; 264; 265; 266; 267; 268; 269; 270; 271; 272; 273; 274; 275; 276; 277; 278; 279; 280; 281; 282; 283; 284; 285; 286; 287; 288; 289; 290; 291; 292; 293; 294; 295; 296; 297; 298; 299; 300; 301; 302; 303; 304; 305; 306; 307; 604; 605; 606; 607; 608; 609; 610; 611; 612; 613; 614; 615; 616; 617; 618; 619; 620; 621; 622; 623; 624; 625; 626; 627; 628; 629; 630; 631; 632; 633; 634; 635; 636; 637; 638; 639; 640; 641; 642; 643; 644; 645; 646; 647; 648; 649; 650; 651; 652; 653; 654; 655; 656; 657; 658; 659; 660; 661; 662; 663; 664; 665; 666; 667; 668; 669; 670; 671; 672; 673; 674; 675; 676; 677; 678; 679; 680; 681; 682; 683; 684; 685; 686; 687; 688; 689; 690; 691; 692; 693; 694; 695; 701; 702; 703; 704; 705; 706; 707; 708; 709; 710; 711; 712; 713; 714; 715; 716; 717; 718; 719; 720; 721; 722; 723; 724; 725; 726; 727; 728; 729; 730; 731; 732; 733; 734; 735; 736; 737; 738; 739; 740; 741; 742; 743; 744; 745; 746; 747; 748; 749; 750; 751; 752; 753; 754; 755; 756; 757; 758; 759; 760; 761; 762; 763; 764; 765; 766; 767; 768; 769; 770; 771; 772; 773; 774; 775; 776; 777; 778; 779; 780; 781; 782; 783; 784; 785; 786;

787; 788; 789; 790; 791; 792; 798; 799; 800; 801; 802; 803; 804; 805; 806; 807; 808; 809; 810; 811; 812; 813; 814; 815; 816; 817; 818; 819; 820; 821; 822; 823; 824; 825; 826; 827; 828; 829; 830; 831; 832; 833; 834; 835; 836; 837; 838; 839; 840; 841; 842; 843; 844; 845; 846; 847; 848; 849; 850; 851; 852; 853; 854; 855; 856; 857; 858; 859; 860; 861; 862; 863; 864; 865; 866; 867; 868; 869; 870; 871; 872; 873; 874; 875; 876; 877; 878; 879; 880; 881; 882; 883; 884; 885; 886; 887; 888; 889; 895; 896; 897; 898; 899; 900; 901; 902; 903; 904; 905; 906; 907; 908; 909; 910; 911; 912; 913; 914; 915; 916; 917; 918; 919; 920; 921; 922; 923; 924; 925; 926; 927; 928; 929; 930; 931; 932; 933; 934; 935; 936; 937; 938; 939; 940; 941; 942; 943; 944; 945; 946; 947; 948; 949; 950; 951; 952; 953; 954; 955; 956; 957; 958; 959; 960; 961; 962; 963; 964; 965; 966; 967; 968; 969; 970; 971; 972; 973; 974; 975; 976; 977; 978; 979; 980; 981; 982; 983; 984; 985; 986; 992; 993; 994; 995; 996; 997; 998; 999; 1000; 1001; 1002; 1003; 1004; 1005; 1006; 1007; 1008; 1009; 1010; 1011; 1012; 1013; 1014; 1015; 1016; 1017; 1018; 1019; 1020; 1021; 1022; 1023; 1024; 1025; 1026; 1027; 1028; 1029; 1030; 1031; 1032; 1033; 1034; 1035; 1036; 1037; 1038; 1039; 1040; 1041; 1042; 1043; 1044; 1045; 1046; 1047; 1048; 1049; 1050; 1051; 1052; 1053; 1054; 1055; 1056; 1057; 1058; 1059; 1060; 1061; 1062; 1063; 1064; 1065; 1066; 1067; 1068; 1069; 1070; 1071; 1072; 1073; 1074; 1075; 1076; 1077; 1078; 1079; 1080; 1081; 1082; 1083; 1089; 1090; 1091; 1092; 1093; 1094; 1095; 1096; 1097; 1098; 1099; 1100; 1101; 1102; 1103; 1104; 1105; 1106; 1107; 1108; 1109; 1110; 1111; 1112; 1113; 1114; 1115; 1116; 1117; 1118; 1119; 1120; 1121; 1122; 1123; 1124; 1125; 1126; 1127; 1128; 1129; 1130; 1131; 1132; 1133; 1134; 1135; 1136; 1137; 1138; 1139; 1140; 1141; 1142; 1143; 1144; 1145; 1146; 1147; 1148; 1149; 1150; 1151; 1152; 1153; 1154; 1155; 1156; 1157; 1158; 1159; 1160; 1161; 1162; 1163; 1164; 1165; 1166; 1167; 1168; 1169; 1170; 1171; 1172; 1173; 1174; 1175; 1176; 1177; 1178; 1179; 1180; 1186; 1187; 1188; 1189; 1190; 1191; 1192; 1193; 1194; 1195; 1196; 1197; 1198; 1199; 1200; 1201; 1202; 1203; 1204; 1205; 1206; 1207; 1208; 1209; 1210; 1211; 1212; 1213; 1214; 1215; 1216; 1217; 1218; 1219; 1220; 1221; 1222; 1223; 1224; 1225; 1226; 1227; 1228; 1229; 1230; 1231; 1232; 1233; 1234; 1235; 1236; 1237; 1238; 1239; 1240; 1241; 1242; 1243; 1244; 1245; 1246; 1247; 1248; 1249; 1250; 1251; 1252; 1253; 1254; 1255; 1256; 1257; 1258; 1259; 1260; 1261; 1262; 1263; 1264; 1265; 1266; 1267; 1268; 1269; 1270; 1271; 1272; 1273; 1274; 1275; 1276; 1277; 1283; 1284; 1285; 1286; 1287; 1288; 1289; 1290; 1291; 1292; 1293; 1294; 1295; 1296; 1297; 1298; 1299; 1300; 1301; 1302; 1303; 1304; 1305; 1306; 1307; 1308; 1309; 1310; 1311; 1312; 1313; 1314; 1315; 1316; 1317; 1318; 1319; 1320; 1321; 1322; 1323; 1324; 1325; 1326; 1327; 1328; 1329; 1330; 1331; 1332; 1333; 1334; 1335; 1336; 1337; 1338; 1339; 1340; 1341; 1342; 1343; 1344; 1345; 1346; 1347; 1348; 1349; 1350; 1351; 1352; 1353; 1354; 1355; 1356; 1357; 1358; 1359; 1360; 1361; 1362; 1363; 1364; 1365; 1366; 1367; 1368; 1369; 1370; 1371; 1372; 1373; 1374; 5204; 5205; 5206; 5207; 5220; 5221; 5222; 5223; 5224; 5225; 5226; 5227; 5228; 5229; 5230; 5231; 5232; 5233; 5234; 5235; 5236; 5237; 5238; 5239; 5240; 5241; 5242; 5243; 5244; 5245; 5246; 5247; 5248; 5249; 5250 or 5251 or a fragment or variant of any one of these nucleic acid sequences.

Sequences Adapted to Human Codon Usage

According to the invention, a further preferred modification of the RNA of the present invention is based on the finding that codons encoding the same amino acid typically occur at different frequencies. According to the invention, in the modified RNA of the present invention, the coding sequence (coding region) as defined herein is preferably modified compared to the corresponding region of the respective wild type RNA such that the frequency of the codons encoding the same amino acid corresponds to the naturally occurring frequency of that codon according to the human codon usage as e.g. shown in Table 2.

For example, in the case of the amino acid alanine (Ala) present in an amino acid sequence encoded by the at least one coding sequence of the RNA according to the invention, the wild type coding sequence is preferably adapted in a way that the codon "GCC" is used with a frequency of 0.40, the codon "GCT" is used with a frequency of 0.28, the codon "GCA" is used with a frequency of 0.22 and the codon "GCG" is used with a frequency of 0.10 etc. (see Table 2).

TABLE 2

Human codon usage table

| Amino acid | codon | fraction | Amino acid /1000 | | codon | fraction | /1000 |
|---|---|---|---|---|---|---|---|
| Ala | GCG | 0.10 | 7.4 | Pro | CCG | 0.11 | 6.9 |
| Ala | GCA | 0.22 | 15.8 | Pro | CCA | 0.27 | 16.9 |
| Ala | GCT | 0.28 | 18.5 | Pro | CCT | 0.29 | 17.5 |
| Ala | GCC* | 0.40 | 27.7 | Pro | CCC* | 0.33 | 19.8 |
| Cys | TGT | 0.42 | 10.6 | Gln | CAG* | 0.73 | 34.2 |
| Cys | TGC* | 0.58 | 12.6 | Gln | CAA | 0.27 | 12.3 |
| Asp | GAT | 0.44 | 21.8 | Arg | AGG | 0.22 | 12.0 |
| Asp | GAC* | 0.56 | 25.1 | Arg | AGA* | 0.21 | 12.1 |
| Glu | GAG* | 0.59 | 39.6 | Arg | CGG | 0.19 | 11.4 |
| Glu | GAA | 0.41 | 29.0 | Arg | CGA | 0.10 | 6.2 |
| Phe | TTT | 0.43 | 17.6 | Arg | CGT | 0.09 | 4.5 |
| Phe | TTC* | 0.57 | 20.3 | Arg | CGC | 0.19 | 10.4 |
| Gly | GGG | 0.23 | 16.5 | Ser | AGT | 0.14 | 12.1 |
| Gly | GGA | 0.26 | 16.5 | Ser | AGC* | 0.25 | 19.5 |
| Gly | GGT | 0.18 | 10.8 | Ser | TCG | 0.06 | 4.4 |
| Gly | GGC* | 0.33 | 22.2 | Ser | TCA | 0.15 | 12.2 |
| His | CAT | 0.41 | 10.9 | Ser | TCT | 0.18 | 15.2 |
| His | CAC* | 0.59 | 15.1 | Ser | TCC | 0.23 | 17.7 |
| Ile | ATA | 0.14 | 7.5 | Thr | ACG | 0.12 | 6.1 |
| Ile | ATT | 0.35 | 16.0 | Thr | ACA | 0.27 | 15.1 |
| Ile | ATC* | 0.52 | 20.8 | Thr | ACT | 0.23 | 13.1 |
| Lys | AAG* | 0.60 | 31.9 | Thr | ACC* | 0.38 | 18.9 |
| Lys | AAA | 0.40 | 24.4 | Val | GTG* | 0.48 | 28.1 |
| Leu | TTG | 0.12 | 12.9 | Val | GTA | 0.10 | 7.1 |
| Leu | TTA | 0.06 | 7.7 | Val | GTT | 0.17 | 11.0 |
| Leu | CTG* | 0.43 | 39.6 | Val | GTC | 0.25 | 14.5 |
| Leu | CTA | 0.07 | 7.2 | Trp | TGG* | 1 | 13.2 |
| Leu | CTT | 0.12 | 13.2 | Tyr | TAT | 0.42 | 12.2 |

TABLE 2-continued

Human codon usage table

| Amino acid | codon | fraction | Amino /1000 acid | | codon | fraction | /1000 |
|---|---|---|---|---|---|---|---|
| Leu | CTC | 0.20 | 19.6 | Tyr | TAC* | 0.58 | 15.3 |
| Met | ATG* | 1 | 22.0 | Stop | TGA* | 0.61 | 1.6 |
| Asn | AAT | 0.44 | 17.0 | Stop | TAG | 0.17 | 0.8 |
| Asn | AAC* | 0.56 | 19.1 | Stop | TAA | 0.22 | 1.0 |

*most frequent codon

In a preferred embodiment, the present invention provides an RNA comprising at least one coding sequence, wherein the coding sequence comprises a nucleic acid sequence selected from the group consisting of SEQ ID NO: 410; 411; 412; 413; 414; 415; 416; 417; 418; 419; 420; 421; 422; 423; 424; 425; 426; 427; 428; 429; 430; 431; 432; 433; 434; 435; 436; 437; 438; 439; 440; 441; 442; 443; 444; 445; 446; 447; 448; 449; 450; 451; 452; 453; 454; 455; 456; 457; 458; 459; 460; 461; 462; 463; 464; 465; 466; 467; 468; 469; 470; 471; 472; 473; 474; 475; 476; 477; 478; 479; 480; 481; 482; 483; 484; 485; 486; 487; 488; 489; 490; 491; 492; 493; 494; 495; 496; 497; 498; 499; 500; 501; 5212; 5213; 5214; 5215 or a fragment or variant of any one of said nucleic acid sequences.

In a further preferred embodiment, the at least one coding sequence of the RNA of the present invention encodes a peptide or protein comprising or consisting of a collagenase as defined herein, preferably MMP-1, ColH or ColG. According to a particularly preferred embodiment, the at least one coding sequence of the RNA of the present invention may thus comprise at least one coding sequence encoding a MMP1 polypeptide, said coding region comprising or consisting of an RNA sequence according to SEQ ID NO: 411 or 412 or a fragment or variant of any one of these nucleic acid sequences. According to a particularly preferred embodiment, the at least one coding sequence of the RNA of the present invention may thus comprise at least one coding sequence encoding a ColG polypeptide, said coding region comprising or consisting of an RNA sequence according to SEQ ID NO: 413; 414; 415; 5212; 5213 or a fragment or variant of any one of these nucleic acid sequences. According to a particularly preferred embodiment, the at least one coding sequence of the RNA of the present invention may thus comprise at least one coding sequence encoding a ColH polypeptide, said coding region comprising or consisting of an RNA sequence according to SEQ ID NO: 416; 417; 418; 419; 5214; 5215 or a fragment or variant of any one of these nucleic acid sequences.

According to a further embodiment, the at least one coding sequence of the RNA according to the invention comprises or consists of a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with a nucleic acid sequence selected from the group consisting of SEQ ID NO: 410; 411; 412; 413; 414; 415; 416; 417; 418; 419; 420; 421; 422; 423; 424; 425; 426; 427; 428; 429; 430; 431; 432; 433; 434; 435; 436; 437; 438; 439; 440; 441; 442; 443; 444; 445; 446; 447; 448; 449; 450; 451; 452; 453; 454; 455; 456; 457; 458; 459; 460; 461; 462; 463; 464; 465; 466; 467; 468; 469; 470; 471; 472; 473; 474; 475; 476; 477; 478; 479; 480; 481; 482; 483; 484; 485; 486; 487; 488; 489; 490; 491; 492; 493; 494; 495; 496; 497; 498; 499; 500; 501; 5212; 5213; 5214; 5215 or a fragment or variant of any one of said nucleic acid sequences.

Codon-Optimized Sequences

As described above it is preferred according to the invention, that all codons of the wild type sequence which code for a tRNA, which is relatively rare in the cell, are exchanged for a codon which codes for a tRNA, which is relatively frequent in the cell and which, in each case, carries the same amino acid as the relatively rare tRNA. Therefore it is particularly preferred that the most frequent codons are used for each encoded amino acid (see Table 2, most frequent codons are marked with asterisks). Such an optimization procedure increases the codon adaptation index (CAI) and ultimately maximises the CAI. In the context of the invention, sequences with increased or maximized CAI are typically referred to as "codon-optimized" sequences and/or CAI increased and/or maximized sequences. According to a preferred embodiment, the RNA of the present invention comprises at least one coding sequence, wherein the coding sequence is codon-optimized as described herein. More preferably, the codon adaptation index (CAI) of the at least one coding sequence is at least 0.5, at least 0.8, at least 0.9 or at least 0.95. Most preferably, the codon adaptation index (CAI) of the at least one coding sequence is 1.

For example, in the case of the amino acid alanine (Ala) present in the amino acid sequence encoded by the at least one coding sequence of the RNA according to the invention, the wild type coding sequence is adapted in a way that the most frequent human codon "GCC" is always used for said amino acid, or for the amino acid Cysteine (Cys), the wild type sequence is adapted in a way that the most frequent human codon "TGC" is always used for said amino acid etc.

In a preferred embodiment, the present invention provides an RNA comprising at least one coding sequence, wherein the coding sequence comprises a nucleic acid sequence selected from the group consisting of SEQ ID NO: 507; 508; 509; 510; 511; 512; 513; 514; 515; 516; 517; 518; 519; 520; 521; 522; 523; 524; 525; 526; 527; 528; 529; 530; 531; 532; 533; 534; 535; 536; 537; 538; 539; 540; 541; 542; 543; 544; 545; 546; 547; 548; 549; 550; 551; 552; 553; 554; 555; 556; 557; 558; 559; 560; 561; 562; 563; 564; 565; 566; 567; 568; 569; 570; 571; 572; 573; 574; 575; 576; 577; 578; 579; 580; 581; 582; 583; 584; 585; 586; 587; 588; 589; 590; 591; 592; 593; 594; 595; 596; 597; 598; 5216; 5217; 5218 or 5219 or a fragment or variant of any one of said nucleic acid sequences.

In a further preferred embodiment, the at least one coding sequence of the RNA of the present invention encodes a peptide or protein comprising or consisting of a collagenase as defined herein, preferably MMP-1, ColH or ColG. According to a particularly preferred embodiment, the at least one coding sequence of the RNA of the present invention may thus comprise at least one coding sequence encoding a MMP1 polypeptide, said coding region comprising or consisting of an RNA sequence according to SEQ ID NO: 508 or 509 or a fragment or variant of any one of these nucleic acid sequences. According to a particularly preferred embodiment, the at least one coding sequence of the RNA of the present invention may thus comprise at least one coding sequence encoding a ColG polypeptide, said coding region comprising or consisting of an RNA sequence according to SEQ ID NO: 510; 511; 512; 5216; 5217 or a fragment or variant of any one of these nucleic acid sequences. According to a particularly preferred embodiment, the at least one coding sequence of the RNA of the present invention may thus comprise at least one coding sequence encoding a ColH polypeptide, said coding region comprising or consisting of an RNA sequence according to SEQ ID NO: 513; 514; 515; 516; 5218; 5219 or a fragment or variant of any one of these nucleic acid sequences.

According to a further embodiment, the at least one coding sequence of the RNA according to the invention comprises or consists of a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with a nucleic acid sequence selected from the group consisting of SEQ ID NO: 507; 508; 509; 510; 511; 512; 513; 514; 515; 516; 517; 518; 519; 520; 521; 522; 523; 524; 525; 526; 527; 528; 529; 530; 531; 532; 533; 534; 535; 536; 537; 538; 539; 540; 541; 542; 543; 544; 545; 546; 547; 548; 549; 550; 551; 552; 553; 554; 555; 556; 557; 558; 559; 560; 561; 562; 563; 564; 565; 566; 567; 568; 569; 570; 571; 572; 573; 574; 575; 576; 577; 578; 579; 580; 581; 582; 583; 584; 585; 586; 587; 588; 589; 590; 591; 592; 593; 594; 595; 596; 597; 598; 5216; 5217; 5218 or 5219 or a fragment or variant of any one of said nucleic acid sequences.

C-Optimized Sequences

According to another embodiment, the RNA of the composition of the present invention may be modified by modifying, preferably increasing, the cytosine (C) content of the RNA, preferably of the coding region of the aRNA.

In a particularly preferred embodiment of the present invention, the C content of the coding region of the RNA of the present invention is modified, preferably increased, compared to the C content of the coding region of the respective wild type RNA, i.e. the unmodified RNA. The amino acid sequence encoded by the at least one coding sequence of the RNA of the present invention is preferably not modified as compared to the amino acid sequence encoded by the respective wild type mRNA.

In a preferred embodiment of the present invention, the modified RNA is modified such that at least 10%, 20%, 30%, 40%, 50%, 60%, 70% or 80%, or at least 90% of the theoretically possible maximum cytosine-content or even a maximum cytosine-content is achieved.

In further preferred embodiments, at least 10%, 20%, 30%, 40%, 50%, 60%, 70%, 80%, 90% or even 100% of the codons of the target RNA wild type sequence, which are "cytosine content optimizable" are replaced by codons having a higher cytosine-content than the ones present in the wild type sequence.

In a further preferred embodiment, some of the codons of the wild type coding sequence may additionally be modified such that a codon for a relatively rare tRNA in the cell is exchanged by a codon for a relatively frequent tRNA in the cell, provided that the substituted codon for a relatively frequent tRNA carries the same amino acid as the relatively rare tRNA of the original wild type codon. Preferably, all of the codons for a relatively rare tRNA are replaced by a codon for a relatively frequent tRNA in the cell, except codons encoding amino acids, which are exclusively encoded by codons not containing any cytosine, or except for glutamine (Gln), which is encoded by two codons each containing the same number of cytosines.

In a further preferred embodiment of the present invention, the modified target RNA is modified such that at least 80%, or at least 90% of the theoretically possible maximum cytosine-content or even a maximum cytosine-content is achieved by means of codons, which code for relatively frequent tRNAs in the cell, wherein the amino acid sequence remains unchanged.

Due to the naturally occurring degeneracy of the genetic code, more than one codon may encode a particular amino acid. Accordingly, 18 out of 20 naturally occurring amino acids are encoded by more than one codon (with Tryp and Met being an exception), e.g. by 2 codons (e.g. Cys, Asp, Glu), by three codons (e.g. Ile), by 4 codons (e.g. Al, Gly, Pro) or by 6 codons (e.g. Leu, Arg, Ser). However, not all codons encoding the same amino acid are utilized with the same frequency under in vivo conditions. Depending on each single organism, a typical codon usage profile is established.

The term "cytosine content-optimizable codon" as used within the context of the present invention refers to codons, which exhibit a lower content of cytosines than other codons encoding the same amino acid. Accordingly, any wild type codon, which may be replaced by another codon encoding the same amino acid and exhibiting a higher number of cytosines within that codon, is considered to be cytosine-optimizable (C-optimizable). Any such substitution of a C-optimizable wild type codon by the specific C-optimized codon within a wild type coding region increases its overall C-content and reflects a C-enriched modified mRNA sequence.

According to a preferred embodiment, the RNA of the present invention, preferably the at least one coding sequence of the RNA of the present invention comprises or consists of a C-maximized RNA sequence containing C-optimized codons for all potentially C-optimizable codons. Accordingly, 100% or all of the theoretically replaceable C-optimizable codons are preferably replaced by C-optimized codons over the entire length of the coding region.

In this context, cytosine-content optimizable codons are codons, which contain a lower number of cytosines than other codons coding for the same amino acid.

TABLE 3

Human codons with optimizable versus optimized C-content

| Amino acid | C-optimizable codon | C-optimized codon |
|---|---|---|
| Ala | GCG | GCC |
| Ala | GCA | GCC |
| Ala | GCU | GCC |
| Cys | UGU | UGC |
| Asp | GAU | GAC |
| Phe | UUU | UUC |
| Gly | GGG | GGC |
| Gly | GGA | GGC |
| Gly | GGU | GGC |
| His | CAU | CAC |
| Ile | AUA | AUC |
| Ile | AUU | AUC |

TABLE 3-continued

Human codons with optimizable versus optimized C-content

| Amino acid | C-optimizable codon | C-optimized codon |
|---|---|---|
| Leu | UUG | CUC |
| Leu | UUA | CUC |
| Leu | CUG | CUC |
| Leu | CUA | CUC |
| Leu | CUU | CUC |
| Asn | AAU | AAC |
| Pro | CCG | CCC |
| Pro | CCA | CCC |
| Pro | CCU | CCC |
| Arg | AGG | CGC |
| Arg | AGA | CGC |
| Arg | CGG | CGC |
| Arg | CGA | CGC |
| Arg | CGU | CGC |
| Ser | AGU | UCC |
| Ser | AGC | UCC |
| Ser | UCG | UCC |
| Ser | UCA | UCC |
| Ser | UCU | UCC |
| Thr | ACG | ACC |
| Thr | ACA | ACC |
| Thr | ACU | ACC |
| Val | GUG | GUC |
| Val | GUA | GUC |
| Val | GUU | GUC |
| Tyr | UAU | UAC |

In any of the above instances, the number of cytosines is increased by 1 per exchanged codon. Exchange of all non C-optimized codons (corresponding to C-optimizable codons) of the coding region results in a C-maximized coding sequence. In the context of the invention, at least 70%, preferably at least 80%, more preferably at least 90%, of the non C-optimized codons within the at least one coding region of the RNA according to the invention are replaced by C-optmized codons.

It may be preferred that for some amino acids the percentage of C-optimizable codons replaced by C-optimized codons is less than 70%, while for other amino acids the percentage of replaced codons is higher than 70% to meet the overall percentage of C-optimization of at least 70% of all C-optimizable wild type codons of the coding region.

Preferably, in a C-optimized RNA of the invention, at least 50% of the C-optimizable wild type codons for any given amino acid are replaced by C-optimized codons, e.g. any modified C-enriched RNA preferably contains at least 50% C-optimized codons at C-optimizable wild type codon positions encoding any one of the above mentioned amino acids Ala, Cys, Asp, Phe, Gly, His, Ile, Leu, Asn, Pro, Arg, Ser, Thr, Val and Tyr, preferably at least 60%.

In this context codons encoding amino acids, which are not cytosine content-optimizable and which are, however, encoded by at least two codons, may be used without any further selection process. However, the codon of the wild type sequence that codes for a relatively rare tRNA in the cell, e.g. a human cell, may be exchanged for a codon that codes for a relatively frequent tRNA in the cell, wherein both code for the same amino acid. Accordingly, the relatively rare codon GAA coding for Glu may be exchanged by the relative frequent codon GAG coding for the same amino acid, and/or the relatively rare codon MA coding for Lys may be exchanged by the relative frequent codon MG coding for the same amino acid, and/or the relatively rare codon CM coding for Gln may be exchanged for the relative frequent codon CAG encoding the same amino acid.

In this context, the amino acids Met (AUG) and Trp (UGG), which are encoded by only one codon each, remain unchanged. Stop codons are not cytosine-content optimized, however, the relatively rare stop codons amber, ochre (UAA, UAG) may be exchanged by the relatively frequent stop codon opal (UGA).

The single substitutions listed above may be used individually as well as in all possible combinations in order to optimize the cytosine-content of the modified RNA compared to the wild type mRNA sequence.

Accordingly, the at least one coding sequence as defined herein may be changed compared to the coding region of the respective wild type RNA in such a way that an amino acid encoded by at least two or more codons, of which one comprises one additional cytosine, such a codon may be exchanged by the C-optimized codon comprising one additional cytosine, wherein the amino acid is preferably unaltered compared to the wild type sequence.

In a preferred embodiment, the present invention provides an RNA comprising at least one coding sequence, wherein the coding sequence comprises a nucleic acid sequence selected from the group consisting of SEQ ID NO: 313; 314; 315; 316; 317; 318; 319; 320; 321; 322; 323; 324; 325; 326; 327; 328; 329; 330; 331; 332; 333; 334; 335; 336; 337; 338; 339; 340; 341; 342; 343; 344; 345; 346; 347; 348; 349; 350; 351; 352; 353; 354; 355; 356; 357; 358; 359; 360; 361; 362; 363; 364; 365; 366; 367; 368; 369; 370; 371; 372; 373; 374; 375; 376; 377; 378; 379; 380; 381; 382; 383; 384; 385; 386; 387; 388; 389; 390; 391; 392; 393; 394; 395; 396; 397; 398; 399; 400; 401; 402; 403; 404; 5208; 5209; 5210; 5211 or a fragment or variant of any one of said nucleic acid sequences.

In a further preferred embodiment, the at least one coding sequence of the RNA of the present invention encodes a peptide or protein comprising or consisting of a collagenase as defined herein, preferably MMP-1, ColH or ColG. According to a particularly preferred embodiment, the at least one coding sequence of the RNA of the present invention may thus comprise at least one coding sequence encoding a MMP1 polypeptide, said coding region comprising or consisting of an RNA sequence according to SEQ ID NO: 314 or 315 or a fragment or variant of any one of these nucleic acid sequences. According to a particularly preferred embodiment, the at least one coding sequence of the RNA of the present invention may thus comprise at least one coding sequence encoding a ColG polypeptide, said coding region comprising or consisting of an RNA sequence according to SEQ ID NO: 316; 317; 318; 5208; 5209 or a fragment or variant of any one of these nucleic acid sequences. According to a particularly preferred embodiment, the at least one coding sequence of the RNA of the present invention may thus comprise at least one coding sequence encoding a ColH polypeptide, said coding region comprising or consisting of an RNA sequence according to SEQ ID NO: 319; 320; 321; 322; 5210; 5211 or a fragment or variant of any one of these nucleic acid sequences.

According to a further embodiment, the at least one coding sequence of the RNA according to the invention comprises or consists of a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with a nucleic acid sequence selected from the group consisting of SEQ ID NO: 313; 314; 315; 316; 317; 318; 319; 320; 321; 322; 323; 324; 325; 326; 327; 328; 329; 330; 331; 332; 333; 334; 335; 336; 337; 338; 339; 340; 341; 342; 343; 344; 345; 346; 347; 348; 349; 350; 351; 352; 353; 354; 355; 356; 357; 358; 359; 360; 361; 362; 363; 364; 365; 366; 367; 368; 369; 370; 371; 372; 373; 374; 375; 376; 377; 378; 379; 380; 381; 382; 383; 384; 385; 386; 387; 388; 389; 390; 391; 392; 393; 394; 395; 396; 397; 398; 399; 400; 401; 402; 403; 404; 5208; 5209; 5210; 5211 or a fragment or variant of any one of said nucleic acid sequences.

According to a particularly preferred embodiment, the invention provides an RNA, preferably an mRNA, comprising at least one coding sequence as defined herein,
a) wherein the G/C content of the at least one coding sequence of the RNA is increased compared to the G/C content of the corresponding coding sequence of the corresponding wild type RNA, and/or
b) wherein the C content of the at least one coding sequence of the RNA is increased compared to the C content of the corresponding coding sequence of the corresponding wild type RNA, and/or
c) wherein the codons in the at least one coding sequence of the RNA are adapted to human codon usage, wherein the codon adaptation index (CAI) is preferably increased or maximised in the at least one coding sequence of the RNA,
d) and wherein the amino acid sequence encoded by the RNA is preferably not being modified compared to the amino acid sequence encoded by the corresponding wild type RNA.

In a further preferred embodiment, the at least one coding sequence of the RNA according to the invention comprises or consists of a nucleic acid sequence identical to or having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the (modified) nucleic acid sequences defined in the fifth column (column "C") of Table 1, or of a fragment or variant of any one of these sequences.

According to a particularly preferred embodiment, the at least one coding sequence of the RNA according to the invention comprises or consists of a nucleic acid sequence having a sequence identity of at least 80% with any one of the (modified) nucleic acid sequences defined in the fifth column (column "C") of Table 1, or of a fragment or variant of any one of these sequences.

According to a preferred embodiment, the present invention provides an RNA as defined herein comprising at least one coding sequence, wherein the coding sequence comprises or consists of any one of the (modified) nucleic acid sequences defined in the fifth column (column "C") of Table 1, or of a fragment or variant of any one of these sequences. In other words, the at least one coding sequence preferably comprises or consists of a nucleic acid sequence selected from the group consisting of SEQ ID NO: 216; 217; 218; 219; 220; 221; 222; 223; 224; 225; 226; 227; 228; 229; 230; 231; 232; 233; 234; 235; 236; 237; 238; 239; 240; 241; 242; 243; 244; 245; 246; 247; 248; 249; 250; 251; 252; 253; 254; 255; 256; 257; 258; 259; 260; 261; 262; 263; 264; 265; 266; 267; 268; 269; 270; 271; 272; 273; 274; 275; 276; 277; 278; 279; 280; 281; 282; 283; 284; 285; 286; 287; 288; 289; 290; 291; 292; 293; 294; 295; 296; 297; 298; 299; 300; 301; 302; 303; 304; 305; 306; 307; 313; 314; 315; 316; 317; 318; 319; 320; 321; 322; 323; 324; 325; 326; 327; 328; 329; 330; 331; 332; 333; 334; 335; 336; 337; 338; 339; 340; 341; 342; 343; 344; 345; 346; 347; 348; 349; 350; 351; 352; 353; 354; 355; 356; 357; 358; 359; 360; 361; 362; 363; 364; 365; 366; 367; 368; 369; 370; 371; 372; 373; 374; 375; 376; 377; 378; 379; 380; 381; 382; 383; 384; 385; 386; 387; 388; 389; 390; 391; 392; 393; 394; 395; 396; 397; 398; 399; 400; 401; 402; 403; 404; 405, 406, 407, 408, 409; 410; 411; 412, 413; 414; 415; 416; 417; 418; 419; 420; 421; 422; 423; 424; 425; 426; 427; 428; 429; 430; 431; 432; 433; 434; 435; 436; 437; 438; 439; 440; 441; 442; 443; 444; 445; 446; 447; 448; 449; 450; 451; 452; 453; 454; 455; 456; 457; 458; 459; 460; 461; 462; 463; 464; 465; 466; 467; 468; 469; 470; 471; 472; 473; 474; 475; 476; 477; 478; 479; 480; 481; 482; 483; 484; 485; 486; 487; 488; 489; 490; 491; 492; 493; 494; 495; 496; 497; 498; 499; 500; 501; 507; 508; 509; 510; 511; 512; 513; 514; 515; 516; 517; 518; 519; 522; 521; 522; 523; 524; 525; 526; 527; 528; 529; 530; 531; 532; 533; 534; 535; 536; 537; 538; 539; 540; 541; 542; 543; 544; 545; 546; 547; 548; 549; 550; 551; 552; 553; 554; 555; 556; 557; 558; 559; 560; 561; 562; 563; 564; 565; 566; 567; 568; 569; 570; 571; 572; 573; 574; 575; 576; 577; 578; 579; 580; 581; 582; 583; 584; 585; 586; 587; 588; 589; 590; 591; 592; 593; 594; 595; 596; 597; 598; 604; 605; 606, 607; 608; 609; 610; 611; 612; 613; 614; 615; 616; 617M 618; 619; 620; 621; 622; 623; 624; 625; 626; 627; 628; 629; 630; 631; 632; 633; 634; 635; 636; 637; 638; 639; 640; 641; 642; 643; 644; 645; 646; 647; 648; 649; 650; 651; 652; 653; 654; 655; 656; 657; 658; 659; 660; 661; 662; 663; 664; 665; 666; 667; 668; 669; 670; 671; 672; 673; 674; 675; 676; 677; 678; 679; 680; 681; 682; 683; 684; 685; 686; 687; 688; 689; 690; 691; 692; 693; 694; 695; 701; 702; 703; 704; 705; 706; 707; 708; 709; 710; 711; 712; 713; 714; 715; 716; 717; 718; 719; 720; 721; 722; 723; 724; 725; 726; 727; 728; 729; 730; 731; 732; 733; 734; 735; 736; 737; 738; 739; 740; 741; 742; 743; 744; 745; 746; 747; 748; 749; 750; 751; 752; 753; 754; 755; 756; 757; 758; 759; 760; 761; 762; 763; 764; 765; 766; 767; 768; 769; 770; 771; 772; 773; 774; 775; 776; 777; 778; 779; 780; 781; 782; 783; 784; 785; 786; 787; 788; 789; 790; 791; 792; 798; 799; 800; 801; 802; 803; 804; 805; 806; 807; 808; 809; 810; 811; 812; 813; 814; 815; 816; 817; 818; 819; 820; 821; 822; 823; 824; 825; 826; 827; 828; 829; 830; 831; 832; 833; 834; 835; 836; 837; 838; 839; 840; 841; 842; 843; 844; 845; 846; 847; 848; 849; 850; 851; 852; 853; 854; 855; 856; 857; 858; 859; 860; 861; 862; 863; 864; 865; 866; 867; 868; 869; 870; 871; 872; 873; 874; 875; 876; 877; 878; 879; 880; 881; 882; 883; 884; 885; 886; 887; 888; 889; 895; 896; 897; 898; 899; 900; 901; 902; 903; 904; 905; 906;

907; 908; 909; 910; 911; 912; 913; 914; 915; 916; 917; 918; 919; 920; 921; 922; 923; 924; 925; 926; 927; 928; 929; 930; 931; 932; 933; 934; 935; 936; 937; 938; 939; 940; 941; 942; 943; 944; 945; 946; 947; 948; 949; 950; 951; 952; 953; 954; 955; 956; 957; 958; 959; 960; 961; 962; 963; 964; 965; 966; 967; 968; 969; 970; 971; 972; 973; 974; 975; 976; 977; 978; 979; 980; 981; 982; 983; 984; 985; 986; 992; 993; 994; 995; 996; 997; 998; 999; 1000; 1001; 1002; 1003; 1004; 1005; 1006; 1007; 1008; 1009; 1010; 1011; 1012; 1013; 1014; 1015; 1016; 1017; 1018; 1019; 1020; 1021; 1022; 1023; 1024; 1025; 1026; 1027; 1028; 1029; 1030; 1031; 1032; 1033; 1034; 1035; 1036; 1037; 1038; 1039; 1040; 1041; 1042; 1043; 1044; 1045; 1046; 1047; 1048; 1049; 1050; 1051; 1052; 1053; 1054; 1055; 1056; 1057; 1058; 1059; 1060; 1061; 1062; 1063; 1064; 1065; 1066; 1067; 1068; 1069; 1070; 1071; 1072; 1073; 1074; 1075; 1076; 1077; 1078; 1079; 1080; 1081; 1082; 1083; 1089; 1090; 1091, 1092; 1093; 1094; 1095; 1096; 1097; 1098; 1099; 1100; 1101; 1102; 1103; 1104; 1105; 1106; 1107; 1108; 1109; 1110; 1111; 1112; 1113; 1114; 1115; 1116; 1117; 1118; 1119; 1120; 1121; 1122; 1123; 1124; 1125; 1126; 1127; 1128; 1129; 1130; 1131; 1132; 1133; 1134; 1135; 1136; 1137; 1138; 1139; 1140; 1141; 1142; 1143; 1144; 1145; 1146; 1147; 1148; 1149; 1150; 1151; 1152; 1153; 1154; 1155; 1156; 1157; 1158; 1159; 1160; 1161; 1162; 1163; 1164; 1165; 1166; 1167; 1168; 1169; 1170; 1171; 1172; 1173; 1174; 1175; 1176; 1177; 1178; 1179; 1180; 1186; 1187; 1188; 1189; 1190; 1191; 1192; 1193; 1194; 1195; 1196; 1197; 1198; 1199; 1200; 1201; 1202; 1203; 1204; 1205; 1206; 1207; 1208; 1209; 1210; 1211; 1212; 1213; 1214; 1215; 1216; 1217; 1218; 1219; 1220; 1221; 1222; 1223; 1224; 1225; 1226; 1227; 1228; 1229; 1230; 1231; 1232; 1233; 1234; 1235; 1236; 1237; 1238; 1239; 1240; 1241; 1242; 1243; 1244; 1245; 1246; 1247; 1248; 1249; 1250; 1251; 1252; 1253; 1254; 1255; 1256; 1257; 1258; 1259; 1260; 1261; 1262; 1263; 1264; 1265; 1266; 1267; 1268; 1269; 1270; 1271; 1272; 1273; 1274; 1275; 1276; 1277; 1283; 1284; 1285; 1286; 1287; 1288; 1289; 1290; 1291; 1292; 1293; 1294; 1295; 1296; 1297; 1298; 1299; 1300; 1301; 1302; 1303; 1304; 1305; 1306; 1307; 1308; 1309; 1310; 1311; 1312; 1313; 1314; 1315; 1316; 1317; 1318; 1319; 1320; 1321; 1322; 1323; 1324; 1325; 1326; 1327; 1328; 1329; 1330; 1331; 1332; 1333; 1334; 1335; 1336; 1337; 1338; 1339; 1340; 1341; 1342; 1343; 1344; 1345; 1346; 1347; 1348; 1349; 1350; 1351; 1352; 1353; 1354; 1355; 1356; 1357; 1358; 1359; 1360; 1361; 1362; 1363; 1364; 1365; 1366; 1367; 1368; 1369; 1370; 1371; 1372; 1373; 1374; 5204; 5205; 5206; 5207; 5208; 5209; 5210; 5211; 5212; 5213; 5214; 5215; 5216; 5217; 5218; 5219; 5220; 5221; 5222; 5223; 5224; 5225; 5226; 5227; 5228; 5229; 5230; 5231; 5232; 5233; 5234; 5235; 5236; 5237; 5238; 5239; 5240; 5241; 5242; 5243; 5244; 5245; 5246; 5247; 5248; 5249; 5250 or 5251 or a fragment or variant of any one of these nucleic acid sequences.

5'-cap

According to another preferred embodiment of the invention, a modified RNA as defined herein, can be modified by the addition of a so-called "5'-cap" structure, which preferably stabilizes the RNA as described herein. A 5'-cap is an entity, typically a modified nucleotide entity, which generally "caps" the 5'-end of a mature mRNA. A 5'-cap may typically be formed by a modified nucleotide, particularly by a derivative of a guanine nucleotide. Preferably, the 5'-cap is linked to the 5'-terminus via a 5'-5'-triphosphate linkage. A 5'-cap may be methylated, e.g. m7GpppN, wherein N is the terminal 5' nucleotide of the nucleic acid carrying the 5'-cap, typically the 5'-end of an mRNA. m7GpppN is the 5'-cap structure, which naturally occurs in mRNA transcribed by polymerase II and is therefore preferably not considered as modification comprised in a modified mRNA in this context. Accordingly, a modified RNA of the present invention may comprise a m7GpppN as 5'-cap, but additionally the modified RNA typically comprises at least one further modification as defined herein.

Further examples of 5'-cap structures include glyceryl, inverted deoxy abasic residue (moiety), 4',5' methylene nucleotide, 1-(beta-D-erythrofuranosyl) nucleotide, 4'-thio nucleotide, carbocyclic nucleotide, 1,5-anhydrohexitol nucleotide, L-nucleotides, alpha-nucleotide, modified base nucleotide, threo-pentofuranosyl nucleotide, acyclic 3',4'-seco nucleotide, acyclic 3,4-dihydroxybutyl nucleotide, acyclic 3,5 dihydroxypentyl nucleotide, 3'-3'-inverted nucleotide moiety, 3'-3'-inverted abasic moiety, 3'-2'-inverted nucleotide moiety, 3'-2'-inverted abasic moiety, 1,4-butanediol phosphate, 3'-phosphoramidate, hexylphosphate, aminohexyl phosphate, 3'-phosphate, 3'phosphorothioate, phosphorodithioate, or bridging or non-bridging methylphosphonate moiety. These modified 5'-cap structures are regarded as at least one modification in this context.

Particularly preferred modified 5'-cap structures are cap1 (methylation of the ribose of the adjacent nucleotide of m7G), cap2 (additional methylation of the ribose of the 2nd nucleotide downstream of the m7G), cap3 (additional methylation of the ribose of the 3rd nucleotide downstream of the m7G), cap4 (methylation of the ribose of the 4th nucleotide downstream of the m7G), ARCA (anti-reverse cap analogue, modified ARCA (e.g. phosphothioate modified ARCA), inosine, N1-methyl-guanosine, 2'-fluoro-guanosine, 7-deaza-guanosine, 8-oxo-guanosine, 2-amino-guanosine, LNA-guanosine, and 2-azido-guanosine. Accordingly, the RNA according to the invention preferably comprises a 5'-cap structure.

In a preferred embodiment, the RNA according to the invention comprises at least one 5'- or 3'-UTR element. In this context, an UTR element comprises or consists of a nucleic acid sequence, which is derived from the 5'- or 3'-UTR of any naturally occurring gene or which is derived from a fragment, a homolog or a variant of the 5'- or 3'-UTR of a gene. Preferably, the 5'- or 3'-UTR element used according to the present invention is heterologous to the at least one coding sequence of the RNA of the invention. Even if 5'- or 3'-UTR elements derived from naturally occurring genes are preferred, also synthetically engineered UTR elements may be used in the context of the present invention.

The term "3'-UTR element" typically refers to a nucleic acid sequence, which comprises or consists of a nucleic acid sequence that is derived from a 3'-UTR or from a variant of a 3'-UTR. A 3'-UTR element in the sense of the present invention may represent the 3'-UTR of an RNA, preferably an mRNA. Thus, in the sense of the present invention, preferably, a 3'-UTR element may be the 3'-UTR of an RNA, preferably of an mRNA, or it may be the transcription template for a 3'-UTR of an RNA. Thus, a 3'-UTR element preferably is a nucleic acid sequence which corresponds to the 3'-UTR of an RNA, preferably to the 3'-UTR of an mRNA, such as an mRNA obtained by transcription of a genetically engineered vector construct. Preferably, the 3'-UTR element fulfils the function of a 3'-UTR or encodes a sequence which fulfils the function of a 3'-UTR.

According to a preferred embodiment, the RNA, preferably an mRNA, according to the invention comprises a 5'-cap structure and/or at least one 3'-untranslated region element (3'-UTR element), preferably as defined herein. More preferably, the RNA further comprises a 5'-UTR element as defined herein.

Poly-A Tail

According to a further preferred embodiment, the RNA of the present invention may contain a poly-A tail on the 3'-terminus of typically about 10 to 200 adenosine nucleotides, preferably about 10 to 100 adenosine nucleotides, more preferably about 40 to 80 adenosine nucleotides or even more preferably about 50 to 70 adenosine nucleotides. Preferably, the poly(A) sequence (or poly(A) tail) in the RNA of the present invention is derived from a DNA template by RNA in vitro transcription. Alternatively, the poly(A) sequence may also be obtained in vitro by common methods of chemical-synthesis without being necessarily transcribed from a DNA-progenitor. Moreover, poly(A) sequences, or poly(A) tails may be generated by enzymatic polyadenylation of the RNA according to the present invention using commercially available polyadenylation kits and corresponding protocols known in the art.

Alternatively, the RNA as described herein optionally comprises a polyadenylation signal, which is defined herein as a signal, which conveys polyadenylation to a (transcribed) RNA by specific protein factors (e.g. cleavage and polyadenylation specificity factor (CPSF), cleavage stimulation factor (CstF), cleavage factors I and II (CF I and CF II), poly(A) polymerase (PAP)). In this context, a consensus polyadenylation signal is preferred comprising the NN(U/T)ANA consensus sequence. In a particularly preferred aspect, the polyadenylation signal comprises one of the following sequences: AA(U/T)AAA or A(U/T)(U/T)AAA (wherein uridine is usually present in RNA and thymidine is usually present in DNA).

Poly(C) Tail

According to a further preferred embodiment, the RNA of the present invention may contain a poly(C) tail on the 3'-terminus of typically about 10 to 200 cytosine nucleotides, preferably about 10 to 100 cytosine nucleotides, more preferably about 20 to 70 cytosine nucleotides or even more preferably about 20 to 60 or even 10 to 40 cytosine nucleotides.

3'-UTR

In a further preferred embodiment, the RNA according to the invention further comprises at least one 3'-UTR element. Preferably, the at least one 3'-UTR element comprises or consists of a nucleic acid sequence derived from the 3'-UTR of a chordate gene, preferably a vertebrate gene, more preferably a mammalian gene, most preferably a human gene, or from a variant of the 3'-UTR of a chordate gene, preferably a vertebrate gene, more preferably a mammalian gene, most preferably a human gene.

Preferably, the RNA of the present invention comprises a 3'-UTR element, which may be derivable from a gene that relates to an mRNA with an enhanced half-life (that provides a stable mRNA), for example a 3'-UTR element as defined and described below. Preferably, the 3'-UTR element is a nucleic acid sequence derived from a 3'-UTR of a gene, which preferably encodes a stable mRNA, or from a homolog, a fragment or a variant of said gene In a particularly preferred embodiment, the 3'-UTR element comprises or consists of a nucleic acid sequence, which is derived from a 3'-UTR of a gene selected from the group consisting of an albumin gene, an α-globin gene, a β-globin gene, a tyrosine hydroxylase gene, a lipoxygenase gene, and a collagen alpha gene, such as a collagen alpha 1(I) gene, or from a variant of a 3'-UTR of a gene selected from the group consisting of an albumin gene, an α-globin gene, a β-globin gene, a tyrosine hydroxylase gene, a lipoxygenase gene, and a collagen alpha gene, such as a collagen alpha 1(I) gene according to SEQ ID NO: 1369-1390 of the patent application WO2013/143700, whose disclosure is incorporated herein by reference, or from a homolog, a fragment or a variant thereof. In a particularly preferred embodiment, the 3'-UTR element comprises or consists of a nucleic acid sequence which is derived from a 3'-UTR of an albumin gene, preferably a vertebrate albumin gene, more preferably a mammalian albumin gene, most preferably a human albumin gene according to SEQ ID NO: 5028 or the corresponding RNA sequence SEQ ID NO: 5029.

```
Human albumin 3'-UTR
CATCACATTTAAAAGCATCTCAGCCTACCATGAGAATAAGAGAAAGAAAA

TGAAGATCAAAAGCTTATTCATCTGTTTTTCTTTTTCGTTGGTGTAAAGC

CAACACCCTGTCTAAAAAACATAAATTTCTTTAATCATTTTGCCTCTTTT

CTCTGTGCTTCAATTAATAAAAAATGGAAAGAATCT (SEQ ID NO: 5028, corresponding to SEQ ID NO:

1369 of the patent application WO2013/143700).
```

In this context it is particularly preferred that the RNA according to the invention comprises a 3'-UTR element comprising a corresponding RNA sequence derived from the nucleic acids according to SEQ ID NO: 1369-1390 of the patent application WO2013/143700 or a fragment, homolog or variant thereof.

Most preferably the 3'-UTR element comprises the nucleic acid sequence derived from a fragment of the human albumin gene according to SEQ ID NO: 5030 or 5032:

```
albumin7 3'-UTR:
CATCACATTTAAAAGCATCTCAGCCTACCATGAGAATAAGAGAAAGAAAA

TGAAGATCAATAGCTTATTCATCTCTTTTTCTTTTTCGTTGGTGTAAAGC

CAACACCCTGTCTAAAAAACATAAATTTCTTTAATCATTTTGCCTCTTTT

CTCTGTGCTTCAATTAATAAAAAATGGAAAGAACCT (SEQ ID NO: 5030 corresponding to SEQ ID NO:

1376 of the patent application WO2013/143700)
```

In this context, it is particularly preferred that the 3'-UTR element of the RNA according to the present invention comprises or consists of a corresponding RNA sequence of the nucleic acid sequence according to SEQ ID NO: 5030 or 5032 as shown in SEQ ID NO: 5031 or 5033.

In another particularly preferred embodiment, the 3'-UTR element comprises or consists of a nucleic acid sequence which is derived from a 3'-UTR of an α-globin gene, preferably a vertebrate α- or β-globin gene, more preferably a mammalian α- or β-globin gene, most preferably a human α- or β-globin gene according to SEQ ID NO: 5020; 5022; 5024 or 5026 or the corresponding RNA sequence SEQ ID NO: 5021; 5023; 5025 or 5027:

3'-UTR of Homo sapiens hemoglobin, alpha 1 (HBA1)

GCTGGAGCCTCGGTGGCCATGCTTCTTGCCCCTTGGGCCTCCCCCCAGCC

CCTCCTCCCCTTCCTGCACCCGTACCCCCGTGGTCTTTGAATAAAGTCTG

AGTGGGCGGC (SEQ ID NO: 5020 corresponding to SEQ ID NO: 1370 of the patent application WO2013/143700)

3'-UTR of Homo sapiens hemoglobin, alpha 2 (HBA2)

GCTGGAGCCTCGGTAGCCGTTCCTCCTGCCCGCTGGGCCTCCCAACGGGC

CCTCCTCCCCTCCTTGCACCGGCCCTTCCTGGTCTTTGAATAAAGTCTGA

GTGGGCAG (SEQ ID NO: 5022 corresponding to SEQ ID NO: 1371 of the patent application WO2013/143700)

3'-UTR of Homo sapiens hemoglobin, beta (HBB)

GCTCGCTTTCTTGCTGTCCAATTTCTATTAAAGGTTCCTTTGTTCCCTAA

GTCCAACTACTAAACTGGGGGATATTATGAAGGGCCTTGAGCATCTGGAT

TCTGCCTAATAAAAAACATTTATTTTCATTGC (SEQ ID NO: 5024 corresponding to SEQ ID NO: 1372 of the patent application WO2013/143700)

For example, the 3'-UTR element may comprise or consist of the center, α-complex-binding portion of the 3'-UTR of an α-globin gene, such as of a human α-globin gene, or a homolog, a fragment, or a variant of an α-globin gene, preferably according to SEQ ID NO: 5026:

Center, α-complex-binding portion of the 3'-UTR of an α-globin gene (also named herein as "muag")

GCCCGATGGGCCTCCCAACGGGCCCTCCTCCCCTCCTTGCACCG (SEQ ID NO: 5026 corresponding to SEQ ID NO: 1393 of the patent application WO2013/143700).

In this context it is particularly preferred that the 3'-UTR element of the RNA according to the invention comprises or consists of a corresponding RNA sequence of the nucleic acid sequence according to SEQ ID NO: 5026 as shown in SEQ ID NO: 5027, or a homolog, a fragment or variant thereof.

The term "a nucleic acid sequence which is derived from the 3'-UTR of a [ . . . ] gene" preferably refers to a nucleic acid sequence which is based on the 3'-UTR sequence of a [ . . . ] gene or on a part thereof, such as on the 3'-UTR of an albumin gene, an α-globin gene, a β-globin gene, a tyrosine hydroxylase gene, a lipoxygenase gene, or a collagen alpha gene, such as a collagen alpha 1(I) gene, preferably of an albumin gene or on a part thereof. This term includes sequences corresponding to the entire 3'-UTR sequence, i.e. the full length 3'-UTR sequence of a gene, and sequences corresponding to a fragment of the 3'-UTR sequence of a gene, such as an albumin gene, α-globin gene, β-globin gene, tyrosine hydroxylase gene, lipoxygenase gene, or collagen alpha gene, such as a collagen alpha 1(I) gene, preferably of an albumin gene.

The term "a nucleic acid sequence which is derived from a variant of the 3'-UTR of a [ . . . ] gene" preferably refers to a nucleic acid sequence, which is based on a variant of the 3'-UTR sequence of a gene, such as on a variant of the 3'-UTR of an albumin gene, an α-globin gene, a β-globin gene, a tyrosine hydroxylase gene, a lipoxygenase gene, or a collagen alpha gene, such as a collagen alpha 1(I) gene, or on a part thereof as described above. This term includes sequences corresponding to the entire sequence of the variant of the 3'-UTR of a gene, i.e. the full length variant 3'-UTR sequence of a gene, and sequences corresponding to a fragment of the variant 3'-UTR sequence of a gene. A fragment in this context preferably consists of a continuous stretch of nucleotides corresponding to a continuous stretch of nucleotides in the full-length variant 3'-UTR, which represents at least 20%, preferably at least 30%, more preferably at least 40%, more preferably at least 50%, even more preferably at least 60%, even more preferably at least 70%, even more preferably at least 80%, and most preferably at least 90% of the full-length variant 3'-UTR. Such a fragment of a variant, in the sense of the present invention, is preferably a functional fragment of a variant as described herein.

5'-UTR

In a particularly preferred embodiment, the at least one mRNA of the inventive composition comprises at least one 5'-untranslated region element (5'-UTR element). Preferably, the at least one 5'-UTR element comprises or consists of a nucleic acid sequence, which is derived from the 5'-UTR of a TOP gene or which is derived from a fragment, homolog or variant of the 5'-UTR of a TOP gene.

It is particularly preferred that the 5'-UTR element does not comprise a TOP-motif or a 5'TOP, as defined above.

In some embodiments, the nucleic acid sequence of the 5'-UTR element, which is derived from a 5'-UTR of a TOP gene, terminates at its 3'-end with a nucleotide located at position 1, 2, 3, 4, 5, 6, 7, 8, 9 or 10 upstream of the start codon (e.g. A(U/T)G) of the gene or mRNA it is derived from. Thus, the 5'-UTR element does not comprise any part of the protein coding region. Thus, preferably, the only protein coding part of the at least one mRNA of the inventive composition is provided by the coding region.

The nucleic acid sequence derived from the 5'-UTR of a TOP gene is preferably derived from a eukaryotic TOP gene, preferably a plant or animal TOP gene, more preferably a chordate TOP gene, even more preferably a vertebrate TOP gene, most preferably a mammalian TOP gene, such as a human TOP gene.

For example, the 5'-UTR element is preferably selected from 5'-UTR elements comprising or consisting of a nucleic acid sequence, which is derived from a nucleic acid sequence selected from the group consisting of SEQ ID NOs: 1-1363, SEQ ID NO: 1395, SEQ ID NO: 1421 and SEQ ID NO: 1422 of the patent application WO2013/143700, whose disclosure is incorporated herein by reference, from the homologs of SEQ ID NOs: 1-1363, SEQ ID NO: 1395, SEQ ID NO: 1421 and SEQ ID NO: 1422 of the patent application WO2013/143700, from a variant thereof, or preferably from a corresponding RNA sequence. The term "homologs of SEQ ID NOs: 1-1363, SEQ ID NO: 1395, SEQ ID NO: 1421 and SEQ ID NO: 1422 of the patent application WO2013/143700" refers to sequences of other species than Homo sapiens, which are homologous to the sequences according to SEQ ID NOs: 1-1363, SEQ ID NO: 1395, SEQ ID NO: 1421 and SEQ ID NO: 1422 of the patent application WO2013/143700.

In a preferred embodiment, the 5'-UTR element of the RNA according to the invention comprises or consists of a nucleic acid sequence, which is derived from a nucleic acid sequence extending from nucleotide position 5 (i.e. the nucleotide that is located at position 5 in the sequence) to the nucleotide position immediately 5' to the start codon (located at the 3'-end of the sequences), e.g. the nucleotide position immediately 5' to the ATG sequence, of a nucleic acid sequence selected from SEQ ID NOs: 1-1363, SEQ ID NO: 1395, SEQ ID NO: 1421 and SEQ ID NO: 1422 of the patent application WO2013/143700, from the homologs of SEQ ID NOs: 1-1363, SEQ ID NO: 1395, SEQ ID NO: 1421 and SEQ ID NO: 1422 of the patent application WO2013/143700 from a variant thereof, or a corresponding RNA sequence. It is particularly preferred that the 5'-UTR element is derived from a nucleic acid sequence extending from the nucleotide position immediately 3' to the 5'TOP to the nucleotide position immediately 5' to the start codon (located at the 3'-end of the sequences), e.g. the nucleotide position immediately 5' to the ATG sequence, of a nucleic acid sequence selected from SEQ ID NOs: 1-1363, SEQ ID NO: 1395, SEQ ID NO: 1421 and SEQ ID NO: 1422 of the patent application WO2013/143700, from the homologs of SEQ ID NOs: 1-1363, SEQ ID NO: 1395, SEQ ID NO: 1421 and SEQ ID NO: 1422 of the patent application WO2013/143700, from a variant thereof, or a corresponding RNA sequence.

In a particularly preferred embodiment, the 5'-UTR element comprises or consists of a nucleic acid sequence, which is derived from a 5'-UTR of a TOP gene encoding a ribosomal protein or from a variant of a 5'-UTR of a TOP gene encoding a ribosomal protein. For example, the 5'-UTR element comprises or consists of a nucleic acid sequence, which is derived from a 5'-UTR of a nucleic acid sequence according to any of SEQ ID NOs: 67, 170, 193, 244, 259, 554, 650, 675, 700, 721, 913, 1016, 1063, 1120, 1138, and 1284-1360 of the patent application WO2013/143700, a corresponding RNA sequence, a homolog thereof, or a variant thereof as described herein, preferably lacking the 5'TOP motif. As described above, the sequence extending from position 5 to the nucleotide immediately 5' to the ATG (which is located at the 3'-end of the sequences) corresponds to the 5'-UTR of said sequences.

L32 Derived 5'-UTR:

Preferably, the 5'-UTR element comprises or consists of a nucleic acid sequence, which is derived from a 5'-UTR of a TOP gene encoding a ribosomal Large protein (RPL) or from a homolog or variant of a 5'-UTR of a TOP gene encoding a ribosomal Large protein (RPL). For example, the 5'-UTR element comprises or consists of a nucleic acid sequence, which is derived from a 5'-UTR of a nucleic acid sequence according to any of SEQ ID NOs: 67, 259, 1284-1318, 1344, 1346, 1348-1354, 1357, 1358, 1421 and 1422 of the patent application WO2013/143700, a corresponding RNA sequence, a homolog thereof, or a variant thereof as described herein, preferably lacking the 5'TOP motif.

In a particularly preferred embodiment, the 5'-UTR element comprises or consists of a nucleic acid sequence which is derived from the 5'-UTR of a ribosomal protein Large 32 gene, preferably from a vertebrate ribosomal protein Large 32 (L32) gene, more preferably from a mammalian ribosomal protein Large 32 (L32) gene, most preferably from a human ribosomal protein Large 32 (L32) gene, or from a variant of the 5'-UTR of a ribosomal protein Large 32 gene, preferably from a vertebrate ribosomal protein Large 32 (L32) gene, more preferably from a mammalian ribosomal protein Large 32 (L32) gene, most preferably from a human ribosomal protein Large 32 (L32) gene, wherein preferably the 5'-UTR element does not comprise the 5'TOP of said gene.

Accordingly, in a particularly preferred embodiment, the 5'-UTR element comprises or consists of a nucleic acid sequence, which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO: 5014 or 5015 (5'-UTR of human ribosomal protein Large 32 lacking the 5'-terminal oligopyrimidine tract: GGCGCTGCCTACGGAGGTGGCAGC-CATCTCCTTCTCGGCATC; corresponding to SEQ ID NO: 1368 of the patent application WO2013/143700) or preferably to a corresponding RNA sequence, or wherein the at least one 5'-UTR element comprises or consists of a fragment of a nucleic acid sequence which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO: 5014 or more preferably to a corresponding RNA sequence (SEQ ID NO: 5015), wherein, preferably, the fragment is as described above, i.e. being a continuous stretch of nucleotides representing at least 20% etc. of the full-length 5'-UTR. Preferably, the fragment exhibits a length of at least about 20 nucleotides or more, preferably of at least about 30 nucleotides or more, more preferably of at least about 40 nucleotides or more. Preferably, the fragment is a functional fragment as described herein.

ATP5A1 Derived 5'-UTR:

Preferably, the 5'-UTR element comprises or consists of a nucleic acid sequence, which is derived from a 5'-UTR of a TOP gene encoding a mitochondrial ATP synthase subunit alpha or from a homolog or variant of a 5'-UTR of a TOP gene encoding a mitochondrial ATP synthase subunit alpha, preferably lacking the 5'TOP motif.

In a particularly preferred embodiment, the 5'-UTR element comprises or consists of a nucleic acid sequence which is derived from the 5'-UTR of a mitochondrial ATP synthase subunit alpha gene, preferably from a vertebrate mitochondrial ATP synthase subunit alpha (ATP5A1) gene, more preferably from a mammalian mitochondrial ATP synthase subunit alpha (ATP5A1) gene, most preferably from a human mitochondrial ATP synthase subunit alpha (ATP5A1) gene, or from a variant of the 5'-UTR of a mitochondrial ATP synthase subunit alpha gene, preferably from a vertebrate mitochondrial ATP synthase subunit alpha (ATP5A1) gene, more preferably from a mammalian mitochondrial ATP synthase subunit alpha (ATP5A1) gene, most preferably from a human mitochondrial ATP synthase subunit alpha (ATP5A1) gene, wherein preferably the 5'-UTR element does not comprise the 5'TOP of said gene.

Accordingly, in a particularly preferred embodiment, the 5'-UTR element comprises or consists of a nucleic acid sequence, which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO: 5016 or 5017 (5'-UTR of ATP5A1 lacking the 5'-terminal oligopyrimidine tract: GCGGCTCGGCCAT- TTTGTCCCAGTCAGTCCGGAGGCTGCGGCTGCAG-AAGTACCGCCTGCGGAGTAACTGCAAAG; corresponding to SEQ ID NO: 1414 of the patent application WO2013/143700) or preferably to a corresponding RNA sequence, or wherein the at least one 5'-UTR element comprises or consists of a fragment of a nucleic acid sequence which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO: 5016 or more preferably to a corresponding RNA sequence (SEQ ID NO: 5017), wherein, preferably, the fragment is as described above, i.e. being a continuous stretch of nucleotides representing at least 20% etc. of the full-length 5'-UTR. Preferably, the fragment exhibits a length of at least about 20 nucleotides or more, preferably of at least about 30 nucleotides or more, more preferably of at least about 40 nucleotides or more. Preferably, the fragment is a functional fragment as described herein.

HSD17B4 Derived 5'-UTR:

Preferably, the 5'-UTR element comprises or consists of a nucleic acid sequence, which is derived from a 5'-UTR of a TOP gene encoding a 17-beta-hydroxysteroid dehydrogenase 4 or from a homolog or variant of a 5'-UTR of a TOP gene encoding a 17-beta-hydroxysteroid dehydrogenase 4, preferably lacking the 5'TOP motif.

In a particularly preferred embodiment, the 5'-UTR element comprises or consists of a nucleic acid sequence which is derived from the 5'-UTR of a 17-beta-hydroxysteroid dehydrogenase 4 (also referred to as peroxisomal multifunctional enzyme type 2) gene, preferably from a vertebrate 17-beta-hydroxysteroid dehydrogenase 4 (HSD17B4) gene, more preferably from a mammalian 17-beta-hydroxysteroid dehydrogenase 4 (HSD17B4) gene, most preferably from a human 17-beta-hydroxysteroid dehydrogenase 4 (HSD17B4) gene, or from a variant of the 5'-UTR of a 17-beta-hydroxysteroid dehydrogenase 4 gene, preferably from a vertebrate 17-beta-hydroxysteroid dehydrogenase 4 (HSD17B4) gene, more preferably from a mammalian 17-beta-hydroxysteroid dehydrogenase 4 (HSD17B4) gene, most preferably from a human 17-beta-hydroxysteroid dehydrogenase 4 (HSD17B4) gene, wherein preferably the 5'-UTR element does not comprise the 5'TOP of said gene.

Accordingly, in a particularly preferred embodiment, the 5'-UTR element comprises or consists of a nucleic acid sequence, which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO: 5018 or 5019 (5'-UTR of human 17-beta-hydroxysteroid dehydrogenase 4 lacking the 5'-terminal oligopyrimidine tract: GTCCCGCAGTCGGCGT-CCAGCGGCTCTGCTTGTTCGTGTGTGTGTCGTTG-CAGGCCTTATTC; corresponding to SEQ ID NO: 1415 of the patent application WO2013/143700) or preferably to a corresponding RNA sequence, or wherein the at least one 5'-UTR element comprises or consists of a fragment of a nucleic acid sequence which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO: 5018 or more preferably to a corresponding RNA sequence (SEQ ID NO: 5019), wherein, preferably, the fragment is as described above, i.e. being a continuous stretch of nucleotides representing at least 20% etc. of the full-length 5'-UTR. Preferably, the fragment exhibits a length of at least about 20 nucleotides or more, preferably of at least about 30 nucleotides or more, more preferably of at least about 40 nucleotides or more. Preferably, the fragment is a functional fragment as described herein.

In some embodiments, the RNA according to the invention comprises a 5'-UTR element, which comprises or consists of a nucleic acid sequence, which is derived from the 5'-UTR of a vertebrate TOP gene, such as a mammalian, e.g. a human TOP gene, selected from RPSA, RPS2, RPS3, RPS3A, RPS4, RPS5, RPS6, RPS7, RPS8, RPS9, RPS10, RPS11, RPS12, RPS13, RPS14, RPS15, RPS15A, RPS16, RPS17, RPS18, RPS19, RPS20, RPS21, RPS23, RPS24, RPS25, RPS26, RP527, RPS27A, RPS28, RPS29, RPS30, RPL3, RPL4, RPL5, RPL6, RPL7, RPL7A, RPL8, RPL9, RPL10, RPL10A, RPL11, RPL12, RPL13, RPL13A, RPL14, RPL15, RPL17, RPL18, RPL18A, RPL19, RPL21, RPL22, RPL23, RPL23A, RPL24, RPL26, RPL27, RPL27A, RPL28, RPL29, RPL30, RPL31, RPL32, RPL34, RPL35, RPL35A, RPL36, RPL36A, RPL37, RPL37A, RPL38, RPL39, RPL40, RPL41, RPLP0, RPLP1, RPLP2, RPLP3, RPLP0, RPLP1, RPLP2, EEF1A1, EEF1B2, EEF1D, EEF1G, EEF2, EIF3E, EIF3F, EIF3H, EIF2S3, EIF3C, EIF3K, EIF3EIP, EIF4A2, PABPC1, HNRNPA1, TPT1, TUBB1, UBA52, NPM1, ATP5G2, GNB2L1, NME2, UQCRB, or from a homolog or variant thereof, wherein preferably the 5'-UTR element does not comprise a TOP-motif or the 5'TOP of said genes, and wherein optionally the 5'-UTR element starts at its 5'-end with a nucleotide located at position 1, 2, 3, 4, 5, 6, 7, 8, 9 or 10 downstream of the 5'-terminal oligopyrimidine tract (TOP) and wherein further optionally the 5'-UTR element which is derived from a 5'-UTR of a TOP gene terminates at its 3'-end with a nucleotide located at position 1, 2, 3, 4, 5, 6, 7, 8, 9 or 10 upstream of the start codon (A(U/T)G) of the gene it is derived from.

In further particularly preferred embodiments, the 5'-UTR element comprises or consists of a nucleic acid sequence, which is derived from the 5'-UTR of a ribosomal protein Large 32 gene (RPL32), a ribosomal protein Large 35 gene (RPL35), a ribosomal protein Large 21 gene (RPL21), an ATP synthase, H+ transporting, mitochondrial F1 complex, alpha subunit 1, cardiac muscle (ATP5A1) gene, an hydroxysteroid (17-beta) dehydrogenase 4 gene (HSD17B4), an androgen-induced 1 gene (AIG1), cytochrome c oxidase subunit VIc gene (COX6C), or a N-acylsphingosine amidohydrolase (acid ceramidase) 1 gene (ASAH1) or from a variant thereof, preferably from a vertebrate ribosomal protein Large 32 gene (RPL32), a vertebrate ribosomal protein Large 35 gene (RPL35), a vertebrate ribosomal protein Large 21 gene (RPL21), a vertebrate ATP synthase, H+ transporting, mitochondrial F1 complex, alpha subunit 1, cardiac muscle (ATP5A1) gene, a vertebrate hydroxysteroid (17-beta) dehydrogenase 4 gene (HSD17B4), a vertebrate androgen-induced 1 gene (AIG1), a vertebrate cytochrome c oxidase subunit VIc gene (COX6C), or a vertebrate N-acylsphingosine amidohydrolase (acid ceramidase) 1 gene (ASAH1) or from a variant thereof, more preferably from a mammalian ribosomal protein Large 32 gene (RPL32), a ribosomal protein Large 35 gene (RPL35), a ribosomal protein Large 21 gene (RPL21), a mammalian ATP synthase, H+ transporting, mitochondrial F1 complex, alpha subunit 1, cardiac muscle (ATP5A1) gene, a mammalian hydroxysteroid (17-beta) dehydrogenase 4 gene (HSD17B4), a mammalian androgen-induced 1 gene (AIG1), a mammalian cyto-chrome c oxidase subunit VIc gene (COX6C), or a mammalian N-acylsphingosine ami-dohydrolase (acid ceramidase) 1 gene (ASAH1) or from a variant thereof, most preferably from a human ribosomal protein Large 32 gene (RPL32), a human ribosomal protein Large 35 gene (RPL35), a human ribosomal protein Large 21 gene (RPL21), a human ATP syn-thase, H+ transporting, mitochondrial F1 complex, alpha subunit 1, cardiac muscle (ATP5A1) gene, a human hydroxysteroid (17-beta) dehydrogenase 4 gene (HSD17B4), a human androgen-induced 1 gene (AIG1), a human cytochrome c oxidase subunit VIc gene (COX6C), or a human N-acylsphingosine amidohydrolase (acid ceramidase) 1 gene (ASAH1) or from a variant thereof, wherein preferably the 5'-UTR element does not comprise the 5'TOP of said gene.

Accordingly, in a particularly preferred embodiment, the 5'-UTR element comprises or consists of a nucleic acid sequence, which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO: 1368, or SEQ ID NOs: 1412-1420 of the patent application WO2013/143700, or a corresponding RNA sequence, or wherein the at least one 5'-UTR element comprises or consists of a fragment of a nucleic acid sequence which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO: 1368, or SEQ ID NOs: 1412-1420 of the patent application WO2013/143700, wherein, preferably, the fragment is as described above, i.e. being a continuous stretch of nucleotides representing at least 20% etc. of the full-length 5'-UTR. Preferably, the fragment exhibits a length of at least about 20 nucleotides or more, preferably of at least about 30 nucleotides or more, more preferably of at least about 40 nucleotides or more. Preferably, the fragment is a functional fragment as described herein.

Preferably, the at least one 5'-UTR element and the at least one 3'-UTR element act synergistically to increase protein production from the at least one mRNA of the inventive composition as described above.

Histone Stem-Loop

In some preferred embodiments, the RNA according to the invention comprises a histone stem-loop sequence/structure. Such histone stem-loop sequences are preferably selected from histone stem-loop sequences as disclosed in WO2012/019780, the disclosure of which is incorporated herewith by reference.

A histone stem-loop sequence, suitable to be used within the present invention, is preferably selected from at least one of the following formulae (I) or (II):

formula (I)
(stem-loop sequence without stem bordering elements):

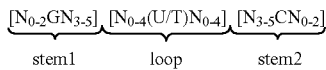

formula (II)
(stem-loop sequence with stem bordering elements):

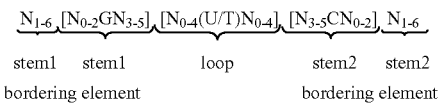

wherein:
stem1 or stem2 bordering elements $N_{1-6}$ is a consecutive sequence of 1 to 6, preferably of 2 to 6, more preferably of 2 to 5, even more preferably of 3 to 5, most preferably of 4 to 5 or 5 N,
  wherein each N is independently from another selected from a nucleotide selected from A, U, T, G and C, or a nucleotide analogue thereof;
stem1 $[N_{0-2}GN_{3-5}]$ is reverse complementary or partially reverse complementary with element stem2, and is a consecutive sequence between of 5 to 7 nucleotides;
  wherein $N_{0-2}$ is a consecutive sequence of 0 to 2, preferably of 0 to 1, more preferably of 1 N, wherein each N is independently from another selected from a nucleotide selected from A, U, T, G and C or a nucleotide analogue thereof;
  wherein $N_{3-5}$ is a consecutive sequence of 3 to 5, preferably of 4 to 5, more preferably of 4 N, wherein each N is independently from another selected from a nucleotide selected from A, U, T, G and C or a nucleotide analogue thereof, and
  wherein G is guanosine or an analogue thereof, and may be optionally replaced by a cytidine or an analogue thereof, provided that its complementary nucleotide cytidine in stem2 is replaced by guanosine;
loop sequence $[N_{0-4}(U/T)N_{0-4}]$ is located between elements stem1 and stem2, and is a consecutive sequence of 3 to 5 nucleotides, more preferably of 4 nucleotides;
  wherein each $N_{0-4}$ is independent from another a consecutive sequence of 0 to 4, preferably of 1 to 3, more preferably of 1 to 2 N, wherein each N is independently from another selected from a nucleotide selected from A, U, T, G and C or a nucleotide analogue thereof; and
  wherein U/T represents uridine, or optionally thymidine;
stem2 $[N_{3-5}CN_{0-2}]$ is reverse complementary or partially reverse complementary with element stem1, and is a consecutive sequence between of 5 to 7 nucleotides;
  wherein $N_{3-5}$ is a consecutive sequence of 3 to 5, preferably of 4 to 5, more preferably of 4 N, wherein each N is independently from another selected from a nucleotide selected from A, U, T, G and C or a nucleotide analogue thereof;
  wherein $N_{0-2}$ is a consecutive sequence of 0 to 2, preferably of 0 to 1, more preferably of 1 N, wherein each N is independently from another selected from a nucleotide selected from A, U, T, G or C or a nucleotide analogue thereof; and
  wherein C is cytidine or an analogue thereof, and may be optionally replaced by a guanosine or an analogue thereof provided that its complementary nucleoside guanosine in stem1 is replaced by cytidine;
wherein
stem1 and stem2 are capable of base pairing with each other forming a reverse complementary sequence, wherein base pairing may occur between stem1 and stem2, e.g. by Watson-Crick base pairing of nucleotides A and U/T or G and C or by non-Watson-Crick base pairing e.g. wobble base pairing, reverse Watson-Crick base pairing, Hoogsteen base pairing, reverse Hoogsteen base pairing or are capable of base pairing with each other forming a partially reverse complementary sequence, wherein an incomplete base pairing may occur between stem1 and stem2, on the basis that one ore more bases in one stem do not have a complementary base in the reverse complementary sequence of the other stem.

According to a further preferred embodiment, the RNA according to the invention may comprise at least one histone stem-loop sequence according to at least one of the following specific formulae (Ia) or (IIa):

formula (Ia)
(stem-loop sequence without stem bordering elements):

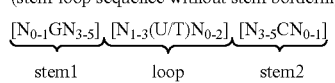

stem1      loop      stem2 formula (IIa)
(stem-loop sequence with stem bordering elements):

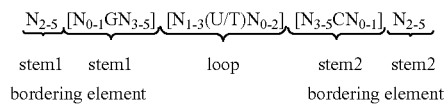

stem1  stem1   loop   stem2  stem2
bordering element            bordering element wherein:
N, C, G, T and U are as defined above.

According to a further more particularly preferred embodiment, the RNA according to the invention may comprise at least one histone stem-loop sequence according to at least one of the following specific formulae (Ib) or (fib):

formula (Ib) (stem-loop sequence without stem bordering elements):

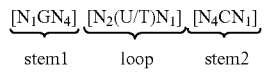

stem1     loop     stem2 formula (IIb) (stem-loop sequence with stem bordering elements):

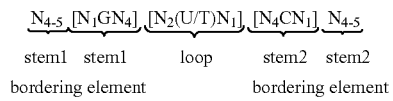

stem1  stem1   loop   stem2  stem2
bordering element            bordering element wherein:
N, C, G, T and U are as defined above.

A particularly preferred histone stem-loop sequence is the sequence CAAAGGCTCTTTTCAGAGCCACCA (according to SEQ ID NO: 5034) or more preferably the corresponding RNA sequence CAAAGGCUCUUUUCAGAGCCACCA (according to SEQ ID NO: 5035).

Signal Peptide

According to another particularly preferred embodiment, the RNA according to the invention may additionally or alternatively encode a secretory signal peptide. Such signal peptides are sequences, which typically exhibit a length of about 15 to 30 amino acids and are preferably located at the N-terminus of the encoded peptide, without being limited thereto. Signal peptides as defined herein preferably allow the transport of the therapeutic protein (in particular a collagenase, growth factor, cytokine, receptor, chaperone or signal transduction inhibitor) as encoded by the at least one RNA into a defined cellular compartment, preferably the cell surface, the endoplasmic reticulum (ER) or the endosomal-lysosomal compartment. Examples of secretory signal peptide sequences as defined herein include, without being limited thereto, signal sequences of classical or non-classical MHC-molecules (e.g. signal sequences of MHC I and II molecules, e.g. of the MHC class I molecule HLA-A*0201), signal sequences of cytokines or immunoglobulines, signal sequences of the invariant chain of immunoglobulines or antibodies, signal sequences of Lamp1, Tapasin, Erp57, Calretikulin, Calnexin, PLAT, EPO or albumin and further membrane associated proteins or of proteins associated with the endoplasmic reticulum (ER) or the endosomal-lysosomal compartment. Most preferably, signal sequences are derived from HLA-A2; PLAT; sEPO; ALB; PLAT(1-21); PLAT(1-22); IgE-leader; CD5(1-24); IL2(1-20); CTRB2(1-18); IgG-HC(1-19); Ig-HC(1-19); Ig-LC(1-19); GpLuc(1-17); Igkappa or a fragment or variant thereof, in particular HsHLA-A2; HsPLAT; sHsEPO; HsALB; HsPLAT(1-21); HsPLAT(1-22); IgE-leader; HsCD5(1-24); HsIL2(1-20); HsCTRB2(1-18); IgG-HC(1-19); Ig-HC(1-19); Ig-LC(1-19); GpLuc(1-17); Mmlgkappa or a fragment or variant thereof.

Such signal peptides are preferably used in order to promote secretion of the encoded therapeutic protein (in particular a collagenase, growth factor, cytokine, receptor, chaperone or signal transduction inhibitor as defined herein) or a fragment or variant thereof. More preferably, a signal peptide as defined herein is fused to an encoded therapeutic protein (in particular a collagenase, growth factor, cytokine, receptor, chaperone or signal transduction inhibitor as defined herein) as defined herein or to a fragment or variant thereof:

In a preferred embodiment, the RNA according to the invention may thus encode a signal peptide comprising or consisting of an amino acid sequence according to SEQ ID NO: 1; 2; 3; 4, 5038; 5039; 5040; 5041; 5042; 5044; 5045; 5046 or 5047 or a fragment or variant of said sequences, preferably provided that said fragment or variant is functional, i.e. capable of effecting transport of the therapeutic protein to the desired cellular compartment. Accordingly, in a preferred embodiment, the encoded therapeutic protein (in particular a collagenase, growth factor, cytokine, receptor, chaperone or signal transduction inhibitor as defined herein) may thus comprise an amino acid sequence according to SEQ ID NO: 1; 2; 3; 4, 5038; 5039; 5040; 5041; 5042; 5044; 5045; 5046 or 5047 or a fragment or variant of said amino acid sequences.

The RNA sequence encoding the signal peptide, which is preferably fused to the RNA sequence encoding the therapeutic protein (in particular a collagenase, growth factor, cytokine, receptor, chaperone or signal transduction inhibitor as defined herein), may be modified as defined above. Thus, the RNA sequence encoding the signal peptide may for instance be G/C optimized, C optimized, codon optimized and/or adapted to human codon usage.

In one embodiment, the RNA according to the invention may thus comprise an RNA sequence encoding a (human) HLA class I histocompatibility antigen, A-2 alpha chain (HLA-A2) signal peptide as defined herein. Accordingly, an RNA according to the invention may comprise a RNA sequence according to SEQ ID NO: 99 or a fragment or variant thereof, preferably comprising or consisting of a RNA sequence according to SEQ ID NO: 211; 308; 405; 502; 599; 696; 793; 890; 987; 1084; 1181 or 1278.

In one embodiment, the RNA according to the invention may thus comprise an RNA sequence encoding a (human) tissue-type plasminogen activator (PLAT) signal peptide as defined herein. Accordingly, an RNA according to the invention may comprise a RNA sequence according to SEQ ID NO: 100 or a fragment or variant thereof, preferably comprising or consisting of a RNA sequence according to SEQ ID NO: 212; 309; 406; 503; 600; 697; 794; 891; 988; 1085; 1182; or 1279.

In one embodiment, the RNA according to the invention may thus comprise an RNA sequence encoding a (human) erythropoietin (EPO) signal peptide as defined herein. Accordingly, an RNA according to the invention may comprise a RNA sequence according to SEQ ID NO: 101 or a fragment or variant thereof, preferably comprising or consisting of a RNA sequence according to SEQ ID NO: 213; 310; 407; 504; 601; 698; 795; 892; 989; 1086; 1183; 1280.

In one embodiment, the RNA according to the invention may thus comprise an RNA sequence encoding a (human) serum albumin (ALB) signal peptide as defined herein. Accordingly, an RNA according to the invention may comprise a RNA sequence according to SEQ ID NO: 102 or a fragment or variant thereof, preferably comprising or consisting of a RNA sequence according to SEQ ID NO: 214; 311; 408; 505; 602; 699; 796; 893; 990; 1087; 1184; 1281.

In one embodiment, the RNA according to the invention may thus comprise an RNA sequence encoding a (human) tissue-type plasminogen activator PLAT (aa1-21) signal peptide as defined herein. Accordingly, an RNA according to the invention may comprise a RNA sequence according to SEQ ID NO: 5049 or a fragment or variant thereof, preferably comprising or consisting of a RNA sequence according to SEQ ID NO: 5060; 5071; 5082; 5093; 5104; 5115; 5126; 5137; 5148; 5159; 5170; 5181.

In one embodiment, the RNA according to the invention may thus comprise an RNA sequence encoding a (human) tissue-type plasminogen activator PLAT (aa1-22) signal peptide as defined herein. Accordingly, an RNA according to the invention may comprise a RNA sequence according to SEQ ID NO: 5050 or a fragment or variant thereof, preferably comprising or consisting of a RNA sequence according to SEQ ID NO: 5061; 5072; 5083; 5094; 5105; 5116; 5127; 5138; 5149; 5160; 5171; 5182.

In one embodiment, the RNA according to the invention may thus comprise an RNA sequence encoding a (human) immunoglobulin E (IgE) leader signal peptide as defined herein. Accordingly, an RNA according to the invention may comprise a RNA sequence according to SEQ ID NO: 5051 or a fragment or variant thereof, preferably comprising or consisting of a RNA sequence according to SEQ ID NO: 5062; 5073; 5084; 5095; 5106; 5117; 5128; 5139; 5150; 5161; 5172; 5183.

In one embodiment, the RNA according to the invention may thus comprise an RNA sequence encoding a (human) T-cell surface glycoprotein CD5CD5 (aa1-24) leader signal peptide as defined herein. Accordingly, an RNA according to the invention may comprise a RNA sequence according to SEQ ID NO: 5052 or a fragment or variant thereof, preferably comprising or consisting of a RNA sequence according to SEQ ID NO: 5063; 5074; 5085; 5096; 5107; 5118; 5129; 5140; 5151; 5162; 5173; 5184.

In one embodiment, the RNA according to the invention may thus comprise an RNA sequence encoding a (human) interleukin-2 (IL2) (aa1-20) signal peptide as defined herein. Accordingly, an RNA according to the invention may comprise a RNA sequence according to SEQ ID NO: 5053 or a fragment or variant thereof, preferably comprising or consisting of a RNA sequence according to SEQ ID NO: 5064; 5075; 5086; 5097; 5108; 5119; 5130; 5141; 5152; 5163; 5174; 5185.

In one embodiment, the RNA according to the invention may thus comprise an RNA sequence encoding a (human) chymotrypsinogen B2 CTRB2 (aa1-18) signal peptide as defined herein. Accordingly, an RNA according to the invention may comprise a RNA sequence according to SEQ ID NO: 5054 or a fragment or variant thereof, preferably comprising or consisting of a RNA sequence according to SEQ ID NO: 5065; 5076; 5087; 5098; 5109; 5120; 5131; 5142; 5153; 5164; 5175; 5186.

In one embodiment, the RNA according to the invention may thus comprise an RNA sequence encoding a (human) immunoglobulin G heavy chain (IgG-HC) (aa1-19) signal peptide as defined herein. Accordingly, an RNA according to the invention may comprise a RNA sequence according to SEQ ID NO: 5055 or a fragment or variant thereof, preferably comprising or consisting of a RNA sequence according to SEQ ID NO: 5055; 5066; 5077; 5088; 5099; 5110; 5121; 5132; 5143; 5154; 5165; 5176; 5187.

In one embodiment, the RNA according to the invention may thus comprise an RNA sequence encoding a (human) immunoglobulin heavy chain (Ig-HC) (aa1-19) signal peptide as defined herein. Accordingly, an RNA according to the invention may comprise a RNA sequence according to SEQ ID NO: 5056 or a fragment or variant thereof, preferably comprising or consisting of a RNA sequence according to SEQ ID NO: 5067; 5078; 5089; 5100; 5111; 5122; 5133; 5144; 5155; 5166; 5177; 5188.

In one embodiment, the RNA according to the invention may thus comprise an RNA sequence encoding a (human) immunoglobulin light chain (Ig-LC) (aa1-19) signal peptide as defined herein. Accordingly, an RNA according to the invention may comprise a RNA sequence according to SEQ ID NO: 5057 or a fragment or variant thereof, preferably comprising or consisting of a RNA sequence according to SEQ ID NO: 5068; 5079; 5090; 5101; 5112; 5123; 5134; 5145; 5156; 5167; 5178; 5189.

In one embodiment, the RNA according to the invention may thus comprise an RNA sequence encoding a *Gaussia princeps* luciferase (GpLuc) signal peptide as defined herein. Accordingly, an RNA according to the invention may comprise a RNA sequence according to SEQ ID NO: 5058 or a fragment or variant thereof, preferably comprising or consisting of a RNA sequence according to SEQ ID NO: 5069; 5080; 5091; 5102; 5113; 5124; 5135; 5146; 5157; 5168; 5179; 5190.

In one embodiment, the RNA according to the invention may thus comprise an RNA sequence encoding a (mouse) immunoglobulin kappa (Igkappa) signal peptide as defined herein. Accordingly, an RNA according to the invention may comprise a RNA sequence according to SEQ ID NO: 5059 or a fragment or variant thereof, preferably comprising or consisting of a RNA sequence according to SEQ ID NO: 5070; 5081; 5092; 5103; 5114; 5125; 5136; 5147; 5158; 5169; 5180; 5191.

Said RNA sequence encoding the signal peptide is preferably fused to the sequence encoding the encoded therapeutic protein (in particular a collagenase, growth factor, cytokine, receptor, chaperone or signal transduction inhibitor as defined herein), so that expression of said RNA sequence preferably yields a therapeutic protein (in particular a collagenase, growth factor, cytokine, receptor, chaperone or signal transduction inhibitor as defined herein) fused to the encoded signal peptide.

Any of the above modifications may be applied to the RNA of the present invention, and further to any RNA as used in the context of the present invention and may be, if suitable or necessary, be combined with each other in any combination, provided, these combinations of modifications do not interfere with each other in the respective at least one mRNA. A person skilled in the art will be able to take his choice accordingly.

Cleavage Site

According to another preferred embodiment, the RNA according to the invention may additionally or alternatively encode a protease cleavage site, in particular a furin cleavage site. Collagenases may be expressed as precursor proteins (zymogens) that are cleaved by cellular proteases. However, as the cleavage sites of, e.g., ColG and ColH are of bacterial origin, it may be preferred to include eukaryotic cleavage site in order to effectively cleave the collagenase even at high expression levels. Therefore, a furin cleavage site (RRRRKR, SEQ ID NO: 5) can be introduced into the ColG and ColH collagenases disclosed herein for enhancing the maturation process of ColG and ColH.

RNA Constructs

The RNA, preferably an mRNA, according to the invention, which comprises at least one coding sequence as defined herein, may preferably comprise a 5'-UTR and/or a 3'-UTR optionally containing at least one histone stem-loop. The 3'-UTR of the RNA according to the invention may further comprise a poly(A) and/or a poly(C) sequence as defined herein. The single elements of the 3'-UTR may occur therein in any order from 5' to 3' along the sequence of the RNA of the present invention. In addition, further elements as described herein, may also be contained, such as a stabilizing sequence as defined herein (e.g. derived from the UTR of a globin gene), IRES sequences, etc. Each of the elements may also be repeated in the RNA according to the invention at least once (particularly in di- or multicistronic constructs), preferably twice or more. As an example, the single elements may be present in the RNA according to the invention in the following order:

TABLE 4

RNA constructs

| | | | | | | |
|---|---|---|---|---|---|---|
| 5' | cds | hSL | | poly(A)/(C) | | 3'; |
| 5' | cds | poly(A)/(C) | | hSL | | 3'; |
| 5' | cds | hSL | | polyadenylation signal | | 3'; |
| 5' | cds | polyadenylation signal | hSL | poly(A)/(C) | | 3'; |
| 5' | cds | hSL | hSL | poly(A)/(C) | | 3'; |
| 5' | cds | hSL | hSL | polyadenylation signal | | 3'; |
| 5' | cds | stabilizing sequence | poly(A)/(C) | hSL | | 3'; |
| 5' | cds | stabilizing sequence | poly(A)/(C) | poly(A)/(C) | hSL | 3' |

Legend for Table 4:
cds = coding region;
hSL = histone stem loop;
poly(A)/(C) = poly(A)/(C) sequence.

According to a further embodiment, the RNA, preferably an mRNA, of the present invention preferably comprises at least one of the following structural elements: a 5'- and/or 3'-untranslated region element (UTR element), particularly a 5'-UTR element, which preferably comprises or consists of a nucleic acid sequence which is derived from the 5'-UTR of a TOP gene or from a fragment, homolog or a variant thereof, or a 5'- and/or 3'-UTR element which may preferably be derivable from a gene that provides a stable mRNA or from a homolog, fragment or variant thereof; a histone-stem-loop structure, preferably a histone-stem-loop in its 3' untranslated region; a 5'-cap structure; a poly-A tail; or a poly(C) sequence.

According to some embodiments, it is particularly preferred that—if, in addition to a therapeutic protein (in particular a collagenase, growth factor, cytokine, receptor, chaperone or signal transduction inhibitor as defined herein) as defined herein or a fragment or variant thereof, a further peptide or protein is encoded by the at least one coding sequence as defined herein—the encoded peptide or protein is preferably no histone protein, no reporter protein (e.g. Luciferase, GFP, EGFP, β-Galactosidase, particularly EGFP) and/or no marker or selection protein (e.g. alpha-Globin, Galactokinase and Xanthine:Guanine phosphoribosyl transferase (GPT)). In a preferred embodiment, the RNA according to the invention does not comprise a reporter gene or a marker gene. Preferably, the RNA according to the invention does not encode, for instance, luciferase; green fluorescent protein (GFP) and its variants (such as eGFP, RFP or BFP); α-globin; hypoxanthine-guanine phosphoribosyltransferase (HGPRT); β-galactosidase; galactokinase; alkaline phosphatase; secreted embryonic alkaline phosphatase (SEAP)) or a resistance gene (such as a resistance gene against neomycin, puromycin, hygromycin and zeocin). In a preferred embodiment, the RNA according to the invention does not encode luciferase. In another embodiment, the RNA according to the invention does not encode GFP or a variant thereof.

According to a preferred embodiment, the RNA according to the present invention comprises, preferably in 5' to 3' direction, the following elements:
 a) a 5'-cap structure, preferably m7GpppN,
 b) at least one coding sequence comprising or consisting of any one of the nucleic acid sequences defined in the fifth column (column "C") of Table 1, or a fragment or variant thereof,
 c) a poly(A) tail, preferably consisting of 10 to 200, 10 to 100, 40 to 80 or 50 to 70 adenosine nucleotides,
 d) a poly(C) tail, preferably consisting of 10 to 200, 10 to 100, 20 to 70, 20 to 60 or 10 to 40 cytosine nucleotides, and
 e) a histone stem-loop, preferably comprising the RNA sequence according to SEQ ID NO: 5035.

More preferably, the RNA according to the invention comprises, preferably in 5' to 3' direction, the following elements:
 a) a 5'-cap structure, preferably m7GpppN,
 b) at least one coding sequence comprising or consisting of any one of the nucleic acid sequences defined in the fifth column (column "C") of Table 1, or a fragment or variant thereof,
 c) a 3'-UTR element comprising a nucleic acid sequence, which is derived from an α-globin gene, preferably comprising the corresponding RNA sequence of the nucleic acid sequence according to SEQ ID NO: 5026, or a homolog, a fragment or a variant thereof,
 d) a poly(A) tail, preferably consisting of 10 to 200, 10 to 100, 40 to 80 or 50 to 70 adenosine nucleotides,
 e) a poly(C) tail, preferably consisting of 10 to 200, 10 to 100, 20 to 70, 20 to 60 or 10 to 40 cytosine nucleotides, and
 f) a histone stem-loop, preferably comprising the RNA sequence according to SEQ ID NO: 5035.

According to a preferred embodiment, the present invention provides an RNA as defined herein comprising at least one coding sequence, wherein said RNA preferably comprises or consists of a nucleic acid sequence selected from the group consisting of SEQ ID NO: 1375; 1376; 1377; 1378; 1379; 1380; 1381; 1382; 1383; 1384; 1385; 1386; 1387; 1388; 1389; 1390; 1391; 1392; 1393; 1394; 1395; 1396; 1397; 1398; 1399; 1400; 1401; 1402; 1403; 1404; 1405; 1406; 1407; 1408; 1409; 1410; 1411; 1412; 1413; 1414; 1415; 1416; 1417; 1418; 1419; 1420; 1421; 1422; 1423; 1424; 1425; 1426; 1427; 1428; 1429; 1430; 1431; 1432; 1433; 1434; 1435; 1436; 1437; 1438; 1439; 1440; 1441; 1442; 1443; 1444; 1445; 1446; 1447; 1448; 1449; 1450; 1451; 1452; 1453; 1454; 1455; 1456; 1457; 1458; 1459; 1460; 1461; 1462; 1463; 1464; 1465; 1466; 1467; 1468; 1469; 1470; 1471; 1472; 1473; 1474; 1475; 1476; 1477; 1478; 1479; 1480; 1481; 1482; 1483; 1484; 1485; 1486; 1487; 1488; 1489; 1490; 1491; 1492; 1493; 1494; 1495; 1496; 1497; 1498; 1499; 1500; 1501; 1502; 1503; 1504; 1505; 1506; 1507; 1508; 1509; 1510; 1511; 1512; 1513; 1514; 1515; 1516; 1517; 1518; 1519; 1520; 1521; 1522; 1523; 1524; 1525; 1526; 1527; 1528; 1529; 1530; 1531; 1532; 1533; 1534; 1535; 1536; 1537; 1538; 1539; 1540; 1541; 1542; 1543; 1544; 1545; 1546; 1547; 1548; 1549; 1550; 1551; 1552; 1553; 1554; 1555; 1556; 1557; 1558; 1559; 1560; 1561; 1562; 1563; 1564; 1565; 1566; 1567; 1568; 1569; 1570; 1571; 1572; 1573; 1574; 1575; 1576; 1577; 1578; 1579; 1580; 1581; 1582; 1583; 1584; 1585; 1586; 1587; 1588; 1589; 1590; 1591; 1592; 1593; 1594; 1595; 1596; 1597; 1598; 1599; 1600; 1601; 1602; 1603; 1604; 1605; 1606; 1607; 1608; 1609; 1610; 1611; 1612; 1613; 1614; 1615; 1616; 1617; 1618; 1619; 1620; 1621; 1622; 1623; 1624; 1625; 1626; 1627; 1628; 1629; 1630; 1631; 1632; 1633; 1634; 1635; 1636; 1637; 1638; 1639; 1640; 1641; 1642; 1643; 1644; 1645; 1646; 1647; 1648; 1649; 1650; 1651; 1652; 1653; 1654; 1655; 1656; 1657; 1658; 1659; 1660; 1661; 1662; 1663; 1664; 1665; 1666; 1667; 1668; 1669; 1670; 1671; 1672; 1673; 1674; 1675; 1676; 1677; 1678; 1679; 1680; 1681; 1682; 1683; 1684; 1685; 1686; 1687; 1688; 1689; 1690; 1691; 1692; 1693; 1694; 1695; 1696; 1697; 1698; 1699; 1700; 1701; 1702; 1703; 1704; 1705; 1706; 1707; 1708; 1709; 1710; 1711; 1712; 1713; 1714; 1715; 1716; 1717; 1718; 1719; 1720; 1721; 1722; 1723; 1724; 1725; 1726; 1727; 1728; 1729; 1730; 1731; 1732; 1733; 1734; 1735; 1736; 1737; 1738; 1739; 1740; 1741; 1742; 1743; 1744; 1745; 1746; 1747; 1748; 1749; 1750; 1751; 1752; 1753; 1754; 1755; 1756; 1757; 1758; 1759; 1760; 1761; 1762; 1763; 1764; 1765; 1766; 1767; 1768; 1769; 1770; 1771; 1772; 1773; 1774; 1775; 1776; 1777; 1778; 1779; 1780; 1781; 1782; 1783; 1784; 1785; 1786; 1787; 1788; 1789; 1790; 1791; 1792; 1793; 1794; 1795; 1796; 1797; 1798; 1799; 1800; 1801; 1802; 1803; 1804; 1805; 1806; 1807; 1808; 1809; 1810; 1811; 1812; 1813; 1814; 1815; 1816; 1817; 1818; 1819; 1820; 1821; 1822; 1823; 1824; 1825; 1826; 1827; 1828; 1829; 1830; 1831; 1832; 1833; 1834; 1835; 1836; 1837; 1838; 1839; 1840; 1841; 1842; 1843; 1844; 1845; 1846; 1847; 1848; 1849; 1850; 1851; 1852; 1853; 1854; 1855; 1856; 1857; 1858; 1859; 1860; 1861; 1862; 1863; 1864; 1865; 1866; 1867; 1868; 1869; 1870; 1871; 1872; 1873; 1874; 1875; 1876; 1877; 1878; 1879; 1880; 1881; 1882; 1883; 1884; 1885; 1886; 1887; 1888; 1889; 1890; 1891; 1892; 1893; 1894; 1895; 1896; 1897; 1898; 1899; 1900; 1901; 1902; 1903; 1904; 1905; 1906; 1907; 1908; 1909; 1910; 1911; 1912; 1913; 1914; 1915; 1916; 1917; 1918; 1919; 1920; 1921; 1922; 1923; 1924; 1925; 1926; 1927; 1928; 1929; 1930; 1931; 1932; 1933; 1934; 1935; 1936; 1937; 1938; 1939; 1940; 1941; 1942; 1943; 1944; 1945; 1946; 1947; 1948; 1949; 1950; 1951; 1952; 1953; 1954; 1955; 1956; 1957; 1958; 1959; 1960; 1961; 1962; 1963; 1964; 1965; 1966; 1967; 1968; 1969; 1970; 1971; 1972; 1973; 1974; 1975; 1976; 1977; 1978; 1979; 1980; 1981; 1982; 1983; 1984; 1985; 1986; 1987; 1988; 1989; 1990; 1991; 1992; 1993; 1994; 1995; 1996; 1997; 1998; 1999; 2000; 2001; 2002; 2003; 2004; 2005; 2006; 2007; 2008; 2009; 2010; 2011; 2012; 2013; 2014; 2015; 2016; 2017; 2018; 2019; 2020; 2021; 2022; 2023; 2024; 2025; 2026; 2027; 2028; 2029; 2030; 2031; 2032; 2033; 2034; 2035; 2036; 2037; 2038; 2039; 2040; 2041; 2042; 2043; 2044; 2045; 2046; 2047; 2048; 2049; 2050; 2051; 2052; 2053; 2054; 2055; 2056; 2057; 2058; 2059; 2060; 2061; 2062; 2063; 2064; 2065; 2066; 2067; 2068; 2069; 2070; 2071; 2072; 2073; 2074; 2075; 2076; 2077; 2078; 2079; 2080; 2081; 2082; 2083; 2084; 2085; 2086; 2087; 2088; 2089; 2090; 2091; 2092; 2093; 2094; 2095; 2096; 2097; 2098; 2099; 2100; 2101; 2102; 2103; 2104; 2105; 2106; 2107; 2108; 2109; 2110; 2111; 2112; 2113; 2114; 2115; 2116; 2117; 2118; 2119; 2120; 2121; 2122; 2123; 2124; 2125; 2126; 2127; 2128; 2129; 2130; 2131; 2132; 2133; 2134; 2135; 2136; 2137; 2138; 2139; 2140; 2141; 2142; 2143; 2144; 2145; 2146; 2147; 2148; 2149; 2150; 2151; 2152; 2153; 2154; 2155; 2156; 2157; 2158; 2159; 2160; 2161; 2162; 2163; 2164; 2165; 2166; 2167; 2168; 2169; 2170; 2171; 2172; 2173; 2174; 2175; 2176; 2177; 2178; 2179; 2180; 2181; 2182; 2183; 2184; 2185; 2186; 2187; 2188; 2189; 2190; 2191; 2192; 2193; 2194; 2195; 2196; 2197; 2198; 2199; 2200; 2201; 2202; 2203; 2204; 2205; 2206; 2207; 2208; 2209; 2210; 2211; 2212; 2213; 2214; 2215; 2216; 2217; 2218; 2219; 2220; 2221; 2222; 2223; 2224; 2225; 2226; 2227; 2228; 2229; 2230; 2231; 2232; 2233; 2234; 2235; 2236; 2237; 2238; 2239; 2240; 2241; 2242; 2243; 2244; 2245; 2246; 2247; 2248; 2249; 2250; 2251; 2252; 2253; 2254; 2255; 2256; 2257; 2258; 2259; 2260; 2261; 2262; 2263; 2264; 2265; 2266; 2267; 2268; 2269; 2270; 2271; 2272; 2273; 2274; 2275; 2276; 2277; 2278; 2279; 2280; 2281; 2282; 2283; 2284; 2285; 2286; 2287; 2288; 2289; 2290; 2291; 2292; 2293; 2294; 2295; 2296; 2297; 2298; 2299; 2300; 2301; 2302; 2303; 2304; 2305; 2306; 2307; 2308; 2309; 2310; 2311; 2312; 2313; 2314; 2315; 2316; 2317; 2318; 2319; 2320; 2321; 2322; 2323; 2324; 2325; 2326; 2327; 2328; 2329; 2330; 2331; 2332; 2333; 2334; 2335; 2336; 2337; 2338; 2339; 2340; 2341; 2342; 2343; 2344; 2345; 2346; 2347; 2348; 2349; 2350; 2351; 2352; 2353; 2354; 2355; 2356; 2357; 2358; 2359; 2360; 2361; 2362; 2363; 2364; 2365; 2366; 2367; 2368; 2369; 2370; 2371; 2372; 2373; 2374; 2375; 2376; 2377; 2378; 2379; 2380; 2381; 2382; 2383; 2384; 2385; 2386; 2387; 2388; 2389; 2390; 2391; 2392; 2393; 2394; 2395; 2396; 2397; 2398; 2399; 2400; 2401; 2402; 2403; 2404; 2405; 2406; 2407; 2408; 2409; 2410; 2411; 2412; 2413; 2414; 2415; 2416; 2417; 2418; 2419; 2420; 2421; 2422; 2423; 2424; 2425; 2426; 2427; 2428; 2429; 2430; 2431; 2432; 2433; 2434; 2435; 2436; 2437; 2438; 2439; 2440; 2441; 2442; 2443; 2444; 2445; 2446; 2447; 2448; 2449; 2450; 2451; 2452; 2453; 2454; 2455; 2456; 2457; 2458; 2459; 2460; 2461; 2462; 2463; 2464; 2465; 2466; 2467; 2468; 2469; 2470; 2471; 2472; 2473; 2474; 2475; 2476; 2477; 2478; 2479; 2480; 2481; 2482; 2483; 2484; 2485; 2486; 2487; 2488; 2489; 2490; 2491; 2492; 2493; 2494; 2495; 2496; 2497; 2498; 2499; 2500; 2501; 2502; 2503; 2504; 2505; 2506; 2507; 2508; 2509; 2510; 2511; 2512; 2513; 2514; 2515; 2516; 2517; 2518; 2519; 2520; 2521; 2522; 2523; 2524; 2525; 2526; 2527; 2528; 2529; 2530; 2531; 2532; 2533; 2534; 2535; 2536; 2537; 2538; 2539; 2540; 2541; 2542; 2543; 2544; 2545; 2546; 2547; 2548; 2549; 2550; 2551; 2552; 2553; 2554; 2555; 2556; 2557; 2558; 2559; 2560; 2561; 2562; 2563; 2564; 2565; 2566; 2567; 2568; 2569; 2570; 2571; 2572; 2573; 2574;

2575; 2576; 2577; 2578; 2579; 2580; 2581; 2582; 2583; 2584; 2585 or a fragment or variant thereof.

In a further preferred embodiment, the RNA according to the invention comprises, preferably in 5' to 3' direction, the following elements:
  a) a 5'-cap structure, preferably m7GpppN,
  b) a 5'-UTR element, which preferably comprises or consists of a nucleic acid sequence, which is derived from the 5'-UTR of a TOP gene, preferably comprising an RNA sequence corresponding to the nucleic acid sequence according to SEQ ID NO: 5014, or a homolog, a fragment or a variant thereof,
  c) at least one coding sequence comprising or consisting of any one of the nucleic acid sequences defined in the fifth column (column "C") of Table 1, or a fragment or variant thereof,
  d) a 3'-UTR element comprising a nucleic acid sequence, which is preferably derived from an α-globin gene, preferably comprising the corresponding RNA sequence of the nucleic acid sequence according to SEQ ID NO: 5026, or a homolog, a fragment or a variant thereof; and/or
    a 3'-UTR element comprising a nucleic acid sequence, which is derived from an albumin gene, preferably comprising the corresponding RNA sequence of the nucleic acid sequence according to SEQ ID NO: 5030 or 5032, or a homolog, a fragment or a variant thereof,
  e) a poly(A) tail, preferably consisting of 10 to 200, 10 to 100, 40 to 80 or 50 to 70 adenosine nucleotides,
  f) a poly(C) tail, preferably consisting of 10 to 200, 10 to 100, 20 to 70, 20 to 60 or 10 to 40 cytosine nucleotides, and
  g) a histone stem-loop, preferably comprising the RNA sequence according to SEQ ID NO: 5035.

According to a further preferred embodiment, the present invention provides an RNA as defined herein comprising at least one coding sequence, wherein said RNA preferably comprises or consists of a nucleic acid sequence selected from the group consisting of SEQ ID NO: 2586; 2587; 2588; 2589; 2590; 2591; 2592; 2593; 2594; 2595; 2596; 2597; 2598; 2599; 2600; 2601; 2602; 2603; 2604; 2605; 2606; 2607; 2608; 2609; 2610; 2611; 2612; 2613; 2614; 2615; 2616; 2617; 2618; 2619; 2620; 2621; 2622; 2623; 2624; 2625; 2626; 2627; 2628; 2629; 2630; 2631; 2632; 2633; 2634; 2635; 2636; 2637; 2638; 2639; 2640; 2641; 2642; 2643; 2644; 2645; 2646; 2647; 2648; 2649; 2650; 2651; 2652; 2653; 2654; 2655; 2656; 2657; 2658; 2659; 2660; 2661; 2662; 2663; 2664; 2665; 2666; 2667; 2668; 2669; 2670; 2671; 2672; 2673; 2674; 2675; 2676; 2677; 2678; 2679; 2680; 2681; 2682; 2683; 2684; 2685; 2686; 2687; 2688; 2689; 2690; 2691; 2692; 2693; 2694; 2695; 2696; 2697; 2698; 2699; 2700; 2701; 2702; 2703; 2704; 2705; 2706; 2707; 2708; 2709; 2710; 2711; 2712; 2713; 2714; 2715; 2716; 2717; 2718; 2719; 2720; 2721; 2722; 2723; 2724; 2725; 2726; 2727; 2728; 2729; 2730; 2731; 2732; 2733; 2734; 2735; 2736; 2737; 2738; 2739; 2740; 2741; 2742; 2743; 2744; 2745; 2746; 2747; 2748; 2749; 2750; 2751; 2752; 2753; 2754; 2755; 2756; 2757; 2758; 2759; 2760; 2761; 2762; 2763; 2764; 2765; 2766; 2767; 2768; 2769; 2770; 2771; 2772; 2773; 2774; 2775; 2776; 2777; 2778; 2779; 2780; 2781; 2782; 2783; 2784; 2785; 2786; 2787; 2788; 2789; 2790; 2791; 2792; 2793; 2794; 2795; 2796; 2797; 2798; 2799; 2800; 2801; 2802; 2803; 2804; 2805; 2806; 2807; 2808; 2809; 2810; 2811; 2812; 2813; 2814; 2815; 2816; 2817; 2818; 2819; 2820; 2821; 2822; 2823; 2824; 2825; 2826; 2827; 2828; 2829; 2830; 2831; 2832; 2833; 2834; 2835; 2836; 2837; 2838; 2839; 2840; 2841; 2842; 2843; 2844; 2845; 2846; 2847; 2848; 2849; 2850; 2851; 2852; 2853; 2854; 2855; 2856; 2857; 2858; 2859; 2860; 2861; 2862; 2863; 2864; 2865; 2866; 2867; 2868; 2869; 2870; 2871; 2872; 2873; 2874; 2875; 2876; 2877; 2878; 2879; 2880; 2881; 2882; 2883; 2884; 2885; 2886; 2887; 2888; 2889; 2890; 2891; 2892; 2893; 2894; 2895; 2896; 2897; 2898; 2899; 2900; 2901; 2902; 2903; 2904; 2905; 2906; 2907; 2908; 2909; 2910; 2911; 2912; 2913; 2914; 2915; 2916; 2917; 2918; 2919; 2920; 2921; 2922; 2923; 2924; 2925; 2926; 2927; 2928; 2929; 2930; 2931; 2932; 2933; 2934; 2935; 2936; 2937; 2938; 2939; 2940; 2941; 2942; 2943; 2944; 2945; 2946; 2947; 2948; 2949; 2950; 2951; 2952; 2953; 2954; 2955; 2956; 2957; 2958; 2959; 2960; 2961; 2962; 2963; 2964; 2965; 2966; 2967; 2968; 2969; 2970; 2971; 2972; 2973; 2974; 2975; 2976; 2977; 2978; 2979; 2980; 2981; 2982; 2983; 2984; 2985; 2986; 2987; 2988; 2989; 2990; 2991; 2992; 2993; 2994; 2995; 2996; 2997; 2998; 2999; 3000; 3001; 3002; 3003; 3004; 3005; 3006; 3007; 3008; 3009; 3010; 3011; 3012; 3013; 3014; 3015; 3016; 3017; 3018; 3019; 3020; 3021; 3022; 3023; 3024; 3025; 3026; 3027; 3028; 3029; 3030; 3031; 3032; 3033; 3034; 3035; 3036; 3037; 3038; 3039; 3040; 3041; 3042; 3043; 3044; 3045; 3046; 3047; 3048; 3049; 3050; 3051; 3052; 3053; 3054; 3055; 3056; 3057; 3058; 3059; 3060; 3061; 3062; 3063; 3064; 3065; 3066; 3067; 3068; 3069; 3070; 3071; 3072; 3073; 3074; 3075; 3076; 3077; 3078; 3079; 3080; 3081; 3082; 3083; 3084; 3085; 3086; 3087; 3088; 3089; 3090; 3091; 3092; 3093; 3094; 3095; 3096; 3097; 3098; 3099; 3100; 3101; 3102; 3103; 3104; 3105; 3106; 3107; 3108; 3109; 3110; 3111; 3112; 3113; 3114; 3115; 3116; 3117; 3118; 3119; 3120; 3121; 3122; 3123; 3124; 3125; 3126; 3127; 3128; 3129; 3130; 3131; 3132; 3133; 3134; 3135; 3136; 3137; 3138; 3139; 3140; 3141; 3142; 3143; 3144; 3145; 3146; 3147; 3148; 3149; 3150; 3151; 3152; 3153; 3154; 3155; 3156; 3157; 3158; 3159; 3160; 3161; 3162; 3163; 3164; 3165; 3166; 3167; 3168; 3169; 3170; 3171; 3172; 3173; 3174; 3175; 3176; 3177; 3178; 3179; 3180; 3181; 3182; 3183; 3184; 3185; 3186; 3187; 3188; 3189; 3190; 3191; 3192; 3193; 3194; 3195; 3196; 3197; 3198; 3199; 3200; 3201; 3202; 3203; 3204; 3205; 3206; 3207; 3208; 3209; 3210; 3211; 3212; 3213; 3214; 3215; 3216; 3217; 3218; 3219; 3220; 3221; 3222; 3223; 3224; 3225; 3226; 3227; 3228; 3229; 3230; 3231; 3232; 3233; 3234; 3235; 3236; 3237; 3238; 3239; 3240; 3241; 3242; 3243; 3244; 3245; 3246; 3247; 3248; 3249; 3250; 3251; 3252; 3253; 3254; 3255; 3256; 3257; 3258; 3259; 3260; 3261; 3262; 3263; 3264; 3265; 3266; 3267; 3268; 3269; 3270; 3271; 3272; 3273; 3274; 3275; 3276; 3277; 3278; 3279; 3280; 3281; 3282; 3283; 3284; 3285; 3286; 3287; 3288; 3289; 3290; 3291; 3292; 3293; 3294; 3295; 3296; 3297; 3298; 3299; 3300; 3301; 3302; 3303; 3304; 3305; 3306; 3307; 3308; 3309; 3310; 3311; 3312; 3313; 3314; 3315; 3316; 3317; 3318; 3319; 3320; 3321; 3322; 3323; 3324; 3325; 3326; 3327; 3328; 3329; 3330; 3331; 3332; 3333; 3334; 3335; 3336; 3337; 3338; 3339; 3340; 3341; 3342; 3343; 3344; 3345; 3346; 3347; 3348; 3349; 3350; 3351; 3352; 3353; 3354; 3355; 3356; 3357; 3358; 3359; 3360; 3361; 3362; 3363; 3364; 3365; 3366; 3367; 3368; 3369; 3370; 3371; 3372; 3373; 3374; 3375; 3376; 3377; 3378; 3379; 3380; 3381; 3382; 3383; 3384; 3385; 3386; 3387; 3388; 3389; 3390; 3391; 3392; 3393; 3394; 3395; 3396; 3397; 3398; 3399; 3400; 3401; 3402; 3403; 3404; 3405; 3406; 3407; 3408; 3409; 3410; 3411; 3412; 3413; 3414; 3415; 3416; 3417; 3418; 3419; 3420; 3421; 3422; 3423; 3424; 3425; 3426; 3427; 3428; 3429; 3430; 3431; 3432; 3433; 3434;

3435; 3436; 3437; 3438; 3439; 3440; 3441; 3442; 3443; 3444; 3445; 3446; 3447; 3448; 3449; 3450; 3451; 3452; 3453; 3454; 3455; 3456; 3457; 3458; 3459; 3460; 3461; 3462; 3463; 3464; 3465; 3466; 3467; 3468; 3469; 3470; 3471; 3472; 3473; 3474; 3475; 3476; 3477; 3478; 3479; 3480; 3481; 3482; 3483; 3484; 3485; 3486; 3487; 3488; 3489; 3490; 3491; 3492; 3493; 3494; 3495; 3496; 3497; 3498; 3499; 3500; 3501; 3502; 3503; 3504; 3505; 3506; 3507; 3508; 3509; 3510; 3511; 3512; 3513; 3514; 3515; 3516; 3517; 3518; 3519; 3520; 3521; 3522; 3523; 3524; 3525; 3526; 3527; 3528; 3529; 3530; 3531; 3532; 3533; 3534; 3535; 3536; 3537; 3538; 3539; 3540; 3541; 3542; 3543; 3544; 3545; 3546; 3547; 3548; 3549; 3550; 3551; 3552; 3553; 3554; 3555; 3556; 3557; 3558; 3559; 3560; 3561; 3562; 3563; 3564; 3565; 3566; 3567; 3568; 3569; 3570; 3571; 3572; 3573; 3574; 3575; 3576; 3577; 3578; 3579; 3580; 3581; 3582; 3583; 3584; 3585; 3586; 3587; 3588; 3589; 3590; 3591; 3592; 3593; 3594; 3595; 3596; 3597; 3598; 3599; 3600; 3601; 3602; 3603; 3604; 3605; 3606; 3607; 3608; 3609; 3610; 3611; 3612; 3613; 3614; 3615; 3616; 3617; 3618; 3619; 3620; 3621; 3622; 3623; 3624; 3625; 3626; 3627; 3628; 3629; 3630; 3631; 3632; 3633; 3634; 3635; 3636; 3637; 3638; 3639; 3640; 3641; 3642; 3643; 3644; 3645; 3646; 3647; 3648; 3649; 3650; 3651; 3652; 3653; 3654; 3655; 3656; 3657; 3658; 3659; 3660; 3661; 3662; 3663; 3664; 3665; 3666; 3667; 3668; 3669; 3670; 3671; 3672; 3673; 3674; 3675; 3676; 3677; 3678; 3679; 3680; 3681; 3682; 3683; 3684; 3685; 3686; 3687; 3688; 3689; 3690; 3691; 3692; 3693; 3694; 3695; 3696; 3697; 3698; 3699; 3700; 3701; 3702; 3703; 3704; 3705; 3706; 3707; 3708; 3709; 3710; 3711; 3712; 3713; 3714; 3715; 3716; 3717; 3718; 3719; 3720; 3721; 3722; 3723; 3724; 3725; 3726; 3727; 3728; 3729; 3730; 3731; 3732; 3733; 3734; 3735; 3736; 3737; 3738; 3739; 3740; 3741; 3742; 3743; 3744; 3745; 3746; 3747; 3748; 3749; 3750; 3751; 3752; 3753; 3754; 3755; 3756; 3757; 3758; 3759; 3760; 3761; 3762; 3763; 3764; 3765; 3766; 3767; 3768; 3769; 3770; 3771; 3772; 3773; 3774; 3775; 3776; 3777; 3778; 3779; 3780; 3781; 3782; 3783; 3784; 3785; 3786; 3787; 3788; 3789; 3790; 3791; 3792; 3793; 3794; 3795; 3796 or a fragment or variant thereof.

In a preferred embodiment, the RNA according to the invention comprises at least one coding sequence encoding a MMP1 collagenase or a fragment or variant thereof. Preferably, said RNA may comprise or consist of a RNA sequence according to SEQ ID NO: 2694. In a preferred embodiment, said RNA comprises at least one coding sequence encoding a MMP1 collagenase lacking the activation peptide sequence (amino acids 20 to 99 of SEQ ID NO: 7). Said RNA may preferably comprise or consist of a RNA sequence according to SEQ ID NO: 2695.

In a preferred embodiment, the RNA according to the invention comprises at least one coding sequence encoding a ColG collagenase or a fragment or variant thereof. Preferably, said RNA may comprise or consist of a RNA sequence according to SEQ ID NO: 2696. In a preferred embodiment, said RNA comprises at least one coding sequence encoding a ColG collagenase fused to a signal peptide as defined herein, preferably the human albumin signal peptide according to SEQ ID NO: 4 or a fragment or variant thereof. Said RNA may preferably comprise or consist of a RNA sequence according to SEQ ID NO: 2697. Preferably, said ColG collagenase may further comprise a Furin cleavage site according to SEQ ID NO: 103. Said RNA may preferably comprise or consist of a RNA sequence according to SEQ ID NO: 2698.

In a preferred embodiment, the RNA according to the invention comprises at least one coding sequence encoding a ColH collagenase or a fragment or variant thereof. Preferably, said RNA may comprise or consist of a RNA sequence according to SEQ ID NO: 2700. In a preferred embodiment, said RNA comprises at least one coding sequence encoding a ColH collagenase fused to a signal peptide as defined herein, preferably the human albumin signal peptide according to SEQ ID NO: 4 or a fragment or variant thereof. Said RNA may preferably comprise or consist of a RNA sequence according to SEQ ID NO: 2701. Preferably, said ColH collagenase may further comprise a Furin cleavage site according to SEQ ID NO: 103. Said RNA may preferably comprise or consist of a RNA sequence according to SEQ ID NO: 2702.

In a further preferred embodiment, the RNA according to the invention comprises, preferably in 5' to 3' direction, the following elements:
a) a 5'-cap structure, preferably m7GpppN,
b) a 5'-UTR element, which preferably comprises or consists of a nucleic acid sequence, which is derived from the 5'-UTR of a TOP gene, preferably comprising an RNA sequence corresponding to the nucleic acid sequence according to SEQ ID NO: 5018, or a homolog, a fragment or a variant thereof,]
c) at least one coding sequence comprising or consisting of any one of the nucleic acid sequences defined in the fifth column (column "C") of Table 1, or a fragment or variant thereof,
d) a poly(A) tail, preferably consisting of 10 to 200, 10 to 100, 40 to 80 or 50 to 70 adenosine nucleotides, According to a preferred embodiment, the present invention provides an RNA as defined herein comprising at least one coding sequence, wherein said RNA preferably comprises or consists of a nucleic acid sequence selected from the group consisting of SEQ ID NO: 3797; 3798; 3799; 3800; 3801; 3802; 3803; 3804; 3805; 3806; 3807; 3808; 3809; 3810; 3811; 3812; 3813; 3814; 3815; 3816; 3817; 3818; 3819; 3820; 3821; 3822; 3823; 3824; 3825; 3826; 3827; 3828; 3829; 3830; 3831; 3832; 3833; 3834; 3835; 3836; 3837; 3838; 3839; 3840; 3841; 3842; 3843; 3844; 3845; 3846; 3847; 3848; 3849; 3850; 3851; 3852; 3853; 3854; 3855; 3856; 3857; 3858; 3859; 3860; 3861; 3862; 3863; 3864; 3865; 3866; 3867; 3868; 3869; 3870; 3871; 3872; 3873; 3874; 3875; 3876; 3877; 3878; 3879; 3880; 3881; 3882; 3883; 3884; 3885; 3886; 3887; 3888; 3889; 3890; 3891; 3892; 3893; 3894; 3895; 3896; 3897; 3898; 3899; 3900; 3901; 3902; 3903; 3904; 3905; 3906; 3907; 3908; 3909; 3910; 3911; 3912; 3913; 3914; 3915; 3916; 3917; 3918; 3919; 3920; 3921; 3922; 3923; 3924; 3925; 3926; 3927; 3928; 3929; 3930; 3931; 3932; 3933; 3934; 3935; 3936; 3937; 3938; 3939; 3940; 3941; 3942; 3943; 3944; 3945; 3946; 3947; 3948; 3949; 3950; 3951; 3952; 3953; 3954; 3955; 3956; 3957; 3958; 3959; 3960; 3961; 3962; 3963; 3964; 3965; 3966; 3967; 3968; 3969; 3970; 3971; 3972; 3973; 3974; 3975; 3976; 3977; 3978; 3979; 3980; 3981; 3982; 3983; 3984; 3985; 3986; 3987; 3988; 3989; 3990; 3991; 3992; 3993; 3994; 3995; 3996; 3997; 3998; 3999; 4000; 4001; 4002; 4003; 4004; 4005; 4006; 4007; 4008; 4009; 4010; 4011; 4012; 4013; 4014; 4015; 4016; 4017; 4018; 4019; 4020; 4021; 4022; 4023; 4024; 4025; 4026; 4027; 4028; 4029; 4030; 4031; 4032; 4033; 4034; 4035; 4036; 4037; 4038; 4039; 4040; 4041; 4042; 4043; 4044; 4045; 4046; 4047; 4048; 4049; 4050; 4051; 4052; 4053; 4054; 4055; 4056; 4057; 4058; 4059; 4060; 4061; 4062; 4063; 4064; 4065; 4066; 4067; 4068; 4069; 4070; 4071; 4072; 4073; 4074; 4075; 4076; 4077; 4078;

4079; 4080; 4081; 4082; 4083; 4084; 4085; 4086; 4087; 4088; 4089; 4090; 4091; 4092; 4093; 4094; 4095; 4096; 4097; 4098; 4099; 4100; 4101; 4102; 4103; 4104; 4105; 4106; 4107; 4108; 4109; 4110; 4111; 4112; 4113; 4114; 4115; 4116; 4117; 4118; 4119; 4120; 4121; 4122; 4123; 4124; 4125; 4126; 4127; 4128; 4129; 4130; 4131; 4132; 4133; 4134; 4135; 4136; 4137; 4138; 4139; 4140; 4141; 4142; 4143; 4144; 4145; 4146; 4147; 4148; 4149; 4150; 4151; 4152; 4153; 4154; 4155; 4156; 4157; 4158; 4159; 4160; 4161; 4162; 4163; 4164; 4165; 4166; 4167; 4168; 4169; 4170; 4171; 4172; 4173; 4174; 4175; 4176; 4177; 4178; 4179; 4180; 4181; 4182; 4183; 4184; 4185; 4186; 4187; 4188; 4189; 4190; 4191; 4192; 4193; 4194; 4195; 4196; 4197; 4198; 4199; 4200; 4201; 4202; 4203; 4204; 4205; 4206; 4207; 4208; 4209; 4210; 4211; 4212; 4213; 4214; 4215; 4216; 4217; 4218; 4219; 4220; 4221; 4222; 4223; 4224; 4225; 4226; 4227; 4228; 4229; 4230; 4231; 4232; 4233; 4234; 4235; 4236; 4237; 4238; 4239; 4240; 4241; 4242; 4243; 4244; 4245; 4246; 4247; 4248; 4249; 4250; 4251; 4252; 4253; 4254; 4255; 4256; 4257; 4258; 4259; 4260; 4261; 4262; 4263; 4264; 4265; 4266; 4267; 4268; 4269; 4270; 4271; 4272; 4273; 4274; 4275; 4276; 4277; 4278; 4279; 4280; 4281; 4282; 4283; 4284; 4285; 4286; 4287; 4288; 4289; 4290; 4291; 4292; 4293; 4294; 4295; 4296; 4297; 4298; 4299; 4300; 4301; 4302; 4303; 4304; 4305; 4306; 4307; 4308; 4309; 4310; 4311; 4312; 4313; 4314; 4315; 4316; 4317; 4318; 4319; 4320; 4321; 4322; 4323; 4324; 4325; 4326; 4327; 4328; 4329; 4330; 4331; 4332; 4333; 4334; 4335; 4336; 4337; 4338; 4339; 4340; 4341; 4342; 4343; 4344; 4345; 4346; 4347; 4348; 4349; 4350; 4351; 4352; 4353; 4354; 4355; 4356; 4357; 4358; 4359; 4360; 4361; 4362; 4363; 4364; 4365; 4366; 4367; 4368; 4369; 4370; 4371; 4372; 4373; 4374; 4375; 4376; 4377; 4378; 4379; 4380; 4381; 4382; 4383; 4384; 4385; 4386; 4387; 4388; 4389; 4390; 4391; 4392; 4393; 4394; 4395; 4396; 4397; 4398; 4399; 4400; 4401; 4402; 4403; 4404; 4405; 4406; 4407; 4408; 4409; 4410; 4411; 4412; 4413; 4414; 4415; 4416; 4417; 4418; 4419; 4420; 4421; 4422; 4423; 4424; 4425; 4426; 4427; 4428; 4429; 4430; 4431; 4432; 4433; 4434; 4435; 4436; 4437; 4438; 4439; 4440; 4441; 4442; 4443; 4444; 4445; 4446; 4447; 4448; 4449; 4450; 4451; 4452; 4453; 4454; 4455; 4456; 4457; 4458; 4459; 4460; 4461; 4462; 4463; 4464; 4465; 4466; 4467; 4468; 4469; 4470; 4471; 4472; 4473; 4474; 4475; 4476; 4477; 4478; 4479; 4480; 4481; 4482; 4483; 4484; 4485; 4486; 4487; 4488; 4489; 4490; 4491; 4492; 4493; 4494; 4495; 4496; 4497; 4498; 4499; 4500; 4501; 4502; 4503; 4504; 4505; 4506; 4507; 4508; 4509; 4510; 4511; 4512; 4513; 4514; 4515; 4516; 4517; 4518; 4519; 4520; 4521; 4522; 4523; 4524; 4525; 4526; 4527; 4528; 4529; 4530; 4531; 4532; 4533; 4534; 4535; 4536; 4537; 4538; 4539; 4540; 4541; 4542; 4543; 4544; 4545; 4546; 4547; 4548; 4549; 4550; 4551; 4552; 4553; 4554; 4555; 4556; 4557; 4558; 4559; 4560; 4561; 4562; 4563; 4564; 4565; 4566; 4567; 4568; 4569; 4570; 4571; 4572; 4573; 4574; 4575; 4576; 4577; 4578; 4579; 4580; 4581; 4582; 4583; 4584; 4585; 4586; 4587; 4588; 4589; 4590; 4591; 4592; 4593; 4594; 4595; 4596; 4597; 4598; 4599; 4600; 4601; 4602; 4603; 4604; 4605; 4606; 4607; 4608; 4609; 4610; 4611; 4612; 4613; 4614; 4615; 4616; 4617; 4618; 4619; 4620; 4621; 4622; 4623; 4624; 4625; 4626; 4627; 4628; 4629; 4630; 4631; 4632; 4633; 4634; 4635; 4636; 4637; 4638; 4639; 4640; 4641; 4642; 4643; 4644; 4645; 4646; 4647; 4648; 4649; 4650; 4651; 4652; 4653; 4654; 4655; 4656; 4657; 4658; 4659; 4660; 4661; 4662; 4663; 4664; 4665; 4666; 4667; 4668; 4669; 4670; 4671; 4672; 4673; 4674; 4675; 4676; 4677; 4678; 4679; 4680; 4681; 4682; 4683; 4684; 4685; 4686; 4687; 4688; 4689; 4690; 4691; 4692; 4693; 4694; 4695; 4696; 4697; 4698; 4699; 4700; 4701; 4702; 4703; 4704; 4705; 4706; 4707; 4708; 4709; 4710; 4711; 4712; 4713; 4714; 4715; 4716; 4717; 4718; 4719; 4720; 4721; 4722; 4723; 4724; 4725; 4726; 4727; 4728; 4729; 4730; 4731; 4732; 4733; 4734; 4735; 4736; 4737; 4738; 4739; 4740; 4741; 4742; 4743; 4744; 4745; 4746; 4747; 4748; 4749; 4750; 4751; 4752; 4753; 4754; 4755; 4756; 4757; 4758; 4759; 4760; 4761; 4762; 4763; 4764; 4765; 4766; 4767; 4768; 4769; 4770; 4771; 4772; 4773; 4774; 4775; 4776; 4777; 4778; 4779; 4780; 4781; 4782; 4783; 4784; 4785; 4786; 4787; 4788; 4789; 4790; 4791; 4792; 4793; 4794; 4795; 4796; 4797; 4798; 4799; 4800; 4801; 4802; 4803; 4804; 4805; 4806; 4807; 4808; 4809; 4810; 4811; 4812; 4813; 4814; 4815; 4816; 4817; 4818; 4819; 4820; 4821; 4822; 4823; 4824; 4825; 4826; 4827; 4828; 4829; 4830; 4831; 4832; 4833; 4834; 4835; 4836; 4837; 4838; 4839; 4840; 4841; 4842; 4843; 4844; 4845; 4846; 4847; 4848; 4849; 4850; 4851; 4852; 4853; 4854; 4855; 4856; 4857; 4858; 4859; 4860; 4861; 4862; 4863; 4864; 4865; 4866; 4867; 4868; 4869; 4870; 4871; 4872; 4873; 4874; 4875; 4876; 4877; 4878; 4879; 4880; 4881; 4882; 4883; 4884; 4885; 4886; 4887; 4888; 4889; 4890; 4891; 4892; 4893; 4894; 4895; 4896; 4897; 4898; 4899; 4900; 4901; 4902; 4903; 4904; 4905; 4906; 4907; 4908; 4909; 4910; 4911; 4912; 4913; 4914; 4915; 4916; 4917; 4918; 4919; 4920; 4921; 4922; 4923; 4924; 4925; 4926; 4927; 4928; 4929; 4930; 4931; 4932; 4933; 4934; 4935; 4936; 4937; 4938; 4939; 4940; 4941; 4942; 4943; 4944; 4945; 4946; 4947; 4948; 4949; 4950; 4951; 4952; 4953; 4954; 4955; 4956; 4957; 4958; 4959; 4960; 4961; 4962; 4963; 4964; 4965; 4966; 4967; 4968; 4969; 4970; 4971; 4972; 4973; 4974; 4975; 4976; 4977; 4978; 4979; 4980; 4981; 4982; 4983; 4984; 4985; 4986; 4987; 4988; 4989; 4990; 4991; 4992; 4993; 4994; 4995; 4996; 4997; 4998; 4999; 5000; 5001; 5002; 5003; 5004; 5005; 5006; 5007; 5008; 5009; 5010; 5011; 5012; 5013 or a fragment or variant thereof.

As indicated above, in preferred embodiments, the RNA according to the invention may comprise a RNA sequence encoding a signal peptide, said RNA sequence preferably being fused to the RNA sequence encoding the therapeutic protein (in particular a collagenase, growth factor, cytokine, receptor, chaperone or signal transduction inhibitor as defined herein). Said RNA sequence encoding a signal peptide may be comprised in any of the codings sequences (cds) of the RNA constructs described herein.

In a preferred embodiment, the RNA according to the invention comprises at least one coding sequence encoding hsAMELX. Preferably, said RNA sequence comprises or consists of a RNA sequence according to SEQ ID NO: 5008 or a fragment or variant thereof. In a preferred embodiment, said RNA comprises at least one coding sequence encoding hsAMELX fused to a signal peptide as defined herein, preferably the HLA-A2 signal peptide according to SEQ ID NO: 1 or a fragment or variant thereof. Said RNA may preferably comprise a RNA sequence according to SEQ ID NO: 5009 or 5010.

In a preferred embodiment, the RNA according to the invention comprises at least one coding sequence encoding ssAMEL. Preferably, said RNA sequence comprises or consists of a RNA sequence according to SEQ ID NO: 5011 or a fragment or variant thereof. In a preferred embodiment, said RNA comprises at least one coding sequence encoding hsAMELX fused to a signal peptide as defined herein, preferably the HLA-A2 signal peptide according to SEQ ID NO: 1 or a fragment or variant thereof. Said RNA may preferably comprise a RNA sequence according to SEQ ID NO: 5012 or 5013.

The RNA according to the present invention may be prepared using any method known in the art, including synthetic methods such as e.g. solid phase RNA synthesis, as well as in vitro methods, such as RNA in vitro transcription reactions.

As apparent from numeric identifier <223> in the sequence listing, different construct designs were applied. The design of the inventive constructs as shown in the present specification and sequence listing is disclosed in Table B. Each construct as shown in the sequence listing resembles a preferred construct of the invention.

TABLE B

Description of construct design.

| Description Sequence Type | RNA generation |
|---|---|
| Gen4 (Design1) | Gen4 |
| Gen5 (Design2) | Gen5 |
| Gen5plusV1 (Design3) | Gen5 + HSD17B4(V2)-albumin7-A64-N5 |
| Gen5plusV2 (Design4) | Gen5 + HSD17B4(V2)-PSMB3-A64-N5-C30-hSL-N5 |
| Gen5plusV3 (Design5) | Gen5 + HSD17B4(V2)-PSMB3-A63 |
| Gen5plusV4 (Design6) | Gen5 + HSD17B4(V2)-PSMB3-hSL-A63 |
| Gen5plusV5 (Design7) | Gen5 + HSD17B4(V2)-RPS9-A63 |
| Gen5plusV6 (Design8) | Gen5 + HSD17B4(V2)-RPS9-hSL-A63 |
| Gen5plusV7 (Design9) | Gen5 + HSD17B4(V2)-Ndufa1-A63 |
| Gen5plusV8 (Design10) | Gen5 + HSD17B4(V2)-Ndufa1-hSL-A63 |

In a preferred embodiment, HsFGF21, HsMMP1, HsMMP1(1-19,100-469), ColG, HsALB(1-18)_ColG(111-1118), HsALB(1-18)_ColG(1-110)_CS-F_ColG(111-1118), ColH, HsALB(1-18)_ColH(41-1021), HsALB(1-18)_ColH(1-40)_CS-F_ColH(41-1021), HsAMELX, HsAMELX-TRAP, HsAMELX-LRAP, HLA-A2-SP_HsAMELX(17-60), HLA-A2-SP_HsAMELX(17-47,168-191), HsAMELY, HsAMELY-TRAP, HsAMELY-LRAP, HLA-A2-SP_HsAMELY(17-61), HLA-A2-SP_HsAMELY(17-48,169-192), SsAMELX-001-1, SsAMELX-TRAP, SsAMELX-LRAP, HLA-A2-SP_SsAMEL(17-61), HLA-A2-SP_SsAMEL(17-49,167-189), SsAMELX-001-2, SsAMELX-001-3, SsAMELX-002, SsAMELX-003, SsAMELX-004, SsAMELX-201, HsBMP1, HsBMP2, HsBMP4, HsBMP6, HsBMP7, HsCCL7, HsEGF, HsEREG, HsFGF1, HsFGF2, HsFGF7, HsHBEGF, HsHGF, HsHSPA1A, HsHSPA1B, HsHSPA1L, HsHSPA2, HsHSPA4, HsHSPA4L, HsHSPA5, HsHSPA6, HsHSPA7, HsHSPA8, HsHSPA9, HsHSPA12A, HsHSPA12B, HsHSPA13, HsHSPA14, HsHSPH1, HsHYOU1, HsHSP90AA1, HsHSP90AA3P, HsHSP90AB1, HsHSP90B1, HsTRAP1, HsIGF1, HsIGF2, HsIL6, HsINHBA, HsINHBB, HsITGAM, HsMMP8, HsMMP9, HsMMP13, HsCCR1, HsPDGFA, HsPDGFB, HsPDGFC, HsPDGFD, HsSOCS3, HsTGFA, HsTGFB1, HsTGFB2, HsTGFB3, HsTNFRSF1B, HsPGF, HsVEGFA, HsVEGFB, HsVEGFC, HsVEGFD, EMCV-IRES, SsAMEL, ColG(111-1118), ColG(1-110)_CS-F_ColG(111-1118), ColH(41-1021), ColH(1-40)_CS-F_ColH(41-1021), Ndufa1 3'-UTR, PSMB3 3'-UTR, RPS9 3'-UTR, HsFGF21(L126R,P199G, A208E), MmHGF, HsHMGB1, MmVEGFA, ntGFP comprise a construct design selected from the group consisting of Design1, Design2, Design3, Design4, Design5, Design6, Design7, Design8, Design9, and Design10 as mentioned in Table B and as apparent from numeric identifier <223> in the sequence listing.

Combinations

In a further aspect, the present invention relates to a combination comprising (1) at least one RNA comprising at least one coding sequence encoding a collagenase as defined herein, preferably selected from MMP1; ColG; ColH; ColG/ColH mixture (i.e. a 1:1 mixture of ColG and ColH mRNAs or a mixture in another ratio other than 1:1), MMP8; MMP9; or MMP13 or a fragment or variant thereof; and more preferably from MMP1; ColG or ColH or a fragment or variant thereof, and (2) at least one RNA comprising at least one coding sequence encoding a growth factor selected from AMELX; AMELY; ssAMELX; ssAMELX-001-1; ssAMELX-001-2; ssAMELX-002; ssAMELX-003; ssAMELX-004; ssAMELX-201; BMP1; BMP2; BMP4; BMP6; BMP7; EGF; EREG; FGF1; FGF2; FGF7; FGF21; HBEGF; HGF; IGF1; IGF2; INHBA; INHBB; PDGFA; PDGFB; PDGFC; PDGFD; TGFA; TGFB1; TGFB2; TGFB3; PGF; VEGFA; VEGFA; VEGFB; VEGFC or VEGFD or a fragment or variant thereof; a cytokine selected from IL6 or CCL7 or a fragment or variant thereof; a receptor is selected from ITGAM, CCR1 or TNFRSF1B or a fragment or variant thereof; a chaperone selected from HSPA1A; HSPA1B; HSPA1L; HSPA2; HSPA4; HSPA4L; HSPA5; HSPA6; HSPA7; HSPA8; HSPA9; HSPA12A; HSPA12B; HSPA13; HSPA14; HSPH1; HSP90AA1; HSP90AA3P; HSP90AB1; HSP90131; HYOU1 or TRAP1 or a fragment or variant thereof; or a signal transduction inhibitor is selected from SOCS3 or a fragment or variant thereof.

In another embodiment, different RNAs comprising different coding sequences of the invention are applied in different stages or phases of the wound healing process, f.e. a different mRNA is applied in each of phase i) inflammation, phase ii) granulation formation, and/or phase iii) matrix formation and remodelling.

Pharmaceutical Composition

In a further aspect, the present invention concerns a pharmaceutical composition comprising the RNA comprising at least one coding sequence as defined herein and a pharmaceutically acceptable carrier. The composition according to the invention is preferably provided as a pharmaceutical composition.

RNAs

According to a preferred embodiment, the (pharmaceutical) composition according to the invention comprises the RNA of the present invention, wherein the at least one coding sequence of the RNA encodes any one of the therapeutic proteins (in particular collagenases, growth factors, cytokines, receptors, chaperones or signal transduction inhibitors as defined herein) as defined in Table 1, preferably as defined in the first ("Gene Name"), second ("Protein Accession No.") or third column ("A") of Table 1, or a fragment or variant of any one of these therapeutic proteins (in particular collagenases, growth factors, cytokines, receptors, chaperones or signal transduction inhibitors as defined herein).

Preferably, the (pharmaceutical) composition according to the invention comprises the RNA of the present invention, wherein the at least one coding sequence of the RNA comprises or consists of a nucleic acid sequence encoding a therapeutic protein (in particular a collagenase, growth factor, cytokine, receptor, chaperone or signal transduction inhibitor as defined herein), or a fragment or variant of a therapeutic protein (in particular a collagenase, growth factor, cytokine, receptor, chaperone or signal transduction inhibitor as defined herein), wherein the therapeutic protein (in particular a collagenase, growth factor, cytokine, receptor, chaperone or signal transduction inhibitor as defined herein) preferably comprises or consists of any one of the amino acid sequences defined in Table 1 herein, preferably in the third column (column "A") of Table 1, or a fragment or variant of any one of these sequences.

Preferably, the (pharmaceutical) composition according to the invention comprises the RNA of the present invention, wherein the at least one coding sequence of the RNA comprises or consists of a nucleic acid sequence encoding a therapeutic protein (in particular a collagenase, growth factor, cytokine, receptor, chaperone or signal transduction inhibitor as defined herein), or a fragment or variant of a therapeutic protein (in particular a collagenase, growth factor, cytokine, receptor, chaperone or signal transduction inhibitor as defined herein), wherein the therapeutic protein (in particular a collagenase, growth factor, cytokine, receptor, chaperone or signal transduction inhibitor as defined herein) preferably comprises or consists of an amino acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the amino acid sequences defined in Table 1 herein, preferably in the third column (column "A") of Table 1, or a fragment or variant of any one of these sequences.

More preferably, the (pharmaceutical) composition according to the invention comprises the RNA of the present invention, wherein the at least one coding sequence of the RNA comprises or consists of a nucleic acid sequence encoding a therapeutic protein (in particular a collagenase, growth factor, cytokine, receptor, chaperone or signal transduction inhibitor as defined herein), or a fragment or variant of a therapeutic protein (in particular a collagenase, growth factor, cytokine, receptor, chaperone or signal transduction inhibitor as defined herein), wherein the therapeutic protein (in particular a collagenase, growth factor, cytokine, receptor, chaperone or signal transduction inhibitor as defined herein) preferably comprises or consists of an amino acid sequence having a sequence identity of at least 80% with any one of the amino acid sequences defined in Table 1 herein, preferably in the third column (column "A") of Table 1, or a fragment or variant of any one of these sequences.

In preferred embodiments, the (pharmaceutical) composition according to the invention comprises the RNA of the present invention, wherein the at least one coding sequence of the RNA comprises or consists of any one of the nucleic acid sequences defined in Table 1, preferably in the fourth or fifth column (column "B" or "C", respectively) of Table 1, or a fragment or variant of any one of these sequences.

According to another embodiment, the (pharmaceutical) composition according to the invention comprises the RNA of the present invention, wherein the at least one coding sequence of the RNA comprises or consists of a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the nucleic acid sequences defined in Table 1, preferably in the fourth or fifth column (column "B" or "C", respectively) of Table 1, or a fragment or variant of any one of these sequences.

According to a particularly preferred embodiment, the (pharmaceutical) composition according to the invention comprises the RNA of the present invention, wherein the at least one coding sequence of the RNA comprises or consists of a nucleic acid sequence having a sequence identity of at least 80% with any one of the nucleic acid sequences defined in Table 1, preferably in the fourth or fifth column (column "B" or "C", respectively) of Table 1, or a fragment or variant of any one of these sequences.

More preferably, the (pharmaceutical) composition according to the invention comprises the RNA of the present invention, wherein the at least one coding sequence of the RNA comprises or consists of any one of the nucleic acid sequences defined in the fifth column ("C") of Table 1, or a fragment or variant of any one of these sequences.

According to a further embodiment, the (pharmaceutical) composition according to the invention comprises the RNA of the present invention, wherein the at least one coding sequence of the RNA comprises or consists of a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the nucleic acid sequences defined in the fifth column ("C") of Table 1, or a fragment or variant of any one of these sequences.

According to a particularly preferred embodiment, the (pharmaceutical) composition according to the invention comprises the RNA of the present invention, wherein the at least one coding sequence of the RNA comprises or consists of a nucleic acid sequence having a sequence identity of at least 80% with any one of the nucleic acid sequences defined in the fifth column ("C") of Table 1, or a fragment or variant of any one of these sequences.

In the context of the present invention, the (pharmaceutical) composition may encode one or more of the therapeutic proteins (in particular collagenases, growth factors, cytokines, receptors, chaperones or signal transduction inhibitors as defined herein) defined herein or a fragment or variant thereof.

The (pharmaceutical) composition according to the invention may thus comprise the RNA of the present invention, wherein the RNA encodes one specific therapeutic protein (in particular a collagenase, growth factor, cytokine, receptor, chaperone or signal transduction inhibitor as defined herein) of the therapeutic proteins defined herein or a fragment or a variant thereof. In that embodiment, the (pharmaceutical) composition preferably comprises the RNA according to the invention comprising the at least one coding sequence as defined herein encoding the therapeutic protein (in particular a collagenase, growth factor, cytokine, receptor, chaperone or signal transduction inhibitor as defined herein) or a fragment or variant thereof.

Alternatively, the (pharmaceutical) composition of the present invention may comprise at least one RNA according to the invention, wherein the at least one RNA encodes at least two, three, four, five, six, seven, eight, nine, ten, eleven or twelve distinct therapeutic proteins (in particular collagenases, growth factors, cytokines, receptors, chaperones or signal transduction inhibitors as defined herein) as defined herein or a fragment or variant thereof. Preferably, the (pharmaceutical) composition comprises several classes of the RNA according to the invention, wherein each RNA species encodes one of the therapeutic proteins (in particular collagenases, growth factors, cytokines, receptors, chaperones or signal transduction inhibitors as defined herein) or a fragment or variant thereof. In another embodiment, the RNA comprised in the (pharmaceutical) composition is a bi- or multicistronic RNA as defined herein, which encodes the at least two, three, four, five, six, seven, eight, nine, ten, eleven or twelve distinct therapeutic proteins (in particular collagenases, growth factors, cytokines, receptors, chaperones or signal transduction inhibitors as defined herein). Mixtures between these embodiments are also envisaged, such as compositions comprising more than one RNA species, wherein at least one RNA species may be monocistronic, while at least one other RNA species may be bi- or multicistronic.

The (pharmaceutical) composition according to the present invention, preferably the at least one coding sequence of the RNA comprised therein, may thus comprise any combination of the nucleic acid sequences as defined herein.

In a preferred embodiment of the composition according to the invention, the RNA is complexed with one or more cationic or polycationic compounds, preferably with cationic or polycationic polymers, cationic or polycationic peptides or proteins, e.g. protamine, cationic or polycationic polysaccharides and/or cationic or polycationic lipids.

According to a preferred embodiment, the RNA of the composition according to the present invention may be complexed with lipids to form one or more liposomes, lipoplexes, or lipid nanoparticles. Therefore, in one embodiment, the inventive composition comprises liposomes, lipoplexes, and/or lipid nanoparticles comprising the at least one mRNA.

Lipid Carriers

Lipid-based formulations have been increasingly recognized as one of the most promising delivery systems for RNA due to their biocompatibility and their ease of large-scale production. Cationic lipids have been widely studied as synthetic materials for delivery of RNA. After mixing together, nucleic acids are condensed by cationic lipids to form lipid/nucleic acid complexes known as lipoplexes. These lipid complexes are able to protect genetic material from the action of nucleases and deliver it into cells by interacting with the negatively charged cell membrane. Lipoplexes can be prepared by directly mixing positively charged lipids at physiological pH with negatively charged nucleic acids.

Conventional liposomes consist of a lipid bilayer that can be composed of cationic, anionic, or neutral (phospho)lipids and cholesterol, which encloses an aqueous core. Both the lipid bilayer and the aqueous space can incorporate hydrophobic or hydrophilic compounds, respectively. Liposome characteristics and behaviour in vivo can be modified by addition of a hydrophilic polymer coating, e.g. polyethylene glycol (PEG), to the liposome surface to confer steric stabilization. Furthermore, liposomes can be used for specific targeting by attaching ligands (e.g., antibodies, peptides, and carbohydrates) to its surface or to the terminal end of the attached PEG chains (Front Pharmacol. 2015 Dec. 1; 6:286).

Liposomes are colloidal lipid-based and surfactant-based delivery systems composed of a phospholipid bilayer surrounding an aqueous compartment. They may present as spherical vesicles and can range in size from 20 nm to a few microns. Cationic lipid-based liposomes are able to complex with negatively charged nucleic acids via electrostatic interactions, resulting in complexes that offer biocompatibility, low toxicity, and the possibility of the large-scale production required for in vivo clinical applications. Liposomes can fuse with the plasma membrane for uptake; once inside the cell, the liposomes are processed via the endocytic pathway and the genetic material is then released from the endosome/carrier into the cytoplasm. Liposomes have long been perceived as drug delivery vehicles because of their superior biocompatibility, given that liposomes are basically analogs of biological membranes, and can be prepared from both natural and synthetic phospholipids (Int J Nanomedicine. 2014; 9: 1833-1843).

Cationic liposomes have been traditionally the most commonly used non-viral delivery systems for oligonucleotides, including plasmid DNA, antisense oligos, and siRNA/small hairpin RNA-shRNA). Cationic lipids, such as DOTAP, (1,2-dioleoyl-3-trimethylammonium-propane) and DOTMA (N-[1-(2,3-dioleoyloxy)propyl]-N,N,N-trimethyl-ammonium methyl sulfate) can form complexes or lipoplexes with negatively charged nucleic acids to form nanoparticles by electrostatic interaction, providing high in vitro transfection efficiency. Furthermore, neutral lipid-based nanoliposomes for RNA delivery as e.g. neutral 1,2-dioleoyl-sn-glycero-3-phosphatidylcholine (DOPC)-based nanoliposomes were developed. (Adv Drug Deliv Rev. 2014 February; 66: 110-116.).

Therefore, in one embodiment the RNA of the composition according to the present invention is complexed with cationic lipids and/or neutral lipids and thereby forms liposomes, lipid nanoparticles, lipoplexes or neutral lipid-based nanoliposomes.

Poly-Cationic Compounds or Carriers

In a preferred embodiment, the composition according to the invention comprises the RNA according to the invention that is formulated together with a cationic or polycationic compound and/or with a polymeric carrier. Accordingly, in a further embodiment of the invention, it is preferred that the RNA as defined herein or any other nucleic acid comprised in the inventive (pharmaceutical) composition is associated with or complexed with a cationic or polycationic compound or a polymeric carrier, optionally in a weight ratio selected from a range of about 6:1 (w/w) to about 0.25:1 (w/w), more preferably from about 5:1 (w/w) to about 0.5:1 (w/w), even more preferably of about 4:1 (w/w) to about 1:1 (w/w) or of about 3:1 (w/w) to about 1:1 (w/w), and most preferably a ratio of about 3:1 (w/w) to about 2:1 (w/w) of mRNA or nucleic acid to cationic or polycationic compound and/or with a polymeric carrier; or optionally in a nitrogen/phosphate (N/P) ratio of mRNA or nucleic acid to cationic or polycationic compound and/or polymeric carrier in the range of about 0.1-10, preferably in a range of about 0.3-4 or 0.3-1, and most preferably in a range of about 0.5-1 or 0.7-1, and even most preferably in a range of about 0.3-0.9 or 0.5-0.9. More preferably, the N/P ratio of the at least one mRNA to the one or more polycations is in the range of about 0.1 to 10, including a range of about 0.3 to 4, of about 0.5 to 2, of about 0.7 to 2 and of about 0.7 to 1.5.

Therein, the RNA as defined herein or any other nucleic acid comprised in the (pharmaceutical) composition according to the invention can also be associated with a vehicle, transfection or complexation agent for increasing the transfection efficiency and/or the expression of the RNA according to the invention or of optionally comprised further included nucleic acids.

Compounds

Cationic or polycationic compounds, being particularly preferred agents in this context include protamine, nucleoline, spermine or spermidine, or other cationic peptides or proteins, such as poly-L-lysine (PLL), poly-arginine, basic polypeptides, cell penetrating peptides (CPPs), including HIV-binding peptides, HIV-1 Tat (HIV), Tat-derived peptides, Penetratin, VP22 derived or analog peptides, HSV VP22 (Herpes simplex), MAP, KALA or protein transduction domains (PTDs), PpT620, prolin-rich peptides, arginine-rich peptides, lysine-rich peptides, MPG-peptide(s), Pep-1, L-oligomers, Calcitonin peptide(s), Antennapedia-derived peptides (particularly from *Drosophila* antennapedia), pAntp, pIsl, FGF, Lactoferrin, Transportan, Buforin-2, Bac715-24, SynB, SynB(1), pVEC, hCT-derived peptides, SAP, or histones. More preferably, the RNA according to the invention is complexed with one or more polycations, preferably with protamine or oligofectamine, most preferably with protamine. In this context protamine is particularly preferred.

Additionally, preferred cationic or polycationic proteins or peptides may be selected from the following proteins or peptides having the following total formula (III):

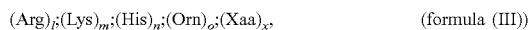

$(Arg)_l;(Lys)_m;(His)_n;(Orn)_o;(Xaa)_x$, (formula (III))

wherein l+m+n+o+x=8-15, and l, m, n or o independently of each other may be any number selected from 0, 1, 2, 3, 4, 5, 6, 7, 8, 9, 10, 11, 12, 13, 14 or 15, provided that the overall content of Arg, Lys, His and Orn represent at least 50% of all amino acids of the oligopeptide; and Xaa may be any amino acid selected from native (=naturally occurring) or non-native amino acids except of Arg, Lys, His or Orn; and x may be any number selected from 0, 1, 2, 3 or 4, provided, that the overall content of Xaa does not exceed 50% of all amino acids of the oligopeptide. Particularly preferred cationic peptides in this context are e.g. $Arg_7$, $Arg_8$, $Arg_9$, $H_3R_9$, $R_9H_3$, $H_3R_9H_3$, $YSSR_9SSY$, $(RKH)_4$, $Y(RKH)_2R$, etc. In this context the disclosure of WO2009/030481 is incorporated herewith by reference.

Cationic or Polycationic Compounds:

Further preferred cationic or polycationic compounds, which can be used as transfection or complexation agent may include cationic polysaccharides, for example chitosan, polybrene, cationic polymers, e.g. polyethyleneimine (PEI), cationic lipids, e.g. DOTMA: [1-(2,3-sioleyloxy)propyl)]-N,N,N-trimethylammonium chloride, DMRIE, di-C14-amidine, DOTIM, SAINT, DC-Chol, BGTC, CTAP, DOPC, DODAP, DOPE: Dioleyl phosphatidylethanol-amine, DOSPA, DODAB, DOIC, DMEPC, DOGS: Dioctadecylamidoglicylspermin, DIMRI: Dimyristo-oxypropyl dimethyl hydroxyethyl ammonium bromide, DOTAP: dioleoyloxy-3-(trimethylammonio)propane, DC-6-14: 0,0-ditetradecanoyl-N-(α-trimethylammon ioacetyl)d iethanolamine chloride, CLIP1: rac-[(2,3-dioctadecyloxypropyl)(2-hyd roxyethyl)]-d imethyla mmon i u m chloride, CLIP6: rac-[2(2,3-dihexadecyloxypropyl-oxymethyloxy)ethyl]trimethylammonium, CLIP9: rac-[2(2,3-dihexadecyloxypropyl-oxysuccinyloxy)ethyl]-trimethylammonium, oligofectamine, or cationic or polycationic polymers, e.g. modified polyaminoacids, such as β-aminoacid-polymers or reversed polyamides, etc., modified polyethylenes, such as PVP (poly(N-ethyl-4-vinylpyridinium bromide)), etc., modified acrylates, such as pDMAEMA (poly(dimethylaminoethyl methylacrylate)), etc., modified amidoamines such as pAMAM (poly(amidoamine)), etc., modified polybetaaminoester (PBAE), such as diamine end modified 1,4 butanediol diacrylate-co-5-amino-1-pentanol polymers, etc., dendrimers, such as polypropylamine dendrimers or pAMAM based dendrimers, etc., polyimine(s), such as PEI: poly(ethyleneimine), poly(propyleneimine), etc., polyallylamine, sugar backbone based polymers, such as cyclodextrin based polymers, dextran based polymers, chitosan, etc., silan backbone based polymers, such as PMOXA-PDMS copolymers, etc., blockpolymers consisting of a combination of one or more cationic blocks (e.g. selected from a cationic polymer as mentioned above) and of one or more hydrophilic or hydrophobic blocks (e.g. polyethyleneglycole); etc.

Polymeric Carriers:

According to a preferred embodiment, the composition of the present invention comprises the RNA as defined herein and a polymeric carrier. A polymeric carrier used according to the invention might be a polymeric carrier formed by disulfide-crosslinked cationic components. The disulfide-crosslinked cationic components may be the same or different from each other. The polymeric carrier can also contain further components. It is also particularly preferred that the polymeric carrier used according to the present invention comprises mixtures of cationic peptides, proteins or polymers and optionally further components as defined herein, which are crosslinked by disulfide bonds as described herein. In this context, the disclosure of WO2012/013326 is incorporated herewith by reference.

In this context, the cationic components, which form basis for the polymeric carrier by disulfide-crosslinkage, are typically selected from any suitable cationic or polycationic peptide, protein or polymer suitable for this purpose, particular any cationic or polycationic peptide, protein or polymer capable of complexing the RNA as defined herein or a further nucleic acid comprised in the composition, and thereby preferably condensing the RNA or the nucleic acid.

The cationic or polycationic peptide, protein or polymer, is preferably a linear molecule, however, branched cationic or polycationic peptides, proteins or polymers may also be used.

Every disulfide-crosslinking cationic or polycationic protein, peptide or polymer of the polymeric carrier, which may be used to complex the RNA according to the invention or any further nucleic acid comprised in the (pharmaceutical) composition of the present invention contains at least one —SH-moiety, most preferably at least one cysteine residue or any further chemical group exhibiting an —SH-moiety, capable of forming a disulfide linkage upon condensation with at least one further cationic or polycationic protein, peptide or polymer as cationic component of the polymeric carrier as mentioned herein.

As defined above, the polymeric carrier, which may be used to complex the RNA of the present invention or any further nucleic acid comprised in the (pharmaceutical) composition according to the invention may be formed by disulfide-crosslinked cationic (or polycationic) components. Preferably, such cationic or polycationic peptides or proteins or polymers of the polymeric carrier, which comprise or are additionally modified to comprise at least one —SH-moiety, are selected from, proteins, peptides and polymers as defined herein for complexation agent.

In a further particular embodiment, the polymeric carrier which may be used to complex the RNA as defined herein or any further nucleic acid comprised in the (pharmaceutical) composition according to the invention may be selected from a polymeric carrier molecule according to generic formula (IV):

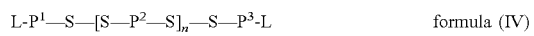

$L-P^1—S—[S—P^2—S]_n—S—P^3-L$ formula (IV)

wherein,
$P^1$ and $P^3$ are different or identical to each other and represent a linear or branched hydrophilic polymer chain, each $P^1$ and $P^3$ exhibiting at least one —SH-moiety, capable to form a disulfide linkage upon condensation with component $P^2$, or alternatively with (AA), $(AA)_x$, or $[(AA)_x]_z$ if such components are used as a linker between $P^1$ and $P^2$ or $P^3$ and $P^2$) and/or with further components (e.g. (AA), (AA)$_x$, [(AA)$_x$]$_z$ or L), the linear or branched hydrophilic polymer chain selected independent from each other from polyethylene glycol (PEG), poly-N-(2-hydroxypropyl)methacrylamide, poly-2-(methacryloyloxy)ethyl phosphorylcholines, poly(hydroxyalkyl L-asparagine), poly(2-(methacryloyloxy)ethyl phosphorylcholine), hydroxyethylstarch or poly(hydroxyalkyl L-glutamine), wherein the hydrophilic polymer chain exhibits a molecular weight of about 1 kDa to about 100 kDa, preferably of about 2 kDa to about 25 kDa; or more preferably of about 2 kDa to about 10 kDa, e.g. about 5 kDa to about 25 kDa or 5 kDa to about 10 kDa;

P$^2$ is a cationic or polycationic peptide or protein, e.g. as defined above for the polymeric carrier formed by disulfide-crosslinked cationic components, and preferably having a length of about 3 to about 100 amino acids, more preferably having a length of about 3 to about 50 amino acids, even more preferably having a length of about 3 to about 25 amino acids, e.g. a length of about 3 to 10, 5 to 15, 10 to 20 or 15 to 25 amino acids, more preferably a length of about 5 to about 20 and even more preferably a length of about 10 to about 20; or is a cationic or polycationic polymer, e.g. as defined above for the polymeric carrier formed by disulfide-crosslinked cationic components, typically having a molecular weight of about 0.5 kDa to about 30 kDa, including a molecular weight of about 1 kDa to about 20 kDa, even more preferably of about 1.5 kDa to about 10 kDa, or having a molecular weight of about 0.5 kDa to about 100 kDa, including a molecular weight of about 10 kDa to about 50 kDa, even more preferably of about 10 kDa to about 30 kDa;

each P$^2$ exhibiting at least two —SH-moieties, capable to form a disulfide linkage upon condensation with further components P$^2$ or component(s) P$^1$ and/or P$^3$ or alternatively with further components (e.g. (AA), (AA)$_x$, or [(AA)$_x$]$_z$);

—S—S— is a (reversible) disulfide bond (the brackets are omitted for better readability), wherein S preferably represents sulphur or a —SH carrying moiety, which has formed a (reversible) disulfide bond. The (reversible) disulfide bond is preferably formed by condensation of —SH-moieties of either components P$^1$ and P$^2$, P$^2$ and P$^2$, or P$^2$ and P$^3$, or optionally of further components as defined herein (e.g. L, (AA), (AA)$_x$, [(AA)$_x$]$_z$, etc); The —SH-moiety may be part of the structure of these components or added by a modification as defined below;

L is an optional ligand, which may be present or not, and may be selected independent from the other from RGD, Transferrin, Folate, a signal peptide or signal sequence, a localization signal or sequence, a nuclear localization signal or sequence (NLS), an antibody, a cell penetrating peptide, (e.g. TAT or KALA), a ligand of a receptor (e.g. cytokines, hormones, growth factors etc), small molecules (e.g. carbohydrates like mannose or galactose or synthetic ligands), small molecule agonists, inhibitors or antagonists of receptors (e.g. RGD peptidomimetic analogues), or any further protein as defined herein, etc.;

n is an integer, typically selected from a range of about 1 to 50, preferably from a range of about 1, 2 or 3 to 30, more preferably from a range of about 1, 2, 3, 4, or 5 to 25, or a range of about 1, 2, 3, 4, or 5 to 20, or a range of about 1, 2, 3, 4, or 5 to 15, or a range of about 1, 2, 3, 4, or 5 to 10, including e.g. a range of about 4 to 9, 4 to 10, 3 to 20, 4 to 20, 5 to 20, or 10 to 20, or a range of about 3 to 15, 4 to 15, 5 to 15, or 10 to 15, or a range of about 6 to 11 or 7 to 10. Most preferably, n is in a range of about 1, 2, 3, 4, or 5 to 10, more preferably in a range of about 1, 2, 3, or 4 to 9, in a range of about 1, 2, 3, or 4 to 8, or in a range of about 1, 2, or 3 to 7.

In this context, the disclosure of WO2011/026641 is incorporated herewith by reference. Each of hydrophilic polymers P$^1$ and P$^3$ typically exhibits at least one —SH-moiety, wherein the at least one —SH-moiety is capable to form a disulfide linkage upon reaction with component P$^2$ or with component (AA) or (AA)$_x$, if used as linker between P$^1$ and P$^2$ or P$^3$ and P$^2$ as defined below and optionally with a further component, e.g. L and/or (AA) or (AA)$_x$, e.g. if two or more —SH-moieties are contained. The following subformulae "P$^1$—S—S—P$^2$" and "P$^2$—S—S—P$^3$" within generic formula (IV) above (the brackets are omitted for better readability), wherein any of S, P$^1$ and P$^3$ are as defined herein, typically represent a situation, wherein one-SH-moiety of hydrophilic polymers P$^1$ and P$^3$ was condensed with one —SH-moiety of component P$^2$ of generic formula (IV) above, wherein both sulphurs of these —SH-moieties form a disulfide bond —S—S— as defined herein in formula (IV). These —SH-moieties are typically provided by each of the hydrophilic polymers P$^1$ and P$^3$, e.g. via an internal cysteine or any further (modified) amino acid or compound which carries a —SH-moiety. Accordingly, the subformulae "P$^1$—S—S—P$^2$" and "P$^2$—S—S—P$^3$" may also be written as "P$^1$-Cys-Cys-P$^2$" and "P$^2$-Cys-Cys-P$^3$", if the —SH-moiety is provided by a cysteine, wherein the term "Cys-Cys" represents two cysteines coupled via a disulfide bond, not via a peptide bond. In this case, the term "—S—S—" in these formulae may also be written as "—S-Cys", as "-Cys-S" or as "-Cys-Cys-". In this context, the term "-Cys-Cys-" does not represent a peptide bond but a linkage of two cysteines via their —SH-moieties to form a disulfide bond. Accordingly, the term "-Cys-Cys-" also may be understood generally as "-(Cys-S)—(S-Cys)-", wherein in this specific case S indicates the sulphur of the —SH-moiety of cysteine. Likewise, the terms "—S-Cys" and "—Cys-S" indicate a disulfide bond between a —SH containing moiety and a cysteine, which may also be written as "—S—(S-Cys)" and "-(Cys-S)—S". Alternatively, the hydrophilic polymers P$^1$ and P$^3$ may be modified with a —SH-moiety, preferably via a chemical reaction with a compound carrying a —SH-moiety, such that each of the hydrophilic polymers P$^1$ and P$^3$ carries at least one such —SH-moiety. Such a compound carrying a —SH-moiety may be e.g. an (additional) cysteine or any further (modified) amino acid, which carries a —SH-moiety. Such a compound may also be any non-amino compound or moiety, which contains or allows to introduce a —SH-moiety into hydrophilic polymers P' and P$^3$ as defined herein. Such non-amino compounds may be attached to the hydrophilic polymers P' and P$^3$ of formula (IV) of the polymeric carrier according to the present invention via chemical reactions or binding of compounds, e.g. by binding of a 3-thio propionic acid or thioimolane, by amide formation (e.g. carboxylic acids, sulphonic acids, amines, etc), by Michael addition (e.g maleinimide moieties, α,β-unsatured carbonyls, etc), by click chemistry (e.g. azides or alkines), by alkene/alkine methatesis (e.g. alkenes or alkines), imine or hydrozone formation (aldehydes or ketons, hydrazins, hydroxylamins, amines), complexation reactions (avidin, biotin, protein G) or components which allow S-type substitution reactions (e.g halogenalkans, thiols, alcohols, amines, hydrazines, hydrazides, sulphonic acid esters, oxyphosphonium salts) or other chemical moieties which can be utilized in the attachment of further components. A particularly preferred PEG derivate in this context is alpha-Methoxy-omega-mercapto poly(ethylene glycol). In each case, the SH-moiety, e.g. of a cysteine or of any further (modified) amino acid or compound, may be present at the terminal ends or internally at any position of hydrophilic polymers P' and $P^3$. As defined herein, each of hydrophilic polymers P' and $P^3$ typically exhibits at least one —SH-moiety preferably at one terminal end, but may also contain two or even more —SH-moieties, which may be used to additionally attach further components as defined herein, preferably further functional peptides or proteins e.g. a ligand, an amino acid component (AA) or $(AA)_x$, antibodies, cell penetrating peptides or enhancer peptides (e.g. TAT, KALA), etc.

Weight Ratio and N/P Ratio:

The inventive composition may comprise at least one RNA as defined herein, which is complexed with one or more polycations, and at least one free RNA, wherein the at least one complexed RNA is preferably identical to the at least one free RNA. In this context, it is particularly preferred that the composition of the present invention comprises the RNA according to the invention that is complexed at least partially with a cationic or polycationic compound and/or a polymeric carrier, preferably cationic proteins or peptides. In this context, the disclosure of WO2010/037539 and WO2012/113513 is incorporated herewith by reference. Partially means that only a part of the RNA as defined herein is complexed in the composition according to the invention with a cationic compound and that the rest of the RNA as defined herein is (comprised in the inventive (pharmaceutical) composition) in uncomplexed form ("free"). Preferably, the molar ratio of the complexed RNA to the free RNA is selected from a molar ratio of about 0.001:1 to about 1:0.001, including a ratio of about 1:1. More preferably the ratio of complexed RNA to free RNA (in the (pharmaceutical) composition of the present invention) is selected from a range of about 5:1 (w/w) to about 1:10 (w/w), more preferably from a range of about 4:1 (w/w) to about 1:8 (w/w), even more preferably from a range of about 3:1 (w/w) to about 1:5 (w/w) or 1:3 (w/w), and most preferably the ratio of complexed mRNA to free mRNA in the inventive pharmaceutical composition is selected from a ratio of about 1:1 (w/w).

The complexed RNA in the (pharmaceutical) composition according to the present invention, is preferably prepared according to a first step by complexing the RNA according to the invention with a cationic or polycationic compound and/or with a polymeric carrier, preferably as defined herein, in a specific ratio to form a stable complex. In this context, it is highly preferable, that no free cationic or polycationic compound or polymeric carrier or only a negligibly small amount thereof remains in the component of the complexed RNA after complexing the RNA. Accordingly, the ratio of the RNA and the cationic or polycationic compound and/or the polymeric carrier in the component of the complexed RNA is typically selected in a range so that the RNA is entirely complexed and no free cationic or polycationic compound or polymeric carrier or only a negligibly small amount thereof remains in the composition.

Preferably the ratio of the RNA as defined herein to the cationic or polycationic compound and/or the polymeric carrier, preferably as defined herein, is selected from a range of about 6:1 (w/w) to about 0.25:1 (w/w), more preferably from about 5:1 (w/w) to about 0.5:1 (w/w), even more preferably of about 4:1 (w/w) to about 1:1 (w/w) or of about 3:1 (w/w) to about 1:1 (w/w), and most preferably a ratio of about 3:1 (w/w) to about 2:1 (w/w). Alternatively, the ratio of the RNA as defined herein to the cationic or polycationic compound and/or the polymeric carrier, preferably as defined herein, in the component of the complexed mRNA, may also be calculated on the basis of the nitrogen/phosphate ratio (N/P-ratio) of the entire complex. In the context of the present invention, an N/P-ratio is preferably in the range of about 0.1-10, preferably in a range of about 0.3-4 and most preferably in a range of about 0.5-2 or 0.7-2 regarding the ratio of RNA: cationic or polycationic compound and/or polymeric carrier, preferably as defined herein, in the complex, and most preferably in a range of about 0.7-1.5, 0.5-1 or 0.7-1, and even most preferably in a range of about 0.3-0.9 or 0.5-0.9, preferably provided that the cationic or polycationic compound in the complex is a cationic or polycationic cationic or polycationic protein or peptide and/or the polymeric carrier as defined above.

In other embodiments, the composition according to the invention comprising the RNA as defined herein may be administered naked without being associated with any further vehicle, transfection or complexation agent.

It has to be understood and recognized, that according to the present invention, the inventive composition may comprise at least one naked RNA as defined herein, preferably an mRNA, and/or at least one formulated/complexed RNA as defined herein, preferably an mRNA, wherein every formulation and/or complexation as disclosed above may be used.

In embodiments, wherein the (pharmaceutical) composition comprises more than one RNA species, these RNA species may be provided such that, for example, two, three, four, five or six separate compositions, which may contain at least one RNA species each (e.g. three distinct mRNA species), each encoding distinct therapeutic proteins (in particular collagenases, growth factors, cytokines, receptors, chaperones or signal transduction inhibitors as defined herein) or a fragment or variant thereof as, are provided, which may or may not be combined. Also, the (pharmaceutical) composition may be a combination of at least two distinct compositions, each composition comprising at least one mRNA encoding at least one of the therapeutic proteins defined herein. Alternatively, the (pharmaceutical) composition may be provided as a combination of at least one mRNA, preferably at least two, three, four, five, six or more mRNAs, each encoding one of the therapeutic proteins defined herein. The (pharmaceutical) composition may be combined to provide one single composition prior to its use or it may be used such that more than one administration is required to administer the distinct mRNA species encoding a certain combination of the proteins as defined herein. If the (pharmaceutical) composition contains at least one mRNA molecule, typically at least two mRNA molecules, encoding of a combination of therapeutic proteins (in particular collagenases, growth factors, cytokines, receptors, chaperones or signal transduction inhibitors as defined herein), it may e.g. be administered by one single administration (combining all mRNA species), by at least two separate administrations. Accordingly; any combination of mono-, bi- or multicistronic mRNAs encoding the at least one therapeutic proteins (in particular collagenases, growth factors, cytokines, receptors, chaperones or signal transduction inhibitors as defined herein) or any combination of therapeutic proteins as defined herein (and optionally further proteins), provided as separate entities (containing one mRNA species) or as combined entity (containing more than one mRNA species), is understood as a (pharmaceutical) composition according to the present invention. According to a particularly preferred embodiment of the (pharmaceutical) composition, the at least one therapeutic protein, preferably a combination of at least two, three, four, five, six or more therapeutic proteins encoded by the (pharmaceutical) composition as a whole, is provided as an individual (monocistronic) mRNA, which is administered separately.

The (pharmaceutical) composition typically comprises a safe and effective amount of the RNA according to the invention as defined herein, encoding a therapeutic protein as defined herein or a fragment or variant thereof or a combination of therapeutic proteins, preferably as defined herein. As used herein, "safe and effective amount" means an amount of the RNA that is sufficient to significantly induce a positive modification of a disease or disorder as defined herein. At the same time, however, a "safe and effective amount" is small enough to avoid serious side-effects, that is to say to permit a sensible relationship between advantage and risk. The determination of these limits typically lies within the scope of sensible medical judgment. In relation to the (pharmaceutical) composition of the present invention, the expression "safe and effective amount" preferably means an amount of the RNA (and thus of the encoded therapeutic protein) that is suitable for obtaining an appropriate expression level of the encoded protein(s). Such a "safe and effective amount of the RNA of the (pharmaceutical) composition as defined herein may furthermore be selected in dependence of the type of RNA, e.g. monocistronic, bi- or even multicistronic RNA, since a bi- or even multicistronic RNA may lead to a significantly higher expression of the encoded protein(s) than the use of an equal amount of a monocistronic RNA. A "safe and effective amount" of the RNA of the (pharmaceutical) composition as defined above will furthermore vary in connection with the particular condition to be treated and also with the age and physical condition of the patient to be treated, the severity of the condition, the duration of the treatment, the nature of the accompanying therapy, of the particular pharmaceutically acceptable carrier used, and similar factors, within the knowledge and experience of the accompanying doctor. The (pharmaceutical) composition according to the invention can be used according to the invention for human and also for veterinary medical purposes.

Carriers:

The (pharmaceutical) composition according to the invention may typically contain a pharmaceutically acceptable carrier. The expression "pharmaceutically acceptable carrier" as used herein preferably includes the liquid or non-liquid basis of the composition. If the composition is provided in liquid form, the carrier will be water, typically pyrogen-free water; isotonic saline or buffered (aqueous) solutions, e.g phosphate, citrate etc. buffered solutions. Particularly for injection of the (pharmaceutical) composition, water or preferably a buffer, more preferably an aqueous buffer, may be used, containing a sodium salt, preferably at least 50 mM of a sodium salt, a calcium salt, preferably at least 0.01 mM of a calcium salt, and optionally a potassium salt, preferably at least 3 mM of a potassium salt. According to a preferred embodiment, the sodium, calcium and, optionally, potassium salts may occur in the form of their halogenides, e.g. chlorides, iodides, or bromides, in the form of their hydroxides, carbonates, hydrogen carbonates, or sulfates, etc. Without being limited thereto, examples of sodium salts include e.g. NaCl, NaI, NaBr, $Na_2CO_3$, $NaHCO_3$, $Na_2SO_4$, examples of the optional potassium salts include e.g. KCl, KI, KBr, $K_2CO_3$, $KHCO_3$, $K_2SO_4$, and examples of calcium salts include e.g. $CaCl_2$), Cale, $CaBr_2$, $CaCO_3$, $CaSO_4$, $Ca(OH)_2$. Furthermore, organic anions of the aforementioned cations may be contained in the buffer. According to a more preferred embodiment, the buffer suitable for injection purposes as defined above, may contain salts selected from sodium chloride (NaCl), calcium chloride ($CaCl_2$)) and optionally potassium chloride (KCl), wherein further anions may be present additional to the chlorides. $CaCl_2$) can also be replaced by another salt like KCl. Typically, the salts in the injection buffer are present in a concentration of at least 50 mM sodium chloride (NaCl), at least 3 mM potassium chloride (KCl) and at least 0.01 mM calcium chloride ($CaCl_2$)). The injection buffer may be hypertonic, isotonic or hypotonic with reference to the specific reference medium, i.e. the buffer may have a higher, identical or lower salt content with reference to the specific reference medium, wherein preferably such concentrations of the afore mentioned salts may be used, which do not lead to damage of cells due to osmosis or other concentration effects. Reference media are e.g. in "in vivo" methods occurring liquids such as blood, lymph, cytosolic liquids, or other body liquids, or e.g. liquids, which may be used as reference media in "in vitro" methods, such as common buffers or liquids. Such common buffers or liquids are known to a skilled person. Ringer-Lactate solution is particularly preferred as a liquid basis.

However, one or more compatible solid or liquid fillers or diluents or encapsulating compounds may be used as well, which are suitable for administration to a person. The term "compatible" as used herein means that the constituents of the composition according to the invention are capable of being mixed with the RNA according to the invention as defined herein, in such a manner that no interaction occurs, which would substantially reduce the pharmaceutical effectiveness of the (pharmaceutical) composition according to the invention under typical use conditions. Pharmaceutically acceptable carriers, fillers and diluents must, of course, have sufficiently high purity and sufficiently low toxicity to make them suitable for administration to a person to be treated. Some examples of compounds which can be used as pharmaceutically acceptable carriers, fillers or constituents thereof are sugars, such as, for example, lactose, glucose, trehalose and sucrose; starches, such as, for example, corn starch or potato starch; dextrose; cellulose and its derivatives, such as, for example, sodium carboxymethylcellulose, ethylcellulose, cellulose acetate; powdered tragacanth; malt; gelatin; tallow; solid glidants, such as, for example, stearic acid, magnesium stearate; calcium sulfate; vegetable oils, such as, for example, groundnut oil, cottonseed oil, sesame oil, olive oil, corn oil and oil from theobroma; polyols, such as, for example, polypropylene glycol, glycerol, sorbitol, mannitol and polyethylene glycol; alginic acid.

Administration

The choice of a pharmaceutically acceptable carrier is determined, in principle, by the manner, in which the pharmaceutical composition according to the invention is administered. The (pharmaceutical) composition can be administered, for example, systemically or locally. Routes for systemic administration in general include, for example, transdermal, oral, parenteral routes, including subcutaneous, intravenous, intramuscular, intraarterial, intradermal and intraperitoneal injections and/or intranasal administration routes. Routes for local administration in general include, for example, topical administration routes but also intradermal, transdermal, subcutaneous, or intramuscular injections or intralesional, intracranial, intrapulmonal, intracardial, and sublingual injections. More preferably, the (pharmaceutical) composition according to the present invention may be administered by an intradermal, subcutaneous, or intramuscular route, preferably by injection, which may be needle-free and/or needle injection.

The (pharmaceutical) composition as defined herein may also be administered orally in any orally acceptable dosage form including, but not limited to, capsules, tablets, aqueous suspensions or solutions.

The (pharmaceutical) composition may also be administered topically, especially when the target of treatment includes areas or organs readily accessible by topical application, e.g. including diseases of the skin or of any other accessible epithelial tissue. Suitable topical formulations are readily prepared for each of these areas or organs. For topical applications, the (pharmaceutical) composition may be formulated in a suitable ointment, containing the RNA according to the invention suspended or dissolved in one or more carriers.

According to a preferred embodiment of this aspect of the invention, the (pharmaceutical) composition according to the invention is administered by injection, e.g. intradermal injection. Any suitable injection technique known in the art may be employed. Preferably, the inventive composition is administered by injection, preferably by needle-less injection, for example by jet-injection.

According to a another preferred embodiment of this aspect of the invention, the (pharmaceutical) composition according to the invention is administered topically. Therefore, the pharmaceutical composition can be provided in the form of a wound dressing as described herein.

In one embodiment, the (pharmaceutical) composition or combination comprises at least two, three, four, five, six, seven, eight, nine, ten, eleven, twelve or more RNAs as defined herein, each of which is preferably injected separately, preferably by needle-less injection. Alternatively, the (pharmaceutical) composition or combination comprises at least two, three, four, five, six, seven, eight, nine, ten, eleven, twelve or more RNAs, wherein the at least two, three, four, five, six, seven, eight, nine, ten, eleven, twelve or more RNAs are administered, preferably by injection as defined herein, as a mixture.

Administration of the RNA as defined herein or the (pharmaceutical) composition according to the invention may be carried out in a time staggered treatment. A time staggered treatment may be e.g. administration of the RNA or the composition prior, concurrent and/or subsequent to a conventional therapy of a disease or disorder, preferably as described herein, e.g. by administration of the RNA or the composition prior, concurrent and/or subsequent to a therapy or an administration of a therapeutic agent suitable for the treatment or prophylaxis of a disease or disorder as described herein. Such time staggered treatment may be carried out using e.g. a kit, preferably a kit of parts as defined herein.

Time staggered treatment may additionally or alternatively also comprise an administration of the RNA as defined herein or the (pharmaceutical) composition according to the invention in a form, wherein the RNA encoding a therapeutic protein as defined herein or a fragment or variant thereof, preferably forming part of the composition, is administered parallel, prior or subsequent to another RNA encoding a therapeutic protein as defined above, preferably forming part of the same inventive composition. Preferably, the administration (of all RNAs) occurs within an hour, more preferably within 30 minutes, even more preferably within 15, 10, 5, 4, 3, or 2 minutes or even within 1 minute. Such time staggered treatment may be carried out using e.g. a kit, preferably a kit of parts as defined herein.

Formulation

The (pharmaceutical) composition is preferably formulated in liquid or solid form. The suitable amount of the (pharmaceutical) composition according to the invention to be administered can be determined by routine experiments, e.g. by using animal models. Such models include, without implying any limitation, rabbit, sheep, mouse, rat, dog and non-human primate models. Preferred unit dose forms for injection include sterile solutions of water, physiological saline or mixtures thereof. The pH of such solutions should be adjusted to about 7.4. Suitable carriers for injection include hydrogels, devices for controlled or delayed release, polylactic acid and collagen matrices. Suitable pharmaceutically acceptable carriers for topical application include those which are suitable for use in lotions, creams, gels and the like. If the (pharmaceutical) composition is to be administered perorally, tablets, capsules and the like are the preferred unit dose form. The pharmaceutically acceptable carriers for the preparation of unit dose forms which can be used for oral administration are well known in the prior art. The choice thereof will depend on secondary considerations such as taste, costs and storability, which are not critical for the purposes of the present invention, and can be made without difficulty by a person skilled in the art.

Further additives which may be included in the (pharmaceutical) composition are emulsifiers, such as, for example, Tween; wetting agents, such as, for example, sodium lauryl sulfate; colouring agents; taste-imparting agents, pharmaceutical carriers; tablet-forming agents; stabilizers; antioxidants; preservatives.

Lyophilized Forms

In a preferred embodiment, the RNA, the (pharmaceutical) composition or kit of parts according to the invention is provided in lyophilized form. Preferably, the lyophilized RNA is reconstituted in a suitable buffer, advantageously based on an aqueous carrier, prior to administration, e.g. Ringer-Lactate solution, which is preferred, Ringer solution, a phosphate buffer solution. In a preferred embodiment, the (pharmaceutical) composition or the kit of parts according to the invention contains at least two, three, four, five, six or more RNAs, preferably mRNAs which are provided separately in lyophilized form (optionally together with at least one further additive) and which are preferably reconstituted separately in a suitable buffer (such as Ringer-Lactate solution) prior to their use so as to allow individual administration of each of the (monocistronic) RNAs.

Saline or Lipid Formulations

In further preferred embodiments, the (pharmaceutical) composition is provided in the form of a saline or a lipid formulation.

Lipid Formulations

The lipid formulation may be selected from, but not limited to, liposomes, lipoplexes, copolymers such as PLGA and lipid nanoparticles.

In one preferred embodiment, a lipid nanoparticle (LNP) comprises:

a) at least one RNA according to the invention,
b) a cationic lipid,
c) an aggregation reducing agent (such as polyethylene glycol (PEG) lipid or PEG-modified lipid),
d) optionally a non-cationic lipid (such as a neutral lipid), and
e) optionally, a sterol.

In one embodiment, the lipid nanoparticle formulation consists of (i) at least one cationic lipid; (ii) a neutral lipid;

(iii) a sterol, e.g., cholesterol; and (iv) a PEG-lipid, in a molar ratio of about 20-60% cationic lipid:5-25% neutral lipid: 25-55% sterol; 0.5-15% PEG-lipid.

In one embodiment, the RNA may be formulated in an aminoalcohol lipidoid. Aminoalcohol lipidoids which may be used in the present invention may be prepared by the methods described in U.S. Pat. No. 8,450,298, herein incorporated by reference in its entirety.

Cationic Lipids:

The lipid nanoparticle may include any cationic lipid suitable for forming a lipid nanoparticle. Preferably, the cationic lipid carries a net positive charge at about physiological pH.

The cationic lipid may be an amino lipid. As used herein, the term "amino lipid" is meant to include those lipids having one or two fatty acid or fatty alkyl chains and an amino head group (including an alkylamino or dialkylamino group) that may be protonated to form a cationic lipid at physiological pH.

The cationic lipid may be, for example, N,N-dioleyl-N,N-dimethylammonium chloride (DODAC), N,N-distearyl-N,N-dimethylammonium bromide (DDAB), 1,2-dioleoyltrimethyl ammonium propane chloride (DOTAP) (also known as N-(2,3-dioleoyloxy)propyl)-N,N,N-trimethylammonium chloride and 1,2-Dioleyloxy-3-trimethylaminopropane chloride salt), N-(1-(2,3-dioleyloxy)propyl)-N,N,N-trimethylammonium chloride (DOTMA), N,N-dimethyl-2,3-dioleyloxy)propylamine (DODMA), 1,2-DiLinoleyloxy-N,N-dimethylaminopropane (DLinDMA), 1,2-Dilinolenyloxy-N,N-dimethylaminopropane (DLenDMA), 1,2-di-γ-linolenyloxy-N,N-dimethylaminopropane (γ-DLenDMA), 1,2-Dilinoleylcarbamoyloxy-3-dimethylaminopropane (DLin-C-DAP), 1,2-Dilinoleyoxy-3-(dimethylamino)acetoxypropane (DLin-DAC), 1,2-Dilinoleyoxy-3-morpholinopropane (DLin-MA), 1,2-Dilinoleoyl-3-dimethylaminopropane (DLinDAP), 1,2-Dilinoleylthio-3-dimethylaminopropane (DLin-S-DMA), 1-Linoleoyl-2-linoleyloxy-3-dimethylaminopropane (DLin-2-DMAP), 1,2-Dilinoleyloxy-3-trimethylaminopropane chloride salt (DLin-TMA.Cl), 1,2-Dilinoleoyl-3-trimethylaminopropane chloride salt (DLin-TAP.Cl), 1,2-Dilinoleyloxy-3-(N-methylpiperazino)propane (DLin-MPZ), or 3-(N,N-Dilinoleylamino)-1,2-propanediol (DLinAP), 3-(N,N-Dioleylamino)-1,2-propanedio (DOAP), 1,2-Dilinoleyloxo-3-(2-N,N-dimethylamino)ethoxypropane (DLin-EG-DM A), 2,2-Dilinoleyl-4-dimethylaminomethyl-[1,3]-dioxolane (DLin-K-DMA) or analogs thereof, (3a R,5s,6aS)-N,N-dimethyl-2,2-d ((9Z,12Z)-octadeca-9,12-dienyl)tetrahydro-3aH-cyclopenta[d][1,3]dioxo1-5-amine, (6Z,9Z,28Z,31Z)-heptatriaconta-6,9,28,31-tetraen-19-yl 4-(dimethylamino) butanoate (MC3), 1,1'-(2-(4-(2-((2-(bis(2-hydroxydodecyl) amino)ethyl)(2-hydroxydodecyl)amino)ethyl)piperazin-1-yl)ethylazanediyl)didodecan-2-ol (C12-200), 2,2-dilinoleyl-4-(2-dimethylaminoethyl)-[1,3]-dioxolane (DLin-K-C2-DMA), 2,2-dilinoleyl-4-dimethylaminomethyl-[1,3]-dioxolane (DLin-K-DMA), (6Z,9Z,28Z,31Z)-heptatriaconta-6,9,28,31-tetraen-19-yl 4-(dimethylamino) butanoate (DLin-M-C3-DMA), 3-((6Z,9Z,28Z,31Z)-heptatriaconta-6,9,28,31-tetraen-19-yloxy)-N,N-dimethylpropan-1-amine (MC3 Ether), 4-((6Z,9Z,28Z,31Z)-heptatriaconta-6,9,28,31-tetraen-19-yloxy)-N,N-dimethylbutan-1-amine (MC4 Ether), or any combination of any of the foregoing.

Other cationic lipids include, but are not limited to, N,N-distearyl-N,N-dimethylammonium bromide (DDAB), 3β—(N—(N',N'-dimethylaminoethane)-carbamoyl)cholesterol (DC-Chol), N-(1-(2,3-dioleyloxy)propyl)-N-2-(sperminecarboxamido)ethyl)-N,N-dimethylammonium trifluoracetate (DOSPA), dioctadecylamidoglycyl carboxyspermine (DOGS), 1,2-dileoyl-sn-3-phosphoethanolamine (DOPE), 1,2-dioleoyl-3-dimethylammonium propane (DODAP), N-(1,2-dimyristyloxyprop-3-yl)-N,N-dimethyl-N-hydroxyethyl ammonium bromide (DMRIE), and 2,2-Dilinoleyl-4-dimethylaminoethyl-[1,3]-dioxolane (XTC). Additionally, commercial preparations of cationic lipids can be used, such as, e.g., LIPOFECTIN (including DOTMA and DOPE, available from GIBCO/BRL), and LIPOFECTAMINE (comprising DOSPA and DOPE, available from GIBCO/BRL).

Other suitable cationic lipids are disclosed in International Publication Nos. WO09/086558, WO09/127060, WO10/048536, WO10/054406, WO10/088537, WO10/129709, and WO2011/153493; U.S. Patent Publication Nos. 2011/0256175, 2012/0128760, and 2012/0027803; U.S. Pat. No. 8,158,601; and Love et al, PNAS, 107(5), 1864-69, 2010. Other suitable amino lipids include those having alternative fatty acid groups and other dialkylamino groups, including those in which the alkyl substituents are different (e.g., N-ethyl-N-methylamino-, and N-propyl-N-ethylamino-). In general, amino lipids having less saturated acyl chains are more easily sized, particularly when the complexes must be sized below about 0.3 microns, for purposes of filter sterilization. Amino lipids containing unsaturated fatty acids with carbon chain lengths in the range of C14 to C22 may be used. Other scaffolds can also be used to separate the amino group and the fatty acid or fatty alkyl portion of the amino lipid.

In certain embodiments, amino or cationic lipids of the invention have at least one protonatable or deprotonatable group, such that the lipid is positively charged at a pH at or below physiological pH (e.g. pH 7.4), and neutral at a second pH, preferably at or above physiological pH. It will, of course, be understood that the addition or removal of protons as a function of pH is an equilibrium process, and that the reference to a charged or a neutral lipid refers to the nature of the predominant species and does not require that all of the lipid be present in the charged or neutral form. Lipids that have more than one protonatable or deprotonatable group, or which are zwitterionic, are not excluded from use in the invention.

In certain embodiments, the protonatable lipids have a pKa of the protonatable group in the range of about 4 to about 11, e.g., a pKa of about 5 to about 7.

Lipid particles can include two or more cationic lipids. The cationic lipids can be selected to contribute different advantageous properties. For example, cationic lipids that differ in properties such as amine pKa, chemical stability, half-life in circulation, half-life in tissue, net accumulation in tissue, or toxicity can be used in the lipid nanoparticle. In particular, the cationic lipids can be chosen so that the properties of the mixed-lipid particle are more desirable than the properties of a single-lipid particle of individual lipids.

The cationic lipid can comprise from about 20 mol % to about 70 mol % or 75 mol % or from about 45 mol % to about 65 mol % or about 20 mol %, 25 mol %, 30 mol %, 35 mol %, 40 mol %, 45 mol %, 50 mol %, 55 mol %, 60 mol %, 65 mol %, or about 70 mol % of the total lipid present in the particle. In another embodiment, the lipid nanoparticles include from about 25% to about 75% on a molar basis of cationic lipid, e.g., from about 20% to about 70%, from about 35% to about 65%, from about 45% to about 65%, about 60%, about 57.5%, about 57.1%, about 50% or about 40% on a molar basis (based upon 100% total moles of lipid in the lipid nanoparticle). [59] In one embodiment, the ratio of cationic lipid to nucleic acid is from about 3 to about 15, such as from about 5 to about 13 or from about 7 to about 11.

Non-Cationic Lipids:

The non-cationic lipid can be a neutral lipid, an anionic lipid, or an amphipathic lipid. Neutral lipids, when present, can be any of a number of lipid species which exist either in an uncharged or neutral zwitterionic form at physiological pH. Such lipids include, for example, diacylphosphatidylcholine, diacylphosphatidylethanolamine, ceramide, sphingomyelin, dihydrosphingomyelin, cephalin, and cerebrosides. The selection of neutral lipids for use in the particles described herein is generally guided by consideration of, e.g., lipid particle size and stability of the lipid particle in the bloodstream. Preferably, the neutral lipid is a lipid having two acyl groups (e.g., diacylphosphatidylcholine and diacylphosphatidylethanolamine).

In one embodiment, the neutral lipids contain saturated fatty acids with carbon chain lengths in the range of C10 to C20. In another embodiment, neutral lipids with mono or diunsaturated fatty acids with carbon chain lengths in the range of C10 to C20 are used. Additionally, neutral lipids having mixtures of saturated and unsaturated fatty acid chains can be used.

Suitable neutral lipids include, but are not limited to, distearoylphosphatidylcholine (DSPC), dioleoylphosphatidylcholine (DOPC), dipalmitoylphosphatidylcholine (DPPC), dioleoylphosphatidylglycerol (DOPG), dipalmitoylphosphatidylglycerol (DPPG), dioleoyl-phosphatidylethanolamine (DOPE), palmitoyloleoylphosphatidylcholine (POPC), palmitoyloleoylphosphatidylethanolamine (POPE), dioleoyl-phosphatidylethanolamine 4-(N-maleimidomethyl)-cyclohexane-1-carboxylate (DOPE-mal), dipalmitoyl phosphatidyl ethanolamine (DPPE), dimyristoylphosphoethanolamine (DMPE), dimyristoyl phosphatidylcholine (DMPC), distearoyl-phosphatidyl-ethanolamine (DSPE), SM, 16-O-monomethyl PE, 16-O-dimethyl PE, 18-1-trans PE, 1-stearoyl-2-oleoyl-phosphatidyethanolamine (SOPE), cholesterol, or a mixture thereof. Anionic lipids suitable for use in lipid particles of the invention include, but are not limited to, phosphatidylglycerol, cardiolipin, diacylphosphatidylserine, diacylphosphatidic acid, N-dodecanoyl phosphatidylethanoloamine, N-succinyl phosphatidylethanolamine, N-glutaryl phosphatidylethanolamine, lysylphosphatidylglycerol, and other anionic modifying groups joined to neutral lipids.

Amphipathic lipids refer to any suitable material, wherein the hydrophobic portion of the lipid material orients into a hydrophobic phase, while the hydrophilic portion orients toward the aqueous phase. Such compounds include, but are not limited to, phospholipids, aminolipids, and sphingolipids. Representative phospholipids include sphingomyelin, phosphatidylcholine, phosphatidylethanolamine, phosphatidylserine, phosphatidylinositol, phosphatidic acid, palmitoyloleoyl phosphatdylcholine, lysophosphatidylcholine, lysophosphatidylethanolamine, dipalmitoylphosphatidylcholine, dioleoylphosphatidylcholine, distearoylphosphatidylcholine, or dilinoleoylphosphatidylcholine. Other phosphorus-lacking compounds, such as sphingolipids, glycosphingolipid families, diacylglycerols, and β-acyloxyacids, can also be used.

The non-cationic lipid can be from about 5 mol % to about 90 mol %, about 5 mol % to about 10 mol %, about 5, 10, 15, 20, 25, 30, 35, 40, 45, 50, 55, 60, 65, 70, 75, 80, 85, or about 90 mol % of the total lipid present in the particle. In one embodiment, the lipid nanoparticles include from about 0% to about 15% or 45% on a molar basis of neutral lipid, e.g., from about 3% to about 12% or from about 5% to about 10%. For instance, the lipid nanoparticles may include about 15%, about 10%, about 7.5%, or about 7.1% of neutral lipid on a molar basis (based upon 100% total moles of lipid in the lipid nanoparticle).

Sterols:

A preferred sterol is cholesterol.

The sterol can be about 10 mol % to about 60 mol % or about 25 mol % to about 40 mol % of the lipid particle. In one embodiment, the sterol is about 10, 15, 20, 25, 30, 35, 40, 45, 50, 55, or about 60 mol % of the total lipid present in the lipid particle. In another embodiment, the lipid nanoparticles include from about 5% to about 50% on a molar basis of the sterol, e.g., about 15% to about 45%, about 20% to about 40%, about 48%, about 40%, about 38.5%, about 35%, about 34.4%, about 31.5% or about 31% on a molar basis (based upon 100% total moles of lipid in the lipid nanoparticle).

Aggregation Reducing Agents:

The aggregation reducing agent can be a lipid capable of reducing aggregation. Examples of such lipids include, but are not limited to, polyethylene glycol (PEG)-modified lipids, monosialoganglioside Gml, and polyamide oligomers (PAO) such as those described in U.S. Pat. No. 6,320,017, which is incorporated by reference in its entirety. Other compounds with uncharged, hydrophilic, steric-barrier moieties, which prevent aggregation during formulation, like PEG, Gml or ATTA, can also be coupled to lipids. ATTA-lipids are described, e.g., in U.S. Pat. No. 6,320,017, and PEG-lipid conjugates are described, e.g., in U.S. Pat. Nos. 5,820,873, 5,534,499 and 5,885,613, each of which is incorporated by reference in its entirety.

The aggregation reducing agent may be, for example, a polyethyleneglycol (PEG)-lipid including, without limitation, a PEG-diacylglycerol (DAG), a PEG-dialkylglycerol, a PEG-dialkyloxypropyl (DAA), a PEG-phospholipid, a PEG-ceramide (Cer), or a mixture thereof (such as PEG-Cer14 or PEG-Cer20). The PEG-DAA conjugate may be, for example, a PEG-d ilau ryloxypropyl (C12), a PEG-d imyristyloxypropyl (C14), a PEG-dipalmityloxypropyl (C16), or a PEG-distearyloxypropyl (C18). Other pegylated-lipids include, but are not limited to, polyethylene glycol-didimyristoyl glycerol (C14-PEG or PEG-C14, where PEG has an average molecular weight of 2000 Da) (PEG-DMG); (R)-2,3-bis(octadecyloxy)propyl-(methoxy poly(ethylene glycol)2000)propylcarbamate) (PEG-DSG); PEG-carbamoyl-1,2-dimyristyloxypropylamine, in which PEG has an average molecular weight of 2000 Da (PEG-cDMA); N-Acetylgalactosamine-aR)-2,3-bis(octadecyloxy)propyl-I-(methoxy poly(ethylene glycol)2000)propylcarbamate)) (GalNAc-PEG-DSG); mPEG (mw2000)-diastearoylphosphatidyl-ethanolamine (PEG-DSPE); and polyethylene glycol-dipalmitoylglycerol (PEG-DPG). In one embodiment, the aggregation reducing agent is PEG-DMG. In another embodiment, the aggregation reducing agent is PEG-c-DMA.

The liposome formulation may be influenced by, but not limited to, the selection of the cationic lipid component, the degree of cationic lipid saturation, the nature of the PEGylation, ratio of all components and biophysical parameters such as size. In one example by Semple et al. (Semple et al. Nature Biotech. 2010 28: 172-176; herein incorporated by reference in its entirety), the liposome formulation was composed of 57.1% cationic lipid, 7.1% dipalmitoylphosphatidylcholine, 34.3% cholesterol, and 1.4% PEG-c-DMA. In some embodiments, liposome formulations may comprise from about 35 to about 45% cationic lipid, from about 40% to about 50% cationic lipid, from about 50% to about 60% cationic lipid and/or from about 55% to about 65% cationic lipid. In some embodiments, the ratio of lipid to mRNA in liposomes may be from about 5:1 to about 20:1, from about 10:1 to about 25:1, from about 15:1 to about 30:1 and/or at least 30:1.

The average molecular weight of the PEG moiety in the PEG-modified lipids can range from about 500 to about 8,000 Daltons (e.g., from about 1,000 to about 4,000 Daltons). In one preferred embodiment, the average molecular weight of the PEG moiety is about 2,000 Daltons.

The concentration of the aggregation reducing agent may range from about 0.1 mol % to about 15 mol %, based upon the 100% total moles of lipid in the lipid particle. In one embodiment, the formulation includes less than about 3, 2, or 1 mole percent of PEG or PEG-modified lipid, based upon the total moles of lipid in the lipid particle.

In another embodiment, the lipid nanoparticles include from about 0.1% to about 20% on a molar basis of the PEG-modified lipid, e.g., about 0.5 to about 10%, about 0.5 to about 5%, about 10%, about 5%, about 3.5%, about 1.5%, about 0.5%, or about 0.3% on a molar basis (based on 100% total moles of lipids in the lipid nanoparticle).

Lipid Nanoparticles (LNPs):

The lipid nanoparticles may have the structure of a liposome. A liposome is a structure having lipid-containing membranes enclosing an aqueous interior. Liposomes may have one or more lipid membranes. Liposomes can be single-layered, referred to as unilamellar, or multi-layered, referred to as multilamellar. When complexed with nucleic acids, lipid particles may also be lipoplexes, which are composed of cationic lipid bilayers sandwiched between DNA layers. Liposomes can further be of different sizes such as, but not limited to, a multilamellar vesicle (MLV) which may be hundreds of nanometers in diameter and may contain a series of concentric bilayers separated by narrow aqueous compartments, a small unicellular vesicle (SUV) which may be smaller than 50 nm in diameter, and a large unilamellar vesicle (LUV) which may be between 50 nm and 500 nm in diameter. Liposome design may include, but is not limited to, opsonins or ligands in order to improve the attachment of liposomes to unhealthy tissue or to activate events such as, but not limited to, endocytosis. Liposomes may contain a low or a high pH in order to improve the delivery of the pharmaceutical formulations.

As a non-limiting example, liposomes such as synthetic membrane vesicles may be prepared by the methods, apparatus and devices described in US Patent Publication No. US20130177638, US20130177637, US20130177636, US20130177635, US20130177634, US20130177633, US20130183375, US20130183373 and US20130183372, the contents of each of which are herein incorporated by reference in its entirety. The nucleic acid may be encapsulated by the liposome and/or it may be contained in an aqueous core which may then be encapsulated by the liposome (see International Pub. Nos. WO2012/031046, WO2012/031043, WO2012/030901 and WO2012/006378 and US Patent Publication No. US20130189351, US20130195969 and US20130202684; the contents of each of which are herein incorporated by reference in their entirety).

In another embodiment, the polynucleotide may be formulated in a cationic oil-in-water emulsion where the emulsion particle comprises an oil core and a cationic lipid which can interact with the polynucleotide anchoring the molecule to the emulsion particle (see International Pub. No. WO2012/006380; herein incorporated by reference in its entirety). In one embodiment, the nucleic acids may be formulated in a water-in-oil emulsion comprising a continuous hydrophobic phase in which the hydrophilic phase is dispersed. As a non-limiting example, the emulsion may be made by the methods described in International Publication No. WO2010/87791, the contents of which are herein incorporated by reference in its entirety.

In one embodiment, the nucleic acid pharmaceutical compositions may be formulated in liposomes such as, but not limited to, DiLa2 liposomes (Marina Biotech, Bothell, Wash.), SMARTICLES® (Marina Biotech, Bothell, Wash.), neutral DOPC (1,2-dioleoyl-sn-glycero-3-phosphocholine) based liposomes (e.g., siRNA delivery for ovarian cancer (Landen et al. Cancer Biology & Therapy 2006 5(12)1708-1713); herein incorporated by reference in its entirety) and hyaluronan-coated liposomes (Quiet Therapeutics, Israel).

In another embodiment, the lipid nanoparticles have a median diameter size of from about 50 nm to about 300 nm, such as from about 50 nm to about 250 nm, for example, from about 50 nm to about 200 nm.

In some embodiments, nucleic acid may be delivered using smaller LNPs. Such particles may comprise a diameter from below 0.1 μm up to 100 nm such as, but not limited to, less than 0.1 μm, less than 1.0 μm, less than 5 μm, less than 10 μm, less than 15 μm, less than 20 μm, less than 25 μm, less than 30 μm, less than 35 μm, less than 40 μm, less than 50 μm, less than 55 μm, less than 60 μm, less than 65 μm, less than 70 μm, less than 75 μm, less than 80 μm, less than 85 μm, less than 90 μm, less than 95 μm, less than 100 μm, less than 125 μm, less than 150 μm, less than 175 μm, less than 200 μm, less than 225 μm, less than 250 μm, less than 275 μm, less than 300 μm, less than 325 μm, less than 350 μm, less than 375 μm, less than 400 μm, less than 425 μm, less than 450 μm, less than 475 μm, less than 500 μm, less than 525 μm, less than 550 μm, less than 575 μm, less than 600 μm, less than 625 μm, less than 650 μm, less than 675 μm, less than 700 μm, less than 725 μm, less than 750 μm, less than 775 μm, less than 800 μm, less than 825 μm, less than 850 μm, less than 875 μm, less than 900 μm, less than 925 μm, less than 950 μm, less than 975 μm. In another embodiment, nucleic acids may be delivered using smaller LNPs which may comprise a diameter from about 1 nm to about 100 nm, from about 1 nm to about 10 nm, about 1 nm to about 20 nm, from about 1 nm to about 30 nm, from about 1 nm to about 40 nm, from about 1 nm to about 50 nm, from about 1 nm to about 60 nm, from about 1 nm to about 70 nm, from about 1 nm to about 80 nm, from about 1 nm to about 90 nm, from about 5 nm to about from 100 nm, from about 5 nm to about 10 nm, about 5 nm to about 20 nm, from about 5 nm to about 30 nm, from about 5 nm to about 40 nm, from about 5 nm to about 50 nm, from about 5 nm to about 60 nm, from about 5 nm to about 70 nm, from about 5 nm to about 80 nm, from about 5 nm to about 90 nm, about 10 nm to about 50 nm, from about 20 nm to about 50 nm, from about 30 nm to about 50 nm, from about 40 nm to about 50 nm, from about 20 nm to about 60 nm, from about 30 nm to about 60 nm, from about 40 nm to about 60 nm, from about 20 nm to about 70 nm, from about 30 nm to about 70 nm, from about 40 nm to about 70 nm, from about 50 nm to about 70 nm, from about 60 nm to about 70 nm, from about 20 nm to about 80 nm, from about 30 nm to about 80 nm, from about 40 nm to about 80 nm, from about 50 nm to about 80 nm, from about 60 nm to about 80 nm, from about 20 nm to about 90 nm, from about 30 nm to about 90 nm, from about 40 nm to about 90 nm, from about 50 nm to about 90 nm, from about 60 nm to about 90 nm and/or from about 70 nm to about 90 nm.

In one embodiment, the lipid nanoparticle may have a diameter greater than 100 nm, greater than 150 nm, greater than 200 nm, greater than 250 nm, greater than 300 nm, greater than 350 nm, greater than 400 nm, greater than 450 nm, greater than 500 nm, greater than 550 nm, greater than 600 nm, greater than 650 nm, greater than 700 nm, greater than 750 nm, greater than 800 nm, greater than 850 nm, greater than 900 nm, greater than 950 nm or greater than 1000 nm.

In yet another embodiment, the lipid nanoparticles in the formulation of the present invention have a single mode particle size distribution (i.e., they are not bi- or polymodal).

The lipid nanoparticles may further comprise one or more lipids and/or other components in addition to those mentioned above. Other lipids may be included in the liposome compositions for a variety of purposes, such as to prevent lipid oxidation or to attach ligands onto the liposome surface. Any of a number of lipids may be present in lipid particles, including amphipathic, neutral, cationic, and anionic lipids. Such lipids can be used alone or in combination.

Additional components that may be present in a lipid particle include bilayer stabilizing components such as polyamide oligomers (see, e.g., U.S. Pat. No. 6,320,017, which is incorporated by reference in its entirety), peptides, proteins, and detergents.

Different lipid nanoparticles having varying molar ratios of cationic lipid, non-cationic (or neutral) lipid, sterol (e.g., cholesterol), and aggregation reducing agent (such as a PEG-modified lipid) on a molar basis (based upon the total moles of lipid in the lipid nanoparticles) are provided in Table A below.

weight ratio of lipid to RNA is from about 0.5:1 to about 12:1.

In one embodiment, the nucleic acids of the present invention may be encapsulated in a therapeutic nanoparticle, referred to herein as "therapeutic nanoparticle nucleic acids." Therapeutic nanoparticles may be formulated by methods described herein and known in the art such as, but not limited to, International Pub Nos. WO2010/005740, WO2010/030763, WO2010/005721, WO2010/005723, WO2012/054923, US Pub. Nos. US20110262491, US20100104645, US20100087337, US20100068285, US20110274759, US20100068286, US20120288541, US20130123351 and US20130230567 and U.S. Pat. Nos. 8,206,747, 8,293,276, 8,318,208 and 8,318,211; the content of each of which are herein incorporated by reference in their entirety. In another embodiment, therapeutic polymer nanoparticles may be identified by the methods described in US Pub No. US20120140790, the contents of which is herein incorporated by reference in its entirety.

In one embodiment, the nucleic acids may be encapsulated in, linked to and/or associated with synthetic nanocarriers. Synthetic nanocarriers include, but are not limited to, those described in International Pub. Nos. WO2010/005740, WO2010/030763, WO2012/13501, WO2012/149252, WO2012/149255, WO2012/149259, WO2012/149265, WO2012/149268, WO2012/149282, WO2012/149301, WO2012/149393, WO2012/149405, WO2012/149411, WO2012/149454 and WO2013/019669, and US Pub. Nos. US20110262491, US20100104645, US20100087337 and US20120244222, each of which is herein incorporated by reference in their entirety. The synthetic nanocarriers may be formulated using methods known in the art and/or described herein. As a non-limiting example, the synthetic nanocarri-

TABLE A

Formulations

Molar Ratio of Lipids
(Based upon 100% total moles of lipid in the lipid nanoparticle)

| Formulation No. | Cationic Lipid | Non-Cationic (or Neutral) Lipid | Sterol | Aggregation Reducing Agent (e.g., PEG-lipid) |
|---|---|---|---|---|
| 1 | from about 35 to about 65% | from about 3 to about 12 or 15% | from about 15 to about 45% | from about 0.1 to about 10% (preferably from about 0.5 to about 2 or 3%) |
| 2 | from about 20 to about 70% | from about 5 to about 45% | from about 20 to about 55% | from about 0.1 to about 10% (preferably from about 0.5 to about 2 or 3%) |
| 3 | from about 45 to about 65% | from about 5 to about 10% | from about 25 to about 40% | from about 0.1 to about 3% |
| 4 | from about 20 to about 60% | from about 5 to about 25% | from about 25 to about 55% | from about 0.1 to about 5% (preferably from about 0.1 to about 3%) |
| 5 | about 40% | about 10% | about 40% | about 10% |
| 6 | about 35% | about 15% | about 40% | about 10% |
| 7 | about 52% | about 13% | about 30% | about 5% |
| 8 | about 50% | about 10% | about 38.5% | about 1.5% |

In one embodiment, the weight ratio of lipid to RNA is at least about 0.5:1, at least about 1:1, at least about 2:1, at least about 3:1, at least about 4:1, at least about 5:1, at least about 6:1, at least about 7:1, at least about 11:1, at least about 20:1, at least about 25:1, at least about 27:1, at least about 30:1, or at least about 33:1. In one embodiment, the weight ratio of lipid to RNA is from about 1:1 to about 35:1, about 3:1 to about 15:1, about 4:1 to about 15:1, or about 5:1 to about 13:1 or about 25:1 to about 33:1. In one embodiment, the ers may be formulated by the methods described in International Pub Nos. WO2010/005740, WO2010/030763 and WO2012/13501 and US Pub. Nos. US20110262491, US20100104645, US20100087337 and US2012024422, each of which is herein incorporated by reference in their entirety. In another embodiment, the synthetic nanocarrier formulations may be lyophilized by methods described in International Pub. No. WO2011/072218 and U.S. Pat. No. 8,211,473; the content of each of which is herein incorporated by reference in their entirety. In yet another embodiment, formulations of the present invention, including, but not limited to, synthetic nanocarriers, may be lyophilized or reconstituted by the methods described in US Patent Publication No. US20130230568, the contents of which are herein incorporated by reference in its entirety.

In one embodiment, the nucleic acids of the invention may be formulated for delivery using the drug encapsulating microspheres described in International Patent Publication No. WO2013/063468 or U.S. Pat. No. 8,440,614, each of which is herein incorporated by reference in its entirety.

In another embodiment, liposomes or LNPs may be formulated for targeted delivery. As a non-limiting example, the liposome or LNP may be formulated for targeted delivery to the liver. The liposome or LNP used for targeted delivery may include, but is not limited to, the liposomes or LNPs described herein. The RNAs of the invention may encode conjugates, e.g. therapeutic proteins or fragments or variants thereof covalently linked to a carrier or targeting group.

Targeting groups can be proteins, e.g., glycoproteins, or peptides, e.g., molecules having a specific affinity for a co-ligand, or antibodies e.g., an antibody, that binds to a specified cell type such as a epithelial cell, keratinocyte or the like. Targeting groups may also include hormones and hormone receptors. They can also include non-peptidic species, such as lipids, lectins, carbohydrates, vitamins, cofactors, multivalent lactose, multivalent galactose, N-acetyl-galactosamine, N-acetyl-gulucosamine multivalent mannose, multivalent fucose, or aptamers. The targeting group can be any ligand that is capable of targeting a specific receptor.

Kit

The RNA, (pharmaceutical) composition or kit according to the invention may also be provided in the form of a kit or kit of parts, wherein the different components form different parts of such kit of parts. These different components, such as the RNAs according to the invention, may be formulated each as a pharmaceutical composition as defined above.

In a further aspect, the present invention provides a kit of parts comprising at least one RNA comprising at least one coding sequence, wherein the coding sequence encodes a therapeutic protein selected from a a collagenase, growth factor, cytokine, chaperone or a signal transduction inhibitor as defined herein. Optionally, the kit of parts may comprise at least one (4) further active agent(s) (e.g. at least one growth factor polypeptide) and/or (5) additional agents (e.g. antimicrobial agents, RNase inhibitors). The kit may be a kit of two or more parts and typically comprises the active agents in suitable containers. For example, each container may be in the form of vials, bottles, squeeze bottles, jars, sealed sleeves, envelopes or pouches, tubes or blister packages or any other suitable form provided the container is configured so as to prevent premature mixing of components.

A container may also be a compartment or a chamber within a vial, a tube, a jar, or an envelope, or a sleeve, or a blister package or a bottle, provided that the contents of one compartment are not able to associate physically with the contents of another compartment prior to their deliberate mixing by a pharmacist or physician. The kit of parts may furthermore contain technical instructions with information on the administration and dosage of the inventive combination, the inventive pharmaceutical composition or of any of its components or parts.

Each of the different parts of the kit may comprise a different component, or some of the different parts of the kit may comprise several components, in case they can be formulated accordingly.

Medical Device

According to another aspect, the present invention also provides a medical device comprising the RNA, (pharmaceutical) composition, or combination according to the invention. Said medical device is preferably a wound dressing comprising a wound contacting layer for placement on the wound, said layer comprising the RNA, (pharmaceutical) composition, or combination according to the invention and optionally further pharmaceutically acceptable carriers or excipients, antimicrobial agents and/or RNAse inhibitors as defined herein. The wound dressing may optionally comprise further layers, such as a a transmission layer for transmitting wound, an absorbent core capable of absorbing and retaining exudates, an adhesive layer for fixing the wound dressing to the tissue surrounding the wound, a hydrating layer for providing hydration, disposed in any suitable order. The design of the wound dressing depends on the wound to be treated. Wound dressings used on dry or desiccated wounds are typically designed to provide hydration. Wounds dressings used on wounds producing excessive exudates are typically designed to absorb the excessive fluid needs to be absorbed. If a wound has necrotic tissue or evident debris, the wound dressing is typically designed to provide for debridement. Lastly, if a wound is infected, the wound dressing will typically comprise appropriate antibacterial agents. There are also several other factors that are important when providing a dressing, such as providing protection to the periwound skin, forming an effective bacterial barrier, conforming to wound shape, producing minimal pain during application and removal, being free of toxic or irritant extractables, not releasing particles or non-biodegradable fibers into the wound, and maintaining the wound at an optimal temperature and pH.

Suitable wound dressings are known in the art and can be adapted to effectively provide the RNA, (pharmaceutical) composition, or combination according to the invention.

Wound dressing materials that can be used in particular in the wound contacting layer include gauze, iodine, bismuth, and zinc impregnated gauze, polyurethane, co-polyester, foams, hydrogels, hydrocolloids, alginates, hydrofibers, hydroconductive materials, oxidized regenerated cellulose (ORC), carboxymethylcellulose, silicone, silver, Polyhexamethylene biguanide (PHMB), iodine, charcoal.

Specific examples of materials that are used in formulating wound dressings include: hydrogels (e.g., Aquasorb®; Duoderm®), hydrocolloids (e.g., Aquacel®; Comfeel®), foams (e.g., LYOfoam®; Spyrosorb®), and alginates (e.g., AlgiSite®; Curasorb®); (iii) additional growth factors e.g. as defined herein to stimulate cell division and proliferation and to promote wound healing (e.g. becaplermin (Regranex Gel®)), a human recombinant platelet-derived growth factor that is approved by the FDA for the treatment of neuropathic foot ulcers).

The wound dressing may also be adapted for use in negative pressure wound therapy.

In another embodiment, the RNA of the invention is comprised in stitches or sutures, i.e. drug-eluting sutures or stitches are coated, soaked, impregnated or generally loaded with the RNA of the invention to serve in a therapeutic role while simultaneously closing wounds and holding tissue together.

Uses

The present invention furthermore provides several applications and uses of the RNA, of the (pharmaceutical) composition, the combination or the kit of parts according to the invention.

According to a further aspect, the present invention provides a method for increasing the expression of an encoded therapeutic protein (in particular a collagenase, growth factor, cytokine, receptor, chaperone or signal transduction inhibitor as defined herein) comprising the steps, e.g. a) providing the RNA as defined herein or the (pharmaceutical) composition as defined herein, b) applying or administering the RNA or the composition to an expression system, e.g. to a cell-free expression system, a cell (e.g. an expression host cell or a somatic cell), a tissue or an organism. The method may be applied for laboratory, for research, for diagnostic, for commercial production of peptides or proteins and/or for therapeutic purposes. In this context, typically after preparing the RNA or the composition, it is typically applied or administered to a cell-free expression system, a cell (e.g. an expression host cell or a somatic cell), a tissue or an organism, e.g. in naked or complexed form or as a (pharmaceutical) composition as described herein, preferably via transfection or by using any of the administration modes as described herein. The method may be carried out in vitro, in vivo or ex vivo. The method may furthermore be carried out in the context of the treatment of a specific disease, preferably as defined herein.

In this context in vitro is defined herein as transfection or transduction of the RNA or the composition according to the invention into cells in culture outside of an organism; in vivo is defined herein as transfection or transduction of the RNA or the composition according to the invention into cells by application of the RNA or the composition to the whole organism or individual and ex vivo is defined herein as transfection or transduction of the RNA or the composition according to the invention into cells outside of an organism or individual and subsequent application of the transfected cells to the organism or individual.

According to another aspect, the present invention also provides the use of the RNA or the composition or the kit or the combination according to the invention, preferably for diagnostic or therapeutic purposes, for increasing the expression of an encoded therapeutic protein (in particular a collagenase, growth factor, cytokine, receptor, chaperone or signal transduction inhibitor as defined herein), particularly in gene therapy e.g. by applying or administering the RNA or the composition, e.g. to a cell-free expression system, a cell (e.g. an expression host cell or a somatic cell), a tissue or an organism. The use may be applied for laboratory, for research, for diagnostic for commercial production of peptides or proteins and/or for therapeutic purposes, preferably for gene therapy. In this context, typically after preparing the RNA or the composition according to the invention, it is typically applied or administered to a cell-free expression system, a cell (e.g. an expression host cell or a somatic cell), a tissue or an organism, preferably in naked form or complexed form, or as a (pharmaceutical) composition as described herein, preferably via transfection or by using any of the administration modes as described herein. The use may be carried out in vitro, in vivo or ex vivo. The use may furthermore be carried out in the context of the treatment of a specific disease, preferably as defined herein.

Expression System

In yet another aspect the present invention also relates to an inventive expression system comprising the RNA according to the invention or an expression vector or plasmid comprising a corresponding nucleic acid sequence according to the first aspect of the present invention. In this context the expression system may be a cell-free expression system (e.g. an in vitro transcription/translation system), a cellular expression system (e.g. mammalian cells like CHO cells, insect cells, yeast cells, bacterial cells like E. coli) or organisms used for expression of peptides or proteins (e.g. plants or animals like cows).

First Medical Use

According to one specific aspect, the present invention is directed to the first medical use of the RNA according to the invention or of the (pharmaceutical) composition comprising the RNA according to the invention or a combination of inventive RNAs as defined herein as a medicament, particularly in gene therapy, preferably for the treatment or prevention of diseases as defined herein.

Further Medical Uses

According to another aspect, the present invention is directed to the second medical use of the RNA according to the invention or of the (pharmaceutical) composition comprising the RNA according to the invention or a combination of inventive RNAs as defined herein, for the treatment of a wound, in particular for inducing or promoting wound healing.

The present invention furthe relates to the use of the RNA, the (pharmaceutical) composition, or of a combination according to the invetion for the preparation of a medicament for the treatment of a wound, in particular for inducing or promoting wound healing. Preferably, the RNA, pharmaceutical composition or combination is used on or administered to a patient in need thereof for this purpose.

According to a further aspect, the RNA, (pharmaceutical) composition, or combination according to the invention is used in the manufacture of a medicament, wherein the medicament is preferably for treatment of a wound. The medicament is thus preferably used in a method of promoting or inducing wound healing.

Wound Healing

The RNA, (pharmaceutical) composition, kit and combination according to the invention are in particular envisaged for use in method of treating a wound. In particular, the RNA, (pharmaceutical) composition, kit and combination according to the invention are envisaged for use in a method of inducing or promoting (i.e. accelerating, improving) wound healing. The term "wound" refers to an injury, usually involving rupture of tissue or laceration or breaking of the integument or (mucous) membrane. Treatments of skin wounds, including cuts, scratches, bruises, and lacerations, is particularly envisaged. Treatment with the RNA, (pharmaceutical) composition, kit and combination according to the invention preferably results in initiation and/or acceleration of wound closure.

The keratinocyte basement membrane serves as a scaffold and a macromolecular signalling matrix which regulates cell behavior during wound healing. Matrix components—which are synthesized and organized by keratinocytes-, play a pivotal role in orchestrating epithelial proliferation, adhesion, and migration, including the cellular responses to injury. Glycoproteins and proteoglycans of the extracellular matrix (ECM) can bind and sequester signaling molecules, including members of the epidermal growth factor (EGF), fibroblast and keratinocyte growth factor and transforming growth factor families. Keratinocytes transduce signals from these matrix-bound or soluble growth factors through their high-affinity growth factor receptors.

Keratinocyte control the expression, activation, and localization of the receptors that transduce matrix-associated signals. For example, the activation and relocation of integrin receptors in response to injury is crucial to the initiation of wound healing. In the wound area, keratinocytes emcounter newly exposed dermal matrix components which bind and activate the α2β1 integrin receptor, causing its relocation to the site of injury, thus allowing keratinocytes to adhere to the exposed dermal matrix and begin migration into the wound area. In addition to the modifications seen in the integrin receptor repertoire during wound healing, injured keratinocytes release growth factors and matrix metalloproteinases (MMPs) to stimulate their integrin-mediated migration. Growth factors, such as heparin-binding epidermal growth factor (HbEGF), are produced by keratinocytes in a membrane-tethered form. In response to injury, Keratinocytes also produce MMP-1, MMP-2 and MMP-9, all of which help to remodel the matrix, allowing cells to migrate into and close the wound.

The present inventors surprisingly discovered that exogenous application of RNAs according to the invention encoding factors known to regulate normal healing accelerate the acute healing process, or activate the healing of chronic wounds. For instance, RNA according to the invention encoding therapeutic proteins and specificalloy collagenases as defined herein may be capable of promoting the migration and proliferation of vascular endothelial cells and keratinocytes after injury, thereby inducing or promoting wound healing as accessible using routine methods known in the art (cf. cell proliferation assay, cell migration assay and wound healing study as performed by Riley and Hermann, J Burns Wounds. 2005; 4: e8).

Items

Item 1. A RNA comprising at least one coding sequence, wherein the coding sequence encodes at least one therapeutic protein selected from a collagenase selected from MMP1; ColG; ColH; MMP8; MMP9; or MMP13 or a fragment or variant thereof; a growth factor selected from AMELX; AMELY; ssAMELX; ssAMELX-001-1; ssAMELX-001-2; ssAMELX-002; ssAMELX-003; ssAMELX-004; ssAMELX-201; BMP1; BMP2; BMP4; BMP6; BMP7; EGF; EREG; FGF1; FGF2; FGF7; HBEGF; HGF; IGF1; IGF2; INHBA; INHBB; PDGFA; PDGFB; PDGFC; PDGFD; TGFA; TGFB1; TGFB2; TGFB3; PGF; VEGFA; VEGFA; VEGFB; VEGFC or VEGFD or a fragment or variant thereof; a cytokine selected from IL6 or CCL7 or a fragment or variant thereof; a receptor selected from ITGAM, CCR1 or TNFRSF1B or a fragment or variant thereof; a chaperone selected from HSPA1A; HSPA1B; HSPA1L; HSPA2; HSPA4; HSPA4L; HSPA5; HSPA6; HSPA7; HSPA8; HSPA9; HSPA12A; HSPA12B; HSPA13; HSPA14; HSPH1; HSP90AA1; HSP90AA3P; HSP90AB1; HSP90I31; HYOU1 or TRAP1 or a fragment or variant thereof; or a signal transduction inhibitor selected from SOCS3 or a fragment or variant thereof for use in a method of treating a wound.

Item 2. The RNA for the use according to item 1, wherein said RNA comprises at least one coding sequence, wherein the coding sequence encodes a therapeutic protein selected from a collagenase, preferably selected from MMP1; ColG or ColH or a fragment or variant thereof.

Item 3. The RNA for the use according to item 1 or 2, wherein said use includes promoting and/or inducing wound healing.

Item 4. The RNA for the use according to any one of the preceding items, wherein the therapeutic protein comprises or consists of an amino acid sequence selected from the group consisting of SEQ ID NO: 6; 7; 8; 9; 10; 11; 12; 13; 14; 15; 16; 17; 18; 19; 20; 21; 22; 23; 24; 25; 26; 27; 28; 29; 30; 31; 32; 33; 34; 35; 36; 37; 38; 39; 40; 41; 42; 43; 44; 45; 46; 47; 48; 49; 50; 51; 52; 53; 54; 55; 56; 57; 58; 59; 60; 61; 62; 63; 64; 65; 66; 67; 68; 69; 70; 71; 72; 73; 74; 75; 76; 77; 78; 79; 80; 81; 82; 83; 84; 85; 86; 87; 88; 89; 90; 91; 92; 93; 94; 95; 96; 97; 5192; 5193; 5194 or 5195 or a fragment or variant of any one of said amino acid sequences.

Item 5. The RNA for the use according to any one of the preceding items, wherein said at least one coding region comprises or consists of a nucleic acid sequence selected from the group consisting of SEQ ID NO: 104; 105; 106; 107; 108; 109; 110; 111; 112; 113; 114; 115; 116; 117; 118; 119; 120; 121; 122; 123; 124; 125; 126; 127; 128; 129; 130; 131; 132; 133; 134; 135; 136; 137; 138; 139; 140; 141; 142; 143; 144; 145; 146; 147; 148; 149; 150; 151; 152; 153; 154; 155; 156; 157; 158; 159; 160; 161; 162; 163; 164; 165; 166; 167; 168; 169; 170; 171; 172; 173; 174; 175; 176; 177; 178; 179; 180; 181; 182; 183; 184; 185; 186; 187; 188; 189; 190; 191; 192; 193; 194; 195; 196; 197; 198; 199; 200; 201; 202; 203; 204; 205; 206; 207; 208; 209; 210; 216; 217; 218; 219; 220; 221; 222; 223; 224; 225; 226; 227; 228; 229; 230; 231; 232; 233; 234; 235; 236; 237; 238; 239; 240; 241; 242; 243; 244; 245; 246; 247; 248; 249; 250; 251; 252; 253; 254; 255; 256; 257; 258; 259; 260; 261; 262; 263; 264; 265; 266; 267; 268; 269; 270; 271; 272; 273; 274; 275; 276; 277; 278; 279; 280; 281; 282; 283; 284; 285; 286; 287; 288; 289; 290; 291; 292; 293; 294; 295; 296; 297; 298; 299; 300; 301; 302; 303; 304; 305; 306; 307; 313; 314; 315; 316; 317; 318; 319; 320; 321; 322; 323; 324; 325; 326; 327; 328; 329; 330; 331; 332; 333; 334; 335; 336; 337; 338; 339; 340; 341; 342; 343; 344; 345; 346; 347; 348; 349; 350; 351; 352; 353; 354; 355; 356; 357; 358; 359; 360; 361; 362; 363; 364; 365; 366; 367; 368; 369; 370; 371; 372; 373; 374; 375; 376; 377; 378; 379; 380; 381; 382; 383; 384; 385; 386; 387; 388; 389; 390; 391; 392; 393; 394; 395; 396; 397; 398; 399; 400; 401; 402; 403; 404; 405, 406, 407, 408, 409; 410; 411; 412; 413; 414; 415; 416; 417; 418; 419; 420; 421; 422; 423; 424; 425; 426; 427; 428; 429; 430; 431; 432; 433; 434; 435; 436; 437; 438; 439; 440; 441; 442; 443; 444; 445; 446; 447; 448; 449; 450; 451; 452; 453; 454; 455; 456; 457; 458; 459; 460; 461; 462; 463; 464; 465; 466; 467; 468; 469; 470; 471; 472; 473; 474; 475; 476; 477; 478; 479; 480; 481; 482; 483; 484; 485; 486; 487; 488; 489; 490; 491; 492; 493; 494; 495; 496; 497; 498; 499; 500; 501; 507; 508; 509; 510; 511; 512; 513; 514; 515; 516; 517; 518; 519; 522; 521; 522; 523; 524; 525; 526; 527; 528; 529; 530; 531; 532; 533; 534; 535; 536; 537; 538; 539; 540; 541; 542; 543; 544; 545; 546; 547; 548; 549; 550; 551; 552; 553; 554; 555; 556; 557; 558; 559; 560; 561; 562; 563; 564; 565; 566; 567; 568; 569; 570; 571; 572; 573; 574; 575; 576; 577; 578; 579; 580; 581; 582; 583; 584; 585; 586; 587; 588; 589; 590; 591; 592; 593; 594; 595; 596; 597; 598; 604; 605; 606; 607; 608; 609; 610; 611; 612; 613; 614; 615; 616; 617M 618; 619; 620; 621; 622; 623; 624; 625; 626; 627; 628; 629; 630; 631; 632; 633; 634; 635; 636; 637; 638; 639; 640; 641; 642; 643; 644; 645; 646; 647; 648; 649; 650; 651; 652; 653; 654; 655; 656; 657; 658; 659; 660; 661; 662; 663; 664; 665; 666; 667; 668; 669; 670; 671; 672; 673; 674; 675; 676; 677; 678; 679; 680; 681; 682; 683; 684; 685; 686; 687; 688; 689; 690; 691; 692; 693; 694; 695; 701; 702; 703; 704; 705; 706; 707; 708; 709; 710; 711;

712; 713; 714; 715; 716; 717; 718; 719; 720; 721; 722; 723; 724; 725; 726; 727; 728; 729; 730; 731; 732; 733; 734; 735; 736; 737; 738; 739; 740; 741; 742; 743; 744; 745; 746; 747; 748; 749; 750; 751; 752; 753; 754; 755; 756; 757; 758; 759; 760; 761; 762; 763; 764; 765; 766; 767; 768; 769; 770; 771; 772; 773; 774; 775; 776; 777; 778; 779; 780; 781; 782; 783; 784; 785; 786; 787; 788; 789; 790; 791; 792; 798; 799; 800; 801; 802; 803; 804; 805; 806; 807; 808; 809; 810; 811; 812; 813; 814; 815; 816; 817; 818; 819; 820; 821; 822; 823; 824; 825; 826; 827; 828; 829; 830; 831; 832; 833; 834; 835; 836; 837; 838; 839; 840; 841; 842; 843; 844; 845; 846; 847; 848; 849; 850; 851; 852; 853; 854; 855; 856; 857; 858; 859; 860; 861; 862; 863; 864; 865; 866; 867; 868; 869; 870; 871; 872; 873; 874; 875; 876; 877; 878; 879; 880; 881; 882; 883; 884; 885; 886; 887; 888; 889; 895; 896; 897; 898; 899; 900; 901; 902; 903; 904; 905; 906; 907; 908; 909; 910; 911; 912; 913; 914; 915; 916; 917; 918; 919; 920; 921; 922; 923; 924; 925; 926; 927; 928; 929; 930; 931; 932; 933; 934; 935; 936; 937; 938; 939; 940; 941; 942; 943; 944; 945; 946; 947; 948; 949; 950; 951; 952; 953; 954; 955; 956; 957; 958; 959; 960; 961; 962; 963; 964; 965; 966; 967; 968; 969; 970; 971; 972; 973; 974; 975; 976; 977; 978; 979; 980; 981; 982; 983; 984; 985; 986; 992; 993; 994; 995; 996; 997; 998; 999; 1000; 1001; 1002; 1003; 1004; 1005; 1006; 1007; 1008; 1009; 1010; 1011; 1012; 1013; 1014; 1015; 1016; 1017; 1018; 1019; 1020; 1021; 1022; 1023; 1024; 1025; 1026; 1027; 1028; 1029; 1030; 1031; 1032; 1033; 1034; 1035; 1036; 1037; 1038; 1039; 1040; 1041; 1042; 1043; 1044; 1045; 1046; 1047; 1048; 1049; 1050; 1051; 1052; 1053; 1054; 1055; 1056; 1057; 1058; 1059; 1060; 1061; 1062; 1063; 1064; 1065; 1066; 1067; 1068; 1069; 1070; 1071; 1072; 1073; 1074; 1075; 1076; 1077; 1078; 1079; 1080; 1081; 1082; 1083; 1089; 1090; 1091; 1092; 1093; 1094; 1095; 1096; 1097; 1098; 1099; 1100; 1101; 1102; 1103; 1104; 1105; 1106; 1107; 1108; 1109; 1110; 1111; 1112; 1113; 1114; 1115; 1116; 1117; 1118; 1119; 1120; 1121; 1122; 1123; 1124; 1125; 1126; 1127; 1128; 1129; 1130; 1131; 1132; 1133; 1134; 1135; 1136; 1137; 1138; 1139; 1140; 1141; 1142; 1143; 1144; 1145; 1146; 1147; 1148; 1149; 1150; 1151; 1152; 1153; 1154; 1155; 1156; 1157; 1158; 1159; 1160; 1161; 1162; 1163; 1164; 1165; 1166; 1167; 1168; 1169; 1170; 1171; 1172; 1173; 1174; 1175; 1176; 1177; 1178; 1179; 1180; 1186; 1187; 1188; 1189; 1190; 1191; 1192; 1193; 1194; 1195; 1196; 1197; 1198; 1199; 1200; 1201; 1202; 1203; 1204; 1205; 1206; 1207; 1208; 1209; 1210; 1211; 1212; 1213; 1214; 1215; 1216; 1217; 1218; 1219; 1220; 1221; 1222; 1223; 1224; 1225; 1226; 1227; 1228; 1229; 1230; 1231; 1232; 1233; 1234; 1235; 1236; 1237; 1238; 1239; 1240; 1241; 1242; 1243; 1244; 1245; 1246; 1247; 1248; 1249; 1250; 1251; 1252; 1253; 1254; 1255; 1256; 1257; 1258; 1259; 1260; 1261; 1262; 1263; 1264; 1265; 1266; 1267; 1268; 1269; 1270; 1271; 1272; 1273; 1274; 1275; 1276; 1277; 1283; 1284; 1285; 1286; 1287; 1288; 1289; 1290; 1291; 1292; 1293; 1294; 1295; 1296; 1297; 1298; 1299; 1300; 1301; 1302; 1303; 1304; 1305; 1306; 1307; 1308; 1309; 1310; 1311; 1312; 1313; 1314; 1315; 1316; 1317; 1318; 1319; 1320; 1321; 1322; 1323; 1324; 1325; 1326; 1327; 1328; 1329; 1330; 1331; 1332; 1333; 1334; 1335; 1336; 1337; 1338; 1339; 1340; 1341; 1342; 1343; 1344; 1345; 1346; 1347; 1348; 1349; 1350; 1351; 1352; 1353; 1354; 1355; 1356; 1357; 1358; 1359; 1360; 1361; 1362; 1363; 1364; 1365; 1366; 1367; 1368; 1369; 1370; 1371; 1372; 1373; 1374; 5196; 5197; 5198; 5199; 5200; 5201; 5202; 5203; 5204; 5205; 5206; 5207; 5208; 5209; 5210; 5211; 5212; 5213; 5214; 5215; 5216; 5217; 5218; 5219; 5220; 5221; 5222; 5223; 5224; 5225; 5226; 5227; 5228; 5229; 5230; 5231; 5232; 5233; 5234; 5235; 5236; 5237; 5238; 5239; 5240; 5241; 5242; 5243; 5244; 5245; 5246; 5247; 5248; 5249; 5250 or 5251 or a fragment or variant of any one of said nucleic acid sequences.

Item 6. The RNA for the use according to items 5, wherein the at least one coding sequence comprises a nucleic acid sequence, which is identical or at least 80% identical to a nucleic acid sequence according to item 5.

Item 7. The RNA for the use according to any one of the preceding items, wherein the RNA is mono-, bi-, or multicistronic.

Item 8. The RNA for the use according to any one of the preceding items, wherein the RNA is an mRNA, a viral RNA or a replicon RNA.

Item 9. The RNA for the use according to any one of the preceding items, wherein the RNA is a modified RNA, preferably a stabilized RNA.

Item 10. The RNA for the use according to any one of the preceding items, wherein a) the G/C content of the at least one coding sequence of the RNA is increased compared to the G/C content of the corresponding coding sequence of the corresponding wild type RNA, and/or wherein b) the C content of the at least one coding sequence of the RNA is increased compared to the C content of the corresponding coding sequence of the corresponding wild type RNA, and/or wherein c) the codons in the at least one coding sequence of the RNA are adapted to human codon usage, wherein the codon adaptation index (CAI) is preferably increased or maximised in the at least one coding sequence of the RNA, d) wherein the amino acid sequence encoded by the RNA is preferably not being modified compared to the amino acid sequence encoded by the corresponding wild type RNA.

Item 11. The RNA for the use according to any one of the preceding items, which comprises a 5'-cap structure and/or at least one 3'-untranslated region element (3'-UTR element).

Item 12. The RNA for the use according to any one of the preceding items, which comprises at least one histone stem-loop.

Item 13. The RNA for the use according to any one of the preceding items, wherein the at least one histone stem-loop comprises a nucleic acid sequence according to the following formulae (I) or (II):

formula (I)

(stem-loop sequence without stem bordering elements):

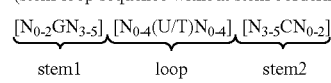

formula (II)

(stem-loop sequence with stem bordering elements):

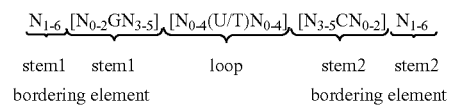

wherein:
stem1 or stem2 bordering elements $N_{1-6}$ is a consecutive sequence of 1 to 6, preferably of 2 to 6, more preferably of 2 to 5, even more preferably of 3 to 5, most preferably of 4 to 5 or 5 N, wherein each N is independently from another selected from a nucleotide selected from A, U, T, G and C, or a nucleotide analogue thereof;
stem1 $[N_{0-2}GN_{3-5}]$ is reverse complementary or partially reverse complementary with element stem2, and is a consecutive sequence between of 5 to 7 nucleotides;
  wherein $N_{0-2}$ is a consecutive sequence of 0 to 2, preferably of 0 to 1, more preferably of 1 N, wherein each N is independently from another selected from a nucleotide selected from A, U, T, G and C or a nucleotide analogue thereof;
  wherein $N_{3-5}$ is a consecutive sequence of 3 to 5, preferably of 4 to 5, more preferably of 4 N, wherein each N is independently from another selected from a nucleotide selected from A, U, T, G and C or a nucleotide analogue thereof, and
  wherein G is guanosine or an analogue thereof, and may be optionally replaced by a cytidine or an analogue thereof, provided that its complementary nucleotide cytidine in stem2 is replaced by guanosine;
loop sequence $[N_{0-4}(U/T)N_{0-4}]$ is located between elements stem1 and stem2, and is a consecutive sequence of 3 to 5 nucleotides, more preferably of 4 nucleotides;
  wherein each $N_{0-4}$ is independent from another a consecutive sequence of 0 to 4, preferably of 1 to 3, more preferably of 1 to 2 N, wherein each N is independently from another selected from a nucleotide selected from A, U, T, G and C or a nucleotide analogue thereof; and
  wherein U/T represents uridine, or optionally thymidine;
stem2 $[N_{3-5}CN_{0-2}]$ is reverse complementary or partially reverse complementary with element stem1, and is a consecutive sequence between of 5 to 7 nucleotides;
  wherein $N_{3-5}$ is a consecutive sequence of 3 to 5, preferably of 4 to 5, more preferably of 4 N, wherein each N is independently from another selected from a nucleotide selected from A, U, T, G and C or a nucleotide analogue thereof;
  wherein $N_{0-2}$ is a consecutive sequence of 0 to 2, preferably of 0 to 1, more preferably of 1 N, wherein each N is independently from another selected from a nucleotide selected from A, U, T, G and C or a nucleotide analogue thereof; and
  wherein C is cytidine or an analogue thereof, and may be optionally replaced by a guanosine or an analogue thereof provided that its complementary nucleotide guanosine in stem1 is replaced by cytidine;
wherein
stem1 and stem2 are capable of base pairing with each other
forming a reverse complementary sequence, wherein base pairing may occur between stem1 and stem2, or
forming a partially reverse complementary sequence, wherein an incomplete base pairing may occur between stem1 and stem2.

Item 14. The RNA for the use according to item 13, wherein the at least one histone stem-loop comprises a nucleic acid sequence according to the following formulae (Ia) or (IIa):

formula (Ia)
(stem-loop sequence without stem bordering elements):

$\underline{[N_{0-1}GN_{3-5}]}\,\underline{[N_{1-3}(U/T)N_{0-2}]}\,\underline{[N_{3-5}CN_{0-1}]}$
   stem1              loop                  stem2 formula (IIa)
(stem-loop sequence with stem bordering elements):

$\underline{N_{2-5}}\,\underline{[N_{0-1}GN_{3-5}]}\,\underline{[N_{1-3}(U/T)N_{0-2}]}\,\underline{[N_{3-5}CN_{0-1}]}\,\underline{N_{2-5}}$
 stem1    stem1           loop              stem2      stem2
bordering element                                    bordering element Item 15. The RNA for the use according to any one of the items 13 or 14, wherein the at least one histone stem loop comprises a nucleic acid sequence according to SEQ ID NO: 5034 and most preferably a RNA sequence according to SEQ ID NO: 5035.

Item 16. The RNA for the use according to any one of the items 13 to 15, wherein the at least one RNA comprises a poly(A) sequence, preferably comprising 10 to 200, 10 to 100, 40 to 80 or 50 to 70 adenosine nucleotides, and/or a poly(C) sequence, preferably comprising 10 to 200, 10 to 100, 20 to 70, 20 to 60 or 10 to 40 cytosine nucleotides.

Item 17. The RNA for the use according to any one of the preceding items, which comprises, preferably in 5' to 3' direction, the following elements:
a) a 5'-cap structure, preferably m7GpppN,
b) optionally a 5'-UTR element
b) at least one coding sequence as defined in item 5,
c) optionally a 3'-UTR element
d) a poly(A) tail, preferably consisting of 10 to 200, 10 to 100, 40 to 80 or 50 to 70 adenosine nucleotides,
e) optionally a poly(C) tail, preferably consisting of 10 to 200, 10 to 100, 20 to 70, 20 to 60 or 10 to 40 cytosine nucleotides, and
f) optionally a histone stem-loop, preferably comprising the RNA sequence according to SEQ ID NO: 5035.

Item 18. The RNA for the use according to any one of the preceding items, which comprises a 3'-UTR element and wherein the 3'-UTR element comprises a nucleic acid sequence derived from a 3'-UTR of a gene, which preferably encodes a stable mRNA, or from a homolog, a fragment or a variant of said gene.

Item 19. The RNA for the use according to item 18, wherein the 3'-UTR element comprises a nucleic acid sequence derived from a 3'-UTR of a gene selected from the group consisting of an albumin gene, an α-globin gene, a β-globin gene, a tyrosine hydroxylase gene, a lipoxygenase gene, and a collagen alpha gene, or from a homolog, a fragment or a variant thereof.

Item 20. The RNA for the use according to item 18 or 19, wherein the 3'-UTR element comprises a nucleic acid sequence derived from a 3'-UTR of an α-globin gene, preferably comprising the corresponding RNA sequence of the nucleic acid sequence according to SEQ ID NO: 5020 or 5022, a homolog, a fragment, or a variant thereof;

Item 21. The RNA for the use according to item 19 or 20, wherein the at least one 3'-UTR element comprises a nucleic acid sequence, which is derived from the 3'-UTR of a vertebrate albumin gene or from a variant thereof, preferably from the 3'-UTR of a mammalian albumin gene or from a variant thereof, more preferably from the 3'-UTR of a human albumin gene or from a variant thereof, even more preferably from the 3'-UTR of the human albumin gene according to GenBank Accession number NM_000477.5, or from a fragment or variant thereof.

Item 22. The RNA for the use according to item 21, wherein the 3'-UTR element is derived from a nucleic acid sequence according to SEQ ID NO: 5028, preferably from a corresponding RNA sequence, or a homolog, a fragment or a variant thereof.

Item 23. The RNA for the use according to any one of the preceding items, wherein the RNA comprises a 5'-UTR element.

Item 24. The RNA for the use according to item 23, wherein the 5'-UTR element comprises a nucleic acid sequence, which is derived from the 5'-UTR of a TOP gene, preferably from a corresponding RNA sequence, or a homolog, a fragment, or a variant thereof, preferably lacking the 5'TOP motif.

Item 25. The RNA for the use according to item 24, wherein the 5'-UTR element comprises a nucleic acid sequence, which is derived from a 5'-UTR of a TOP gene encoding a ribosomal protein, preferably from a corresponding RNA sequence, or from a homolog, a fragment or a variant thereof, preferably lacking the 5'TOP motif.

Item 26. The RNA for the use according to item 24 or 25, wherein the 5'-UTR element comprises a nucleic acid sequence, which is derived from a 5'-UTR of a TOP gene encoding a ribosomal Large protein (RPL), or from a homolog, a fragment or variant thereof, preferably lacking the 5'TOP motif.

Item 27. The RNA for the use according to any one of items 24 to 26, wherein the 5'-UTR element comprises an RNA sequence corresponding to the nucleic acid sequence according to SEQ ID NO: 5014 or 5018, or a homolog, a fragment or a variant thereof.

Item 28. The RNA for the use according to any one of the preceding items, which comprises, preferably in 5' to 3' direction, the following elements:
  a) a 5'-cap structure, preferably m7GpppN,
  b) a 5'-UTR element, which preferably comprises or consists of a nucleic acid sequence, which is derived from the 5'-UTR of a TOP gene, preferably comprising an RNA sequence corresponding to the nucleic acid sequence according to SEQ ID NO: 5014, or a homolog, a fragment or a variant thereof,]
  c) at least one coding sequence comprising or consisting of any one of the nucleic acid sequences defined in the fifth column (column "C") of Table 1, or a fragment or variant thereof,
  d) a poly(A) tail, preferably consisting of 10 to 200, 10 to 100, 40 to 80 or 50 to 70 adenosine nucleotides, Item 29. The RNA according to any one of the preceding items, which comprises, preferably in 5' to 3' direction, the following elements:
  a) a 5'-cap structure, preferably m7GpppN,
  b) a 5'-UTR element, which comprises or consists of a nucleic acid sequence, which is derived from the 5'-UTR of a TOP gene, preferably comprising an RNA sequence corresponding to the nucleic acid sequence according to SEQ ID NO: 5014, or a homolog, a fragment or a variant thereof,
  c) at least one coding sequence as defined in item 8,
  d) a 3'-UTR element comprising a nucleic acid sequence, which is derived from an α-globin gene, preferably comprising the corresponding RNA sequence of the nucleic acid sequence according to SEQ ID NO: 5026, or a homolog, a fragment or a variant thereof; and/or
    a 3'-UTR element comprising a nucleic acid sequence, which is derived from an albumin gene, preferably comprising the corresponding RNA sequence of the nucleic acid sequence according to SEQ ID NO: 5030 or 5032, or a homolog, a fragment or a variant thereof,
  e) a poly(A) tail, preferably consisting of 10 to 200, 10 to 100, 40 to 80 or 50 to 70 adenosine nucleotides,
  f) a poly(C) tail, preferably consisting of 10 to 200, 10 to 100, 20 to 70, 20 to 60 or 10 to 40 cytosine nucleotides, and
  g) a histone stem-loop, preferably comprising the RNA sequence according to SEQ ID NO: 5035.

Item 30. The RNA according to any one of items 1 to 28, which comprises, preferably in 5' to 3' direction, the following elements:
  a) a 5'-cap structure, preferably m7GpppN,
  b) a 5'-UTR element, which preferably comprises or consists of a nucleic acid sequence, which is derived from the 5'-UTR of a TOP gene, preferably comprising an RNA sequence corresponding to the nucleic acid sequence according to SEQ ID NO: 5018, or a homolog, a fragment or a variant thereof,]
  c) at least one coding sequence as defined in item 5,
  d) a poly(A) tail, preferably consisting of 10 to 200, 10 to 100, 40 to 80 or 50 to 70 adenosine nucleotides, Item 31. The RNA for the use according to any one of the preceding items, wherein the at least one coding sequence encodes a collagenase, preferably selected from MMP-1; ColH or ColG.

Item 32. The RNA for the use according to item 31, wherein said use includes the use of said RNA comprising at least one coding sequence encoding a collagenase in combination with an RNA comprising at least one coding sequence encoding a growth factor.

Item 33. Composition comprising the RNA according to any one of items 1 to 32 and a pharmaceutically acceptable carrier.

Item 34. The composition according to item 33, wherein the RNA is complexed with one or more cationic or polycationic compounds, preferably with cationic or polycationic polymers, cationic or polycationic peptides or proteins, e.g. protamine, cationic or polycationic polysaccharides and/or cationic or polycationic lipids.

Item 35. The composition according to item 34, wherein the N/P ratio of the RNA to the one or more cationic or polycationic peptides or proteins is in the range of about 0.1 to 10, including a range of about 0.3 to 4, of about 0.5 to 2, of about 0.7 to 2 and of about 0.7 to 1.5.

Item 36. The composition according to any one of items 33 to 35 comprising at least one RNA, which is complexed with one or more cationic or polycationic compounds, and at least one free RNA.

Item 37. The composition according to item 36, wherein the at least one complexed RNA is identical to the at least one free RNA.

Item 38. The composition according to item 36 or 37, wherein the molar ratio of the complexed RNA to the free RNA is selected from a molar ratio of about 0.001:1 to about 1:0.001, including a ratio of about 1:1.

Item 39. The composition according to any one of items 33 to 38, wherein the RNA is complexed with one or more lipids, thereby forming liposomes, lipid nanoparticles and/or lipoplexes.

Item 40. Kit, preferably kit of parts, comprising the RNA according to any one of items 1 to 32 or the composition according to any one of items 33 to 39, and optionally a liquid vehicle for solubilising and optionally technical instructions with information on the administration and dosage of the RNA or the composition.

Item 41. The kit according to item 40, wherein the kit contains as a part Ringer-Lactate solution.

Item 42. A combination comprising at least one RNA comprising at least one coding sequence, wherein the coding sequence encodes a therapeutic protein selected from a collagenase is selected from MMP1; ColG; ColH; MMP8; MMP9; or MMP13 or a fragment or variant thereof; and at least one RNA comprising at least one coding sequence, wherein the coding sequence encodes a therapeutic protein selected from a growth factor is selected from AMELX; AMELY; ssA-MELX; ssAMELX-001-1; ssAMELX-001-2; ssA-MELX-002; ssAMELX-003; ssAMELX-004; ssA-MELX-201; BMP1; BMP2; BMP4; BMP6; BMP7; EGF; EREG; FGF1; FGF2; FGF7; HBEGF; HGF; IGF1; IGF2; INHBA; INHBB; PDGFA; PDGFB; PDGFC; PDGFD; TGFA; TGFB1; TGFB2; TGFB3; PGF; VEGFA; VEGFA; VEGFB; VEGFC or VEGFD or a fragment or variant thereof; a cytokine selected from IL6 or CCL7 or a fragment or variant thereof; a receptor selected from ITGAM, CCR1 or TNFRSF1B or a fragment or variant thereof; a chaperone selected from HSPA1A; HSPA1B; HSPA1L; HSPA2; HSPA4; HSPA4L; HSPA5; HSPA6; HSPA7; HSPA8; HSPA9; HSPA12A; HSPA12B; HSPA13; HSPA14; HSPH1; HSP90AA1; HSP90AA3P; HSP90AB1; HSP90B1; HYOU1 or TRAP1 or a fragment or variant thereof; or a signal transduction inhibitor selected from SOCS3 or a fragment or variant thereof.

Item 43. The RNA according to any one of items 1 to 32, the composition according to any one of items 33 to 39, or the kit according to item 40 or 41 or a combination according to item 42 for use as a medicament.

Item 44. The RNA according to any one of items 1 to 32, the composition according to any one of items 33 to 39, or the kit according to item 40 or 41 or a combination according to item 42 for use in gene therapy.

Item 45. Use of the RNA according to any one of items 1 to 32, the composition according to any one of items 33 to 39, or the kit according to item 40 or 41 or a combination according to item 42 for increasing the expression of said encoded therapeutic protein.

Item 46. Use of the RNA to any one of items 1 to 32, the composition according to any one of items 33 to 39, or the kit according to item 40 or 41 or a combination according to item 42 for increasing the expression of said encoded therapeutic protein in gene therapy.

Item 47. A method for increasing the expression of an encoded peptide or protein comprising the steps of:
a) providing the RNA according to any one of items 1 to 32 or the composition according to any one of items 33 to 39 or a combination according to item 42,
b) applying or administering the RNA or the composition to a cell-free expression system, a cell, a tissue or an organism.

Item 48. Method of treating a wound, wherein the method comprises administering to a subject in need thereof an effective amount of the RNA according to any one of items 1 to 32, the composition according to any one of items 33 to 39 or a combination according to item 42.

Item 49. A wound dressing comprising the RNA according to any one of items 1 to 32, the composition according to any one of items 33 to 39 or a combination according to item 42 or a combination according to item 41.

FIGURES

FIG. 1A: Schematic drawing of the scratch assay experimental set-up in vitro. The 6-well plate was prepared for the scratch assay by drawing five horizontal lines on the bottom of the plate. Wounding of the confluent cell monolayer was achieved by scratching a 100 µl pipette tip perpendicular to the horizontal lines (vertical dotted line). Image recording was performed at indicated positions highlighted by circles.

FIG. 1B: The kinetics of wound closure in vitro was followed over time. Scratch widths were measured at start of the experiment (0 hours), 16 and 24 hours after scratching. All subsequent measurements were normalized to the scratch width at start of the experiment (set to 100%).

FIG. 1C: Endpoint analysis at the time point 24 hours after scratching. Wound closure in vitro was enhanced after transfection of CHO cells with MmHGF mRNA compared to control cells (***$p<0.001$ Student's t-test).

Figure 2:
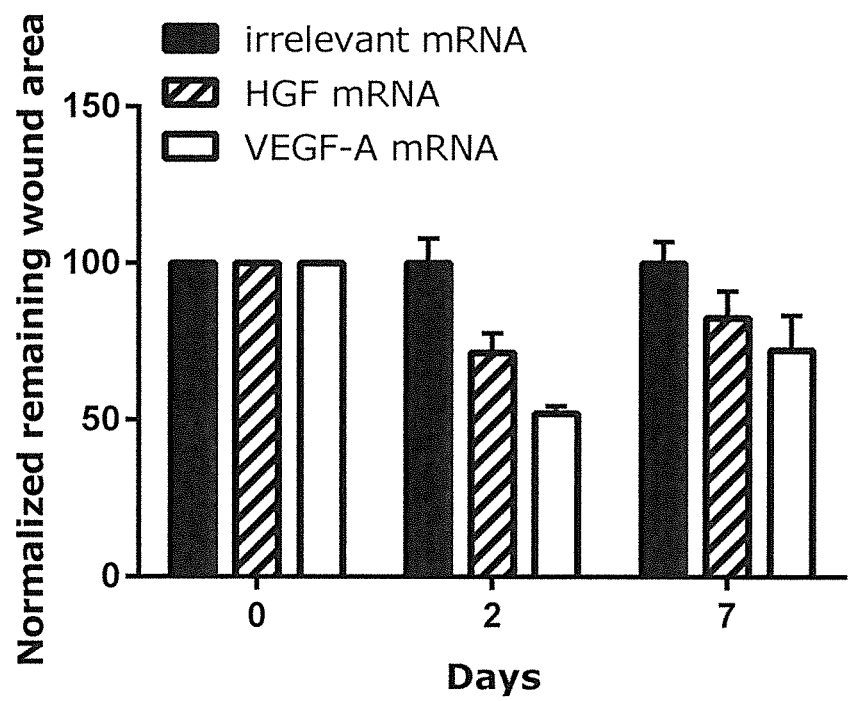

FIG. 2: Normalized remaining wound area. Wound areas induced on the back of hairless guinea pigs by full thickness punch biopsies were measured on days 0, 2, and 7 in experimental groups treated with irrelevant mRNA, Hepatocyte Growth Factor (HGF) mRNA and Vascular Endothelial Growth Factor A (VEGF-A) mRNA. Wounds at start of experiment on day 0 were set to 100% to allow for comparison. On each treatment day, wound areas were measured and normalized to the wound area in animals treated with irrelevant mRNA. Enhanced wound closure in HGF and VEGF-A mRNA treated animals was observed compared to animals treated with irrelevant mRNA. Shown are mean+/−s.e.m. (standard error of the mean) (n=4 wounds for irrelevant mRNA, n=8 wounds for HGF mRNA treated wounds, n=8 wounds for VEGF-A mRNA treated wounds).

Figure 3:
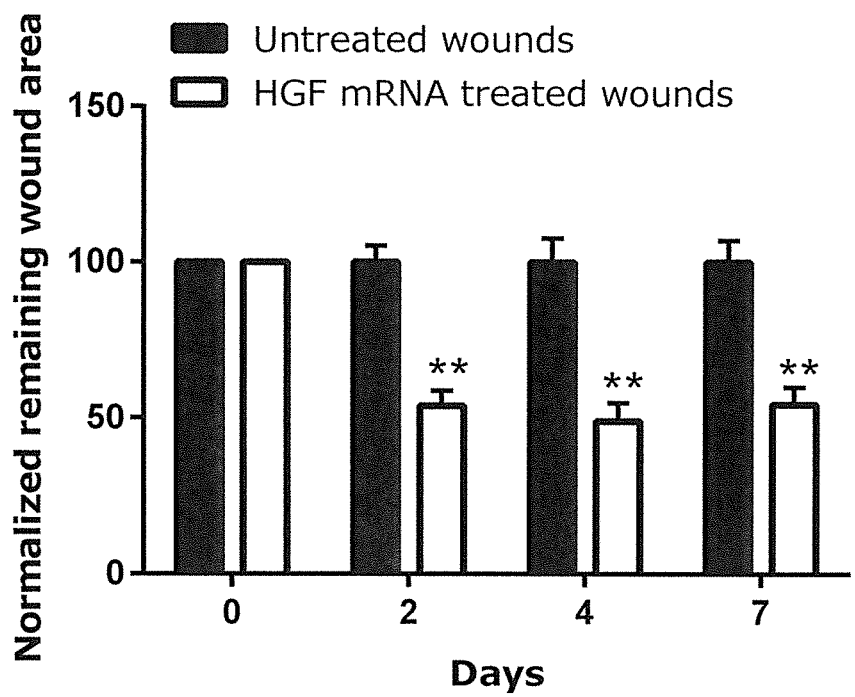

FIG. 3: Normalized remaining wound area. Wound areas induced on the back of hairless guinea pigs by full thickness punch biopsies were measured on days 0, 2, 4, and 7 in experimental groups treated with Hepatocyte Growth Factor (HGF) mRNA. Treated wounds were compared to untreated wounds of the same animal. Wounds at start of experiment on day 0 were set to 100% to allow for comparison. On each treatment day, wound areas were measured and normalized to the wound area of untreated wounds. Enhanced wound closure in HGF mRNA treated animals was observed compared to untreated wounds on each single treatment day. Shown are mean+/−s.e.m. (standard error of the mean) (n=2 untreated wounds, n=8 HGF mRNA treated wounds) (**$p<0.01$ Student's t-test).

Figure 4:
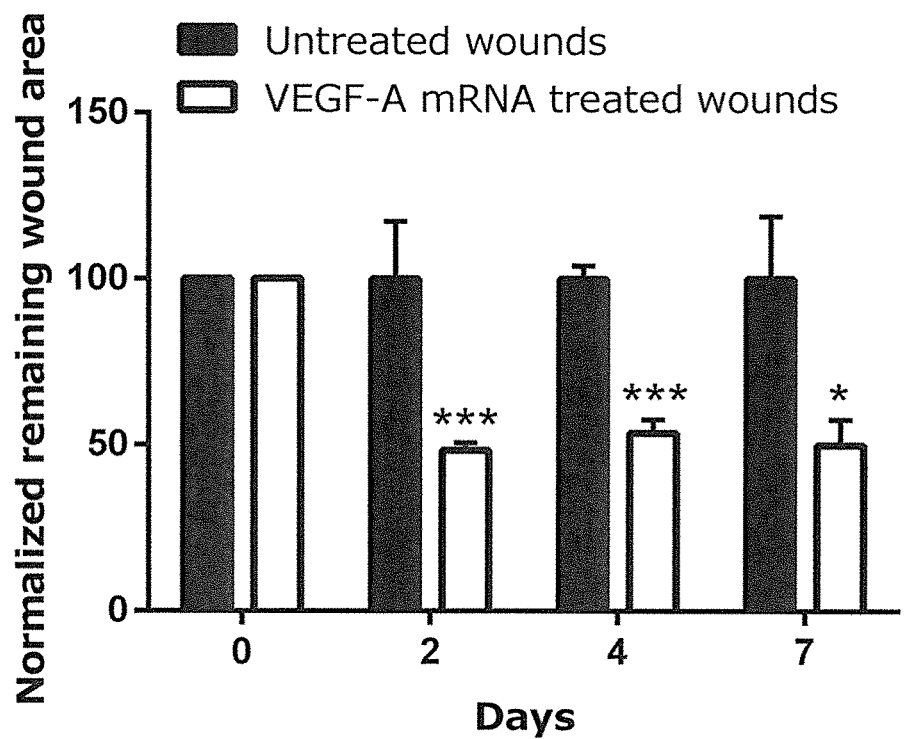

FIG. 4: Normalized remaining wound area. Wound areas induced on the back of hairless guinea pigs by full thickness punch biopsies were measured on days 0, 2, 4, and 7 in experimental groups treated with Vascular Endothelial Growth Factor A (VEGF-A) mRNA. Treated wounds were compared to untreated wounds of the same animal. Wounds at start of experiment on day 0 were set to 100% to allow for comparison. On each treatment day, wound areas were measured and normalized to the wound area of untreated wounds. Enhanced wound closure in VEGF-A mRNA treated animals was observed compared to untreated wounds on each single treatment day. Shown are mean+/−s.e.m. (standard error of the mean) (n=2 untreated wounds, n=8 VEGF-A mRNA treated wounds) (*p<0.05 and ***p<0.001 Student's t-test).

Figure 5:
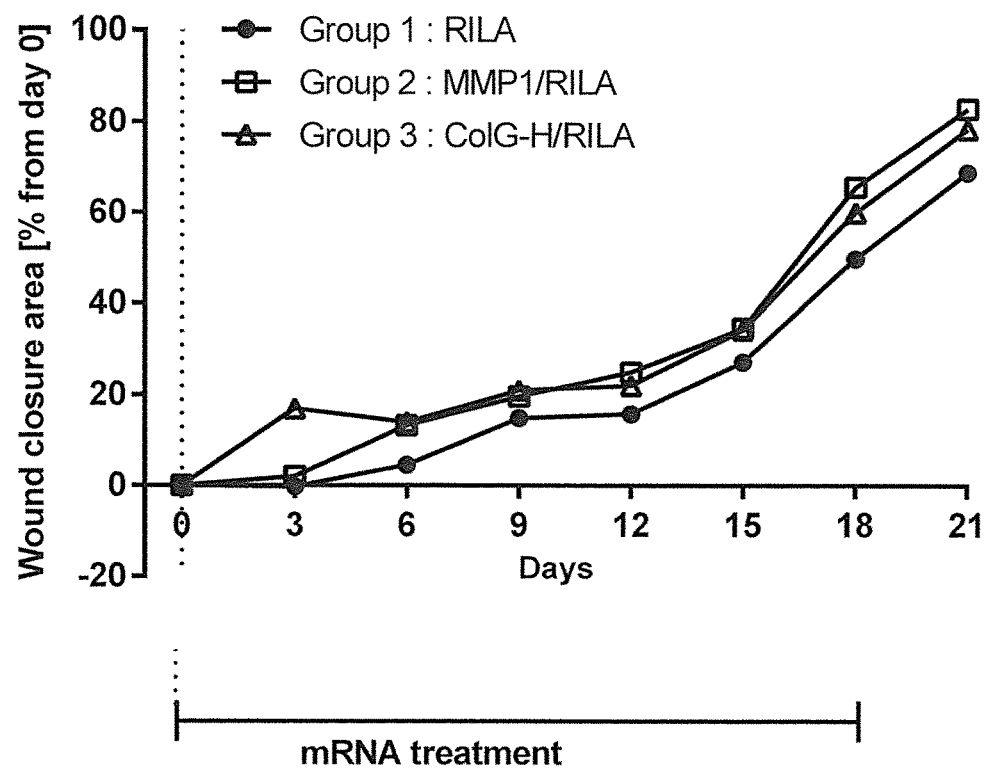

FIG. 5: Wound closure area normalized to start of wounding set to 0%. Wound areas induced on the back of diabetic mice by full thickness punch biopsies were measured on days 0, 3, 6, 9, 12, 15, 18 and on the day of termination day 21 in experimental groups treated with MMP1 mRNA and a mixture of ColG/H mRNAs, respectively. Treated wounds were compared to RiLa (Ringer Lactate) treated wounds. Wounds at start of experiment on day 0 were set to 0% to allow for comparison. On each treatment day, wound areas were measured. Enhanced wound closure in MMP1 mRNA and ColG/H mRNA treated animals was observed compared to RiLa treated wounds on each single treatment day. Shown are means for n=20 wounds for RiLa, MMP1 and ColG/H mRNA treatment.

Figure 6:
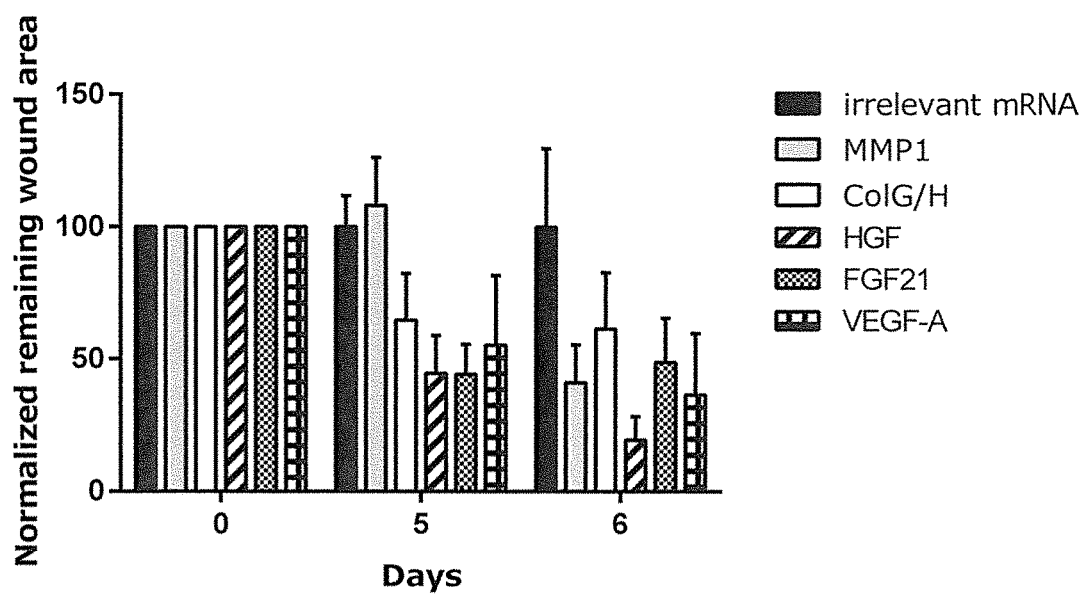

FIG. 6: Normalized remaining wound area. Wound areas induced on the back of hairless guinea pigs by full thickness punch biopsies were measured on days 0, 5, and 6 in experimental groups treated with irrelevant mRNA, Matrix Metalloproteinase 1 (MMP1) mRNA, a 1:1 mixture of Collagenase G and H (ColG/H) mRNAs, Hepatocyte Growth Factor (HGF) mRNA, Fibroblast Growth Factor 21 (FGF21) mRNA, and Vascular Endothelial Growth Factor A (VEGF-A) mRNA. Wounds at start of experiment on day 0 were set to 100% to allow for comparison. On each treatment day, wound areas were measured and normalized to the wound area in animals treated with irrelevant mRNA. Enhanced wound closure in all mRNA treated animals was observed compared to animals treated with irrelevant mRNA. Shown are mean+/−s.e.m. (standard error of the mean) (n=4 wounds for each experimental condition).

Figure 7:
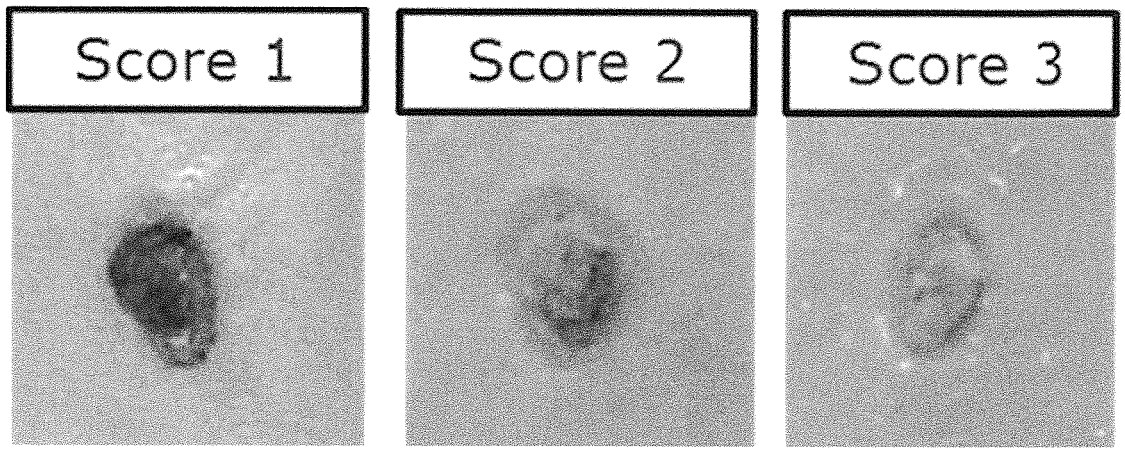
Figure 7:
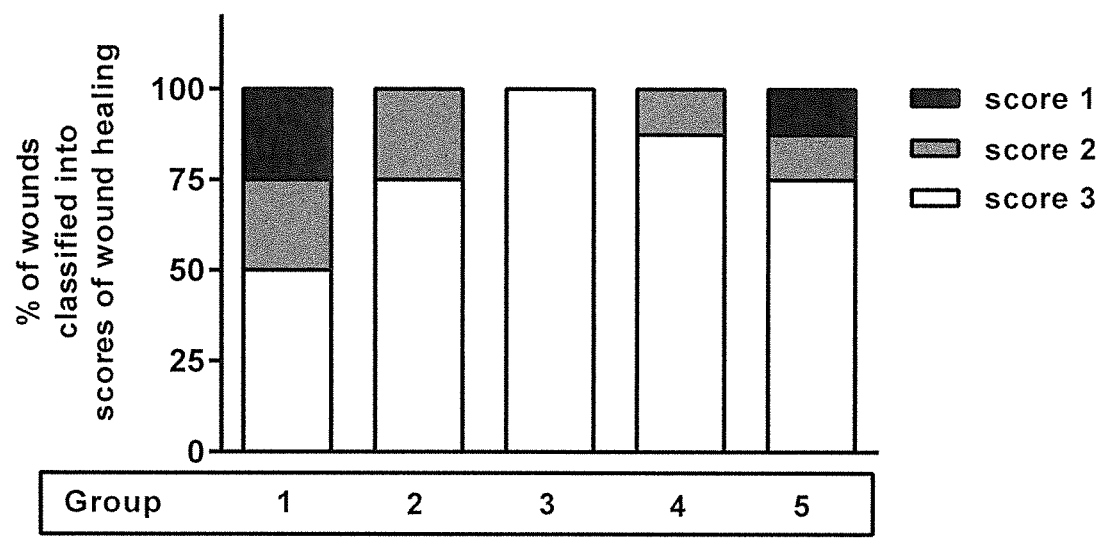

FIG. 7A: Wound areas induced on the back of hairless guinea pigs by full thickness punch biopsies were scored on day 5 in experimental groups treated with irrelevant mRNA, Matrix Metalloproteinase 1 (MMP1) mRNA, a 1:1 mixture of Collagenase G and H (ColG/H) mRNAs, Hepatocyte Growth Factor (HGF) mRNA, and Fibroblast Growth Factor 21 (FGF21) mRNA. Wounds were analysed qualitatively by a scoring system: score 1=low wound closure; score 2=medium wound closure; score 3=full wound closure. Each wound was scored and % of wounds of each score was calculated (see FIG. 7B).

FIG. 7B: Enhanced wound closure in all mRNA treated animals was observed compared to animals treated with irrelevant mRNA.

Figure 8:
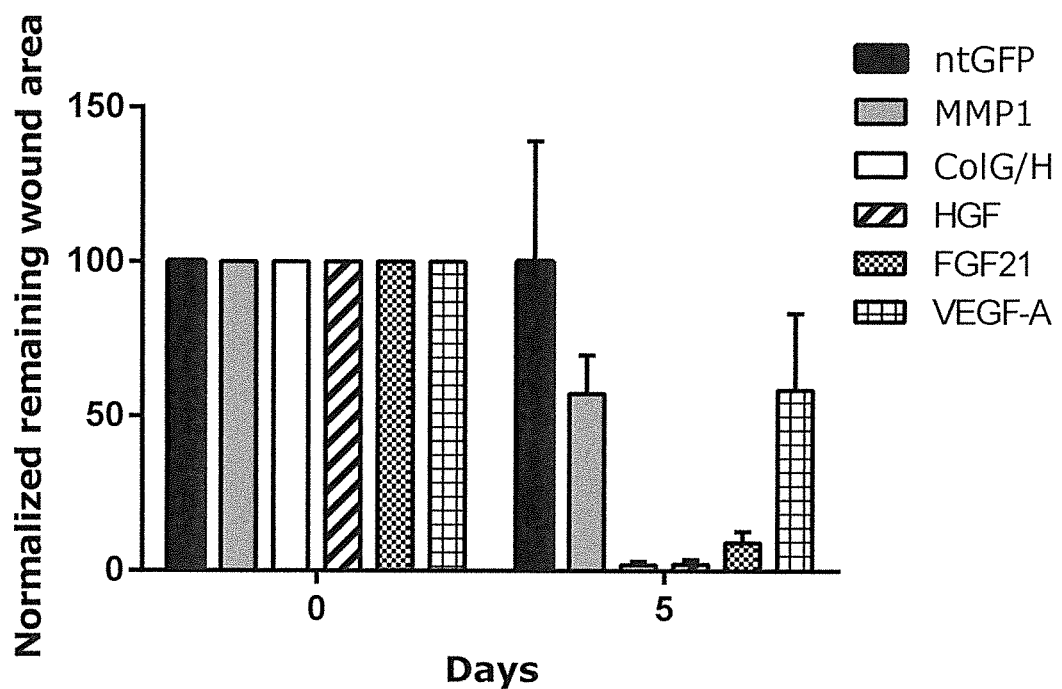

FIG. 8: Normalized remaining wound area. Wound areas induced on the back of hairless guinea pigs by full thickness punch biopsies were measured on days 0 and 5 in experimental groups treated with irrelevant mRNA, Matrix Metalloproteinase 1 (MMP1) mRNA, a 1:1 mixture of Collagenase G and H (ColG/H) mRNAs, Hepatocyte Growth Factor (HGF) mRNA, Fibroblast Growth Factor 21 (FGF21) mRNA, and Vascular Endothelial Growth Factor A (VEGF-A) mRNA. To mimic standard of care of human patients, wounds were kept wet during the life phase of the experiment by applying a self-adhesive, transparent bio-film on the wound area from day 1 onwards (i.e. Tegaderm™ I.V.; Tegaderm™ I.V. is a 3M product, referring to a polyurethane film sheet with an adhesive layer, the sheet being porous to air but providing a barrier against bacterial infection). Wounds at start of experiment on day 0 were set to 100% to allow for comparison. On each treatment day, wound areas were measured and normalized to the wound area in animals treated with irrelevant mRNA. Enhanced wound closure in all mRNA treated animals was observed compared to animals treated with irrelevant mRNA. Shown are mean+/−s.e.m. (standard error of the mean) (n=8 wounds for each experimental condition).

EXAMPLES

The Examples shown in the following are merely illustrative and shall describe the present invention in a further way. These Examples shall not be construed to limit the present invention thereto.

Example 1—Scratch Assay—In Vitro Wound Closure

Experimental Setup

The 6-well plate was prepared for the scratch assay by drawing five horizontal lines on the bottom of the plate (FIG. 1). 1.000.000 CHO cells (Chinese Hamster Ovary cells) were seeded into the 6-well plate in full culture medium (Ham's F-12+10% Fetal Calf Serum, 1% Penicillin/Streptomycin, 1% L-Glutamine) to obtain a confluent cell monolayer. 24 hours after seeding, cells were transfected with 2 μg mouse Hepatocyte Growth Factor (MmHGF) using Lipofectamine 2000. Transfection complexes remained on the cells for three hours. The transfection medium was changed to full culture medium thereafter.

8 hours after transfection, the confluent monolayer was wounded by scratching a 100 μl pipette tip perpendicular to the lines drawn on the bottom of the 6-well plate as depicted in FIG. 1A (vertical dotted lines). The serum-containing culture medium and loosened cells were removed by washing twice with PBS (Phosphate Buffered Saline). Serum-free culture medium was applied to all wells and images of the scratch width were recorded and set to 100% to allow for quantitation of the kinetics of wound closure in vitro (position of image recording highlighted by circle as depicted in FIG. 1A). The width at start of the experiment (0 h) was used for normalization of all other data points. The remaining widths of wounds in vitro were recorded during a time course of 24 hours to record kinetics of wound closure in vitro.

Results:

Wound closure in vitro is enhanced after transfection of CHO cells with MmHGF mRNA compared to control cells at all analysed time points (16 hours and 24 hours after transfection; FIGS. 1B and 1C).

Example 2—In Vivo Wound Healing Experiments with Guinea Pigs

Experimental Setup

Five punch biopsies (diameter 6 mm per biopsy) were induced on the back of each guinea pig (2 animals per group, animal model: female hairless guinea pigs from Charles River, strain code 161, animal weight ~400-450 g). On days 0, 2, 4, 7, and 9 guinea pigs were injected intradermally into the wound edges of four wounds with 4×10 μg mRNA encoding mRNAs described in Example—Table 1; one wound per animal was left untreated for comparison. Injection sites per wound were rotated by 45° on alternating injection days. On days 0, 2, 4, 7, 9 and on the day of termination day 10, wounds were photographed to allow for quantitation of wound closure. Wound area on day 0 at induction of wounds was set to 100%. On day of termination, skin biopsies were extracted, fixed in 4% paraformaldehyde, embedded in paraffin and sectioned for histological analysis. Parameters analysed on histological sections stained with Hematoxylin and Eosin include number of blood vessels/capillaries, extent of epithelization, fibrosis, and inflammation. Adjacent sections are stained with Masson Trichrome to visualize collagen content.

Example-Table 1: Study design.

| Group | # of guinea pigs | Treatment (i.d.) days 0, 2, 4, 7, 9. Harvest Day 10 | Formulation | Design | SEQ ID NO (RNA) |
|---|---|---|---|---|---|
| 1 | 2 | ntGFP | RiLa | Design2 | 7425 |
| 2 | 2 | HGF-iso1(GC) | RiLa | Design5 | 5485 |
| 3 | 2 | VEGF-A | RiLa | Design5 | 5487 |

The efficacy of mRNA treatment is assessed by its ability to enhance wound closure. For evaluation of therapeutic efficacy, 40 µg of RNA (diluted in Ringer Lactate solution) are injected into the animals (n=5) intradermally (i.d.) on days 0, 2, 4, 7, 9 (4×10 µg at four injection sites into the wound edges):

Animals in group 1 (n=2) serve as controls (i.e. administration of 40 µg irrelevant, non-therapeutic mRNA formulated in Ringer Lactate).

Animals in groups 2, 4, 5 and 6 (n=2): administration of 40 µg respective therapeutic mRNA formulated in Ringer Lactate.

Animals in group 3 (n=2): administration of a 1:1 mixture of ColG and ColH (injection of 20 µg each to result in a total amount of 40 µg) formulated in Ringer Lactate.

Results:

Enhanced wound closure in vivo was observed (FIGS. 2-4).

Example 3—In Vivo Wound Healing Experiments with Diabetic Mice

Experimental Setup

Two punch biopsies (diameter 1 cm per biopsy) were induced on the back of each diabetic mouse (db/db mouse strain) (10 animals per group). A silicon ring was adjusted around the wound to prevent wound closure by muscle contraction. On days 0, 3, 6, 9, 12, 15, and 18 mice were injected intradermally into the wound edges of four wounds with 4×10 µg mRNA encoding mRNAs described in Example—Table 2.

Example-Table 2: Study design.

| Group | # of db/db mice | Treatment (i.d.) days 0, 3, 6, 9, 12, 15, 18 Harvest Day 21 | Formulation | Design | SEQ ID NO (RNA) |
|---|---|---|---|---|---|
| 1 | 10 | Buffer only | RiLa | — | — |
| 2 | 10 | MMP1 | RiLa | Design5 | 6323 |
| 3 | 10 | ColG/H | RiLa | Design5 | 6325 + 6329 |

The efficacy of mRNA treatment is assessed by its ability to enhance wound closure. For evaluation of therapeutic efficacy, 40 µg of RNA (diluted in Ringer Lactate solution) are injected into the animals (n=10) intradermally (i.d.) on days 0, 3, 6, 9, 12, 15, 18 (4×10 µg at four injection sites into the wound edges):

Animals in group 1 (n=10) serve as controls (i.e. administration of Ringer Lactate).

Animals in groups 2 (n=10): administration of 40 µg therapeutic mRNA formulated in Ringer Lactate.

Animals in group 3: administration of a 1:1 mixture of ColG and ColH mRNAs (injection of 20 µg each to result in a total amount of 40 µg) formulated in Ringer Lactate.

Results:

On days 0, 3, 6, 9, 12, 15, 18 and on the day of termination day 21, wounds were photographed to allow for quantitation of wound closure. Wound area on day 0 at induction of wounds was set to 0% and subsequent wound closure was measured on digital images. Enhanced wound closure in vivo was observed in MMP1 and ColG/H mRNA treated wounds compared to buffer-treated wounds (Ringer Lactate (RiLa) only (FIG. 5).

Example 4—In Vivo Wound Healing Experiments with Guinea Pigs

Experimental Setup

Four punch biopsies (diameter 6 mm per biopsy) were induced on the back of each guinea pig (two animals per group, animal model: female hairless guinea pigs from Charles River, strain code 161, animal weight ~300-350 g). On days 0, 2, and 5 guinea pigs were injected intradermally into the wound edges of four wounds with 4×10 µg mRNA encoding mRNAs described in Example—Table 3. Injection sites per wound were rotated by 45° on alternating injection days.

Example-Table 3: Study design.

| Group | # of wounds | Treatment (i.d.) days 0, 2, 5 Harvest Day 6 | Formulation | SEQ ID NO (RNA) |
|---|---|---|---|---|
| 1 | 4 | ntGFP | RiLa | 7425 |
| 2 | 4 | MMP1 | RiLa | 6323 |
| 3 | 4 | ColG/H | RiLa | 6325 + 6329 |
| 4 | 4 | HGF | RiLa | 5485 |
| 5 | 4 | FGF21 | RiLa | 5479 |
| 6 | 4 | VEGF-A | RiLa | 5487 |

The efficacy of mRNA treatment is assessed by its ability to enhance wound closure. For evaluation of therapeutic efficacy, 40 µg of RNA (diluted in Ringer Lactate solution) are injected into the animals (n=4 wounds) intradermally (i.d.) on days 0, 2, 5 (4×10 µg at four injection sites into the wound edges):

Animals in group 1 serve as controls (i.e. administration of 40 µg irrelevant, non-therapeutic mRNA formulated in Ringer Lactate).

Animals in groups 2, 4, 5, 6: administration of 40 µg respective therapeutic mRNA formulated in Ringer Lactate.

Animals in group 3: administration of a 1:1 mixture of ColG and ColH (injection of 20 µg each to result in a total amount of 40 µg) formulated in Ringer Lactate.

Results:

On days 0, 2, and 5 and on the day of termination day 6, wounds were photographed to allow for comparison of wound closure. Enhanced wound closure in vivo was observed in several groups (FIG. 6).

Example 5—In Vivo Wound Healing Experiments with Guinea Pigs

Experimental Setup

Four punch biopsies (diameter 6 mm per biopsy) were induced on the back of each guinea pig (two animals per group, eight wounds per group; animal model: female hairless guinea pigs from Charles River, strain code 161). On days 0, 2, and 5 guinea pigs were injected intradermally into the wound edges of four wounds with 4×10 µg mRNA encoding mRNAs described in Example—Table 4. Injection sites per wound were rotated by 45° on alternating injection days. On days 0, 2, and 5 and on the day of termination day 6, wounds were photographed to allow for comparison of wound closure. To mimic standard of care of human patients, wounds were kept wet during the life phase of the experiment by applying a self-adhesive, transparent bio-film on the wound area from day 1 onwards (i.e. Tegadermm I.V. as described above).

Example-Table 4: Study design.

| Group | # of guinea pigs | Treatment (i.d.) days 0, 2, 5 Harvest Day 6 | Formulation | SEQ ID NO (RNA) |
|---|---|---|---|---|
| 1 | 2 | ntGFP | RiLa | 7425 |
| 2 | 2 | MMP1 | RiLa | 6323 |
| 3 | 2 | ColG/H | RiLa | 6325 + 6329 |
| 4 | 2 | HGF | RiLa | 5485 |
| 5 | 2 | FGF21 | RiLa | 5479 |

The efficacy of mRNA treatment is assessed by its ability to enhance wound closure. For evaluation of therapeutic efficacy, 40 µg of RNA (diluted in Ringer Lactate solution) are injected into the animals (n=2) intradermally (i.d.) on days 0, 2, 5 (4×10 µg at four injection sites into the wound edges):

Animals in group 1 (n=2) serve as controls (i.e. administration of 40 µg irrelevant, non-therapeutic mRNA formulated in Ringer Lactate).

Animals in groups 2, 4, 5 (n=2): administration of 40 µg respective therapeutic mRNA formulated in Ringer Lactate.

Animals in group 3: administration of a 1:1 mixture of ColG and ColH (injection of 20 µg each to result in a total amount of 40 µg) formulated in Ringer Lactate.

Results:

Wounds were analysed qualitatively by a scoring system: score 1=low wound closure; score 2=medium wound closure; score 3=full wound closure. Each wound was scored and % of wounds of each score was calculated. Enhanced wound closure in vivo was observed (FIGS. 7A and 7B).

Example 6—In Vivo Wound Healing Experiments with Guinea Pigs

Experimental Setup:

Four punch biopsies (diameter 6 mm per biopsy) were induced on the back of each guinea pig (two animals per group, eight wounds per group; animal model: female hairless guinea pigs from Charles River, strain code 161). On days 0, 2, and 5 guinea pigs were injected intradermally into the wound edges of four wounds with 4×10 µg mRNA encoding mRNAs described in Example—Table 5. Injection sites per wound were rotated by 45° on alternating injection days. On days 0, 2, and 5 and on the day of termination day 6, wounds were photographed to allow for comparison of wound closure. To mimic standard of care of human patients, wounds were kept wet during the life phase of the experiment by applying a self-adhesive, transparent bio-film on the wound area from day 1 onwards (i.e. Tegaderm™ I.V. as described above).

Example-Table 5: Study design.

| Group | # of guinea pigs | Treatment (i.d.) days 0, 2, 5 Harvest Day 6 | Formulation | SEQ ID NO (RNA) |
|---|---|---|---|---|
| 1 | 2 | R5132 = ntGFP | RiLa | 7425 |
| 2 | 2 | R6148 = MMP1 | RiLa | 6323 |
| 3 | 2 | R6149 + R6150 = ColG/H | RiLa | 6325 + 6329 |
| 4 | 2 | R6151 = HGF | RiLa | 5485 |
| 5 | 2 | R6155 = FGF21 | RiLa | 5479 |
| 6 | 2 | R6152 = VEGF-A | RiLa | 5487 |

The efficacy of mRNA treatment was assessed by its ability to enhance wound closure. For evaluation of therapeutic efficacy, 40 µg of RNA (diluted in Ringer Lactate solution) were injected into the animals (n=2) intradermally (i.d.) on days 0, 2, 5 (4×10 µg at four injection sites into the wound edges):

Animals in group 1 (n=2) served as controls (i.e. administration of 40 µg irrelevant, non-therapeutic mRNA formulated in Ringer Lactate).

Animals in groups 2, 4, 5, and 6 (n=2): administration of 40 µg respective therapeutic mRNA formulated in Ringer Lactate.

Animals in group 3: administration of a 1:1 mixture of ColG and ColH (injection of 20 µg each to result in a total amount of 40 µg) formulated in Ringer Lactate.

Results:

Wound areas were normalized to day 0 and on each subsequent day of analysis to the wound areas treated with the irrelevant, non-therapeutic mRNA (ntGFP). Enhanced wound closure in vivo was observed in all experimental groups treated with therapeutic mRNAs compared to wounds treated with irrelevant, non-therapeutic mRNA (FIG. 8).

Example 7—In Vivo Wound Healing Experiments with Mice [Prophetic]

Experimental Setup:

Two punch biopsies are taken on the back of each mouse (10 mice per group (db/db mice)). On day 0, 3, 6, 9, and 12 the mice are injected intradermally around each wound with 4×10 µg mRNA encoding the collagenase (e.g. ColH, ColG etc.). On day 0, 3, 6, 9, 12 and 15 the wound is photographed for wound closure measurement.

Results:

An enhanced wound closure is observed in several groups.

SEQUENCE LISTING (7425 sequences)

SEQ ID NO: 1 - protein, 24 aa, Artificial Sequence
  derived and/or modified protein sequence (wt) from Homo sapiens__AAA59606.1__signal peptide-HLA-A2-SP
MAVMAPRTLVLLLSGALALTQTWA

SEQ ID NO: 2 - protein, 23 aa, Artificial Sequence
  derived and/or modified protein sequence (wt) from Homo sapiens__AAA61213.1__signal peptide-HsPLAT
MDAMKRGLCCVLLLCGAVFVSPS

SEQ ID NO: 3 - protein, 27 aa, Artificial Sequence
  derived and/or modified protein sequence (wt) from Homo sapiens__NP_000790.2__signal peptide-HsEPO
MGVHECPAWLWLLLSLLSLPLGLPVLG

SEQ ID NO: 4 - protein, 18 aa, Artificial Sequence
  derived and/or modified protein sequence (wt) from Homo sapiens__NP_000468.1__signal peptide-HsALB
MKWVTFISLLFLFSSAYS

SEQ ID NO: 5 - protein, 6 aa, Artificial Sequence
  derived and/or modified protein sequence (wt) from Artificial____cleavage site-Furin
RRRRKR

SEQ ID NO: 6 - protein, 209 aa, Artificial Sequence
  derived and/or modified protein sequence (wt) from Homo sapiens__NP_061986.1__HsFGF21
MDSDETGFEHSGLWVSVLAGLLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYAS

SEQ ID NO: 7 - protein, 469 aa, Artificial Sequence
  derived and/or modified protein sequence (wt) from Homo sapiens__NP_002412.1__HsMMP1
MHSFPPLLLLLFWGVVSHSFPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 8 - protein, 389 aa, Artificial Sequence
  derived and/or modified protein sequence (wt) from Homo sapiens__NP_002412.1__HsMMP1(1-19,100-469)
MHSFPPLLLLLFWGVVSHSFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 9 - protein, 1118 aa, Artificial Sequence
  derived and/or modified protein sequence (wt) from Clostridium histolyticum__BAA77453.1__ColG
MKKNILKILMDSYSKESKIQTVRRVTSVSLLAVYLTMNTSSLVLAKPIENTNDTSIKNVEKLRNAPNEENSKKVEDSKNDKVEHVKNIEEAKVEQVAPEVKSKSTLRSASIANTNSEKYDFEYLNGLSYTELTNLIKNIKWNQINGLFNYSTGSQKFFGDKNRVQAIINALQESGRTYTANDMKGIETFTEVLRAGFYLGYYNDGLSYLNDRNFQDKCIPAMIAIQKNPNFKLGTAVQDEVITSLGKLIGNASANAEVVNNCVPVLKQFRENLNQYAPDYVKGTAVNELIKGIEFDFSGAAYEKDVKTMPWYGKIDPFINELKALGLYGNITSATEWASDVGIYYLSKFGLYSTNRNDIVQSLEKAVDMYKYGKIAFVAMERITWDYDGIGSNGKKVDHDKFLDDAEKHYLPKTYTFDNGTFIIRAGDKVSEEKIKRLYWASREVKSQFHRVVGNDKALEVGNADDVLTMKIFNSPEEYKFNTNINGVSTDNGGLYIEPRGTFYTYERTPQQSIFSLEELFRHEYTHYLQARYLVDGLWGQGPFYEKNRLTWFDEGTAEFFAGSTRTSGVLPRKSILGYLAKDKVDHRYSLKKTLNSGYDDSDWMFYNYGFAVAHYLYEKDMPTFIKMNKAILNTDVKSYDEIIKKLSDDANKNTEYQNHIQELADKYQGAGIPLVSDDYLKDHGYKKASEVYSEISKAASLTNTSVTAEKSQYFNTFTLRGTYTGETSKGEFKDWDEMSKKLDGTLESLAKNSWSGYKTLTAYFTNYRVTSDNKVQYDVVFHGVLTDNADISNNKAPIAKVTGPSTGAVGRNIEFSGKDSKDEDGKIVSYDWDFGDGATSRGKNSVHAYKKAGTYNVTLKVTDDKGATATESFTIEIKNEDTTTPITKEMEPNDDIKEANGPIVEGVTVKGDLNGSDDADTFYFDVKEDGDVTIELPYSGSSNFTWLVYKEGDDQNHIASGIDKNNSKVGTFKSTKGRHYVFIYKHDSASNISYSLNIKGLGNEKLKEKENNDSSDKATVIPNFNTTMQGSLLGDDSRDYYSFEVKEEGEVNIELDKKDEFGVTWTLHPESNINDRITYGQVDGNKVSNKVKLRPGKYYLLVYKYSGSGNYELRVNK

SEQ ID NO: 10 - protein, 1026 aa, Artificial Sequence
  derived and/or modified protein sequence (wt) from Clostridium histolyticum__BAA77453.1__HsALB(1-18)_ColG(111-1118)
MKWVTFISLLFLFSSAYSIANTNSEKYDFEYLNGLSYTELTNLIKNIKWNQINGLFNYSTGSQKFFGDKNRVQAIINALQESGRTYTANDMKGIETFTEVLRAGFYLGYYNDGLSYLNDRNFQDKCIPAMIAIQKNPNFKLGTAVQDEVITSLGKLIGNASANAEVVNNCVPVLKQFRENLNQYAPDYVKGTAVNELIKGIEFDFSGAAYEKDVKTMPWYGKIDPFINELKALGLYGNITSATEWASDVGIYYLSKFGLYSTNRNDIVQSLEKAVDMYKYGKIAFVAMERITWDYDGIGSNGKKVDHDKFLDDAEKHYLPKTYTFDNGTFIIRAGDKVSEEKIKRLYWASREVKSQFHRVVGNDKALEVGNADDVLTMKIFNSPEEYKFNTNINGVSTDNGGLYIEPRGTFYTYERTPQQSIFSLEELFRHEYTHYLQARYLVDGLWGQGPFYEKNRLTWFDEGTAEFFAGSTRTSGVLPRKSILGYLAKDKVDHRYSLKKTLNSGYDDSDWMFYNYGFAVAHYLYEKDMPTFIKMNKAILNTDVKSYDEIIKKLSDDANKNTEYQNHIQELADKYQGAGIPLVSDDYLKDHGYKKASEVYSEISKAASLTNTSVTAEKSQYFNTFTLRGTYTGETSKGEFKDWDEMSKKLDGTLESLAKNSWSGYKTLTAYFTNYRVTSDNKVQYDVVFHGVLTDNADISNNKAPIAKVTGPSTGAVGRNIEFSGKDSKDEDGKIVSYDWDFGDGATSRGKNSVHAYKKAGTYNVTLKVTDDKGATATESFTIEIKNEDTTTPITKEMEPNDDIKEANGPIVEGVTVKGDLNGSDDADTFYFDVKEDGDVTIELPYSGSSNFTWLVYKEGDDQNHIASGIDKNNSKVGTFKSTKGRHYVFIYKHDSASNISYSLNIKGLGNEKLKEKENNDSSDKATVIPNFNTTMQGSLLGDDSRDYYSFEVKEEGEVNIELDKKDEFGVTWTLHPESNINDRITYGQVDGNKVSNKVKLRPGKYYLLVYKYSGSGNYELRVNK

SEQ ID NO: 11 - protein, 1142 aa, Artificial Sequence
  derived and/or modified protein sequence (wt) from Clostridium histolyticum__BAA77453.1__HsALB(1-18)_ColG(1-110)_CS-F_ColG(111-1 118)
MKWVTFISLLFLFSSAYSMKKNILKILMDSYSKESKIQTVRRVTSVSLLAVYLTMNTSSLVLAKPIENTNDTSIKNVEKLRNAPNEENSKKVEDSKNDKVEHVKNIEEAKVEQVAPEVKSKSTLRSASRRRRKRIANTNSEKYDFEYLNGLSYTELTNLIKNIKWNQINGLFNYSTGSQKFFGDKNRVQAIINALQESGRTYTANDMKGIETFTEVLRAGFYLGYYNDGLSYLNDRNFQDKCIPAMIAIQKNPNFKLGTAVQDEVITSLGKLIGNASANAEVVNNCVPVLKQFRENLNQYAPDYVKGTAVNELIKGIEFDFSGAAYEKDVKTMPWYGKIDPFINELKALGLYGNITSATEWASDVGIYYLSKFGLYSTNRNDIVQSLEKAVDMYKYGKIAFVAMERITWDYDGIGSNGKKVDHDKFLDDAEKHYLPKTYTFDNGTFIIRAGDKVSEEKIKRLYWASREVKSQFHRVVGNDKALEVGNADDVLTMKIFNSPEEYKFNTNINGVSTDNGGLYIEPRGTFYTYERTPQQSIFSLEELFRHEYTHYLQARYLVDGLWGQGPFYEKNRLTWFDEGTAEFFAGSTRTSGVLPRKSILGYLAKDKVDHRYSLKKTLNSGYDDSDWMFYNYGFAVAHYLYEKDMPTFIKMNKAILNTDVKSYDEIIKKLSDDANKNTEYQNHIQELADKYQGAGIPLVSDDYLKDHGYKKASEVYSEISKAASLTNTSVTAEKSQYFNTFTLRGTYTGETSKGEFKDWDEMSKKLDGTLESLAKNSWSGYKTLTAYFTNYRVTSDNKVQYDVVFHGVLTDNADISNNKAPIAKVTGPSTGAVGRNIEFSGKDSKDEDGKIVSYDWDFGDGATSRGKNSVHAYKKAGTYNVTLKVTDDKGATATESFTIEIKNEDTTTPITKEMEPNDDIKEANGPIVEGVTVKGDLNGSDDADTFYFDVKEDGDVTIELPYSGSSNFTWLVYKEGDDQNHIASGIDKNNSKVGTFKSTKGRHYVFIYKHDSASNISYSLNIKGLGNEKLKEKENNDSSDKATVIPNFNTTMQGSLLGDDSRDYYSFEVKEEGEVNIELDKKDEFGVTWTLHPESNINDRITYGQVDGNKVSNKVKLRPGKYYLLVYKYSGSGNYELRVNK

SEQ ID NO: 12 - protein, 1034 aa, Artificial Sequence
  derived and/or modified protein sequence (wt) from Clostridium histolyticum__BAA34542.1__ColH
MNFLKIILNRGKTMKRKCLSKRLMLAITMATIFTVNSTLPIYAAVDKNNATAAVQNESKRYTVSYLKTLNYYDLVDLLVKTEIENLPDLFQYSSDAKEFYGNKTRMSFIMDEIGRRAPQYTEIDHKGIPTLVEVVRAGFYLGFHNKELNEINKRSFKERVIPSILAIQKNPNFKLGTEVQDKIVSATGLLAGNETAPPEVVNNFTPILQDCIKNIDRYALDDLKSKALFNVLAAPTYDITEYLRATKEKPENTPWYGKIDGFINELKKLALYGKINDNNSWIIDNGIYHIAPLGKLHSNNKIGIETLTEVMKVYPYLSMQHLQSADQIKRHYDSKDAEGNKIPLDKFKKEGKEKYCPKTYTFDDGKVIIKAGARVEEEKVKRLYWASKEVNSQFFRVYGIDKPLEEGNPDDILTMVIYNSPEEYKLNSVLYGYDTNNGGMYIEPEGTFFTYEREAQESTYTLEELFRHEYTHYLQGRYAVPGQWGRTKLYDNDRLTWYEEGGAELFAGSTRTSGILPRKSIVSNIHNTTRNNRYKLSDTVHSKYGASFEFYNYACMFMDYMYNKDMGILNKLNDLAKNNDVDGYDNYIRDLSSNYALNDKYQDHMQERIDNYENLTVPFVADDYLVRHAYKNPNEIYSEISEVAKLKDAKSEVKKSQYFSTFTLRGSYTGGASKGKLEDQKAMNKFIDDSLKKLDTYSWSGYKTLTAYFTNYKVDSSNRVTYDVVFHGYLPNEGDSKNSLPYGKINGTYKGTEKEKIKFSSEGSFDPDGKIVSYEWDFGDGNKSNEENPEHSYDKVGTYTVKLKVTDDKGESSVSTTTAEIKDLSENKLPVIYMHVPKSGALNQKVVFYGKGTYDPDGSIAGYQWDFGDGSDFSSEQNPSHVYTKKGEYTVTLRVMDSSGQMSEKTMKIKITDPVYPIGTEKEPNNSKETASGPIVPGIPVSGTIENTSDQDYFYFDVITPGEVKIDINKLGYGGATWVVYDENNNAVSYATDDGQNLSGKFKADKPGRYYIHLYMFNGSYMPYRINIEGSVGR

SEQ ID NO: 13 - protein, 1021 aa, Artificial Sequence
  derived and/or modified protein sequence (wt) from Clostridium histolyticum__BAA34542.1__ColH
MKRKCLSKRLMLAITMATIFTVNSTLPIYAAVDKNNATAAVQNESKRYTVSYLKTLNYYDLVDLLVKTEIENLPDLFQYSSDAKEFYGNKTRMSFIMDEIGRRAPQYTEIDHKGIPTLVEVVRAGFYLGFHNKELNEINKRSFKERVIPSILAIQKNPNFKLGTEVQDKIVSATGLLAGNETAPPEVVNNFTPILQDCIKNIDRYALDDLKSKALFNVLAAPTYDITEYLRATKEKPENTPWYGKIDGFINELKKLALYGKINDNNSWIIDNGIYHIAPLGKLHSNNKIGIETLTEVMKVYPYLSMQHLQSADQIKRHYDSKDAEGNKIPLDKFKKEGKEKYCPKTYTFDDGKVIIKAGARVEEEKVKRLYWASKEVNSQFFRVYGIDKPLEEGNPDDILTMVIYNSPEEYKLNSVLYGYDTNNGGMYIEPEGTFFTYEREAQESTYTLEELFRHEYTHYLQGRYAVPGQWGRTKLYDNDRLTWYEEGGAELFAGSTRTSGILPRKSIVSNIHNTTRNNRYKLSDTVHSKYGASFEFYNYACMFMDYMYNKDMGILNKLNDLAKNNDVDGYDNYIRDLSSNYALNDKYQDHMQERIDNYENLTVPFVADDYLVRHAYKNPNEIYSEISEVAKLKDAKSEVKKSQYFSTFTLRGSYTGGASKGKLEDQKAMNKFIDDSLKKLDTYSWSGYKTLTAYFTNYKVDSSNRVTYDVVFHGYLPNEGDSKNSLPYGKINGTYKGTEKEKIKFSSEGSFDPDGKIVSYEWDFGDGNKSNEENPEHSYDKVGTYTVKLKVTDDKGESSVSTTTAEIKDLSENKLPVIYMHVPKSGALNQKVVFYGKGTYDPDGSIAGYQWDFGDGSDFSSEQNPSHVYTKKGEYTVTLRVMDSSGQMSEKTMKIKITDPVYPIGTEKEPNNSKETASGPIVPGIPVSGTIENTSDQDYFYFDVITPGEVKIDINKLGYGGATWVVYDENNNAVSYATDDGQNLSGKFKADKPGRYYIHLYMFNGSYMPYRINIEGSVGR

SEQ ID NO: 14 - protein, 999 aa, Artificial Sequence
  derived and/or modified protein sequence (wt) from Clostridium histolyticum__BAA34542.1__HsALB(1-18)_ColH(41-1021)
MKWVTFISLLFLFSSAYSVQNESKRYTVSYLKTLNYYDLVDLLVKTEIENLPDLFQYSSDAKEFYGNKTRMSFIMDEIGRRAPQYTEIDHKGIPTLVEVVRAGFYLGFHNKELNEINKRSFKERVIPSILAIQKNPNFKLGTEVQDKIVSATGLLAGNETAPPEVVNNFTPILQDCIKNIDRYALDDLKSKALFNVLAAPTYDITEYLRATKEKPENTPWYGKIDGFINELKKLALYGKINDNNSWIIDNGIYHIAPLGKLHSNNKIGIETLTEVMKVYPYLSMQHLQSADQIKRHYDSKDAEGNKIPLDKFKKEGKEKYCPKTYTFDDGKVIIKAGARVEEEKVKRLYWASKEVNSQFFRVYGIDKPLEEGNPDDILTMVIYNSPEEYKLNSVLYGYDTNNGGMYIEPEGTFFTYEREAQESTYTLEELFRHEYTHYLQGRYAVPGQWGRTKLYDNDRLTWYEEGGAELFAGSTRTSGILPRKSIVSNIHNTTRNNRYKLSDTVHSKYGASFEFYNYACMFMDYMYNKDMGILNKLNDLAKNNDVDGYDNYIRDLSSNYALNDKYQDHMQERIDNYENLTVPFVADDYLVRHAYKNPNEIYSEISEVAKLKDAKSEVKKSQYFSTFTLRGSYTGGASKGKLEDQKAMNKFIDDSLKKLDTYSWSGYKTLTAYFTNYKVDSSNRVTYDVVFHGYLPNEGDSKNSLPYGKINGTYKGTEKEKIKFSSEGSFDPDGKIVSYEWDFGDGNKSNEENPEHSYDKVGTYTVKLKVTDDKGESSVSTTTAEIKDLSENKLPVIYMHVPKSGALNQKVVFYGKGTYDPDGSIAGYQWDFGDGSDFSSEQNPSHVYTKKGEYTVTLRVMDSSGQMSEKTMKIKITDPVYPIGTEKEPNNSKETASGPIVPGIPVSGTIENTSDQDYFYFDVITPGEVKIDINKLGYGGATWVVYDENNNAVSYATDDGQNLSGKFKADKPGRYYIHLYMFNGSYMPYRINIEGSVGR

SEQ ID NO: 15 - protein, 1045 aa, Artificial Sequence
  derived and/or modified protein sequence (wt) from Clostridium histolyticum__BAA34542.1__HsALB(1-18)_ColH(1-40)_CS-F_ColH(41-102 1)
MKWVTFISLLFLFSSAYSMKRKCLSKRLMLAITMATIFTVNSTLPIYAAVDKNNATAARRRRKRVQNESKRYTVSYLKTLNYYDLVDLLVKTEIENLPDLFQYSSDAKEFYGNKTRMSFIMDEIGRRAPQYTEIDHKGIPTLVEVVRAGFYLGFHNKELNEINKRSFKERVIPSILAIQKNPNFKLGTEVQDKIVSATGLLAGNETAPPEVVNNFTPILQDCIKNIDRYALDDLKSKALFNVLAAPTYDITEYLRATKEKPENTPWYGKIDGFINELKKLALYGKINDNNSWIIDNGIYHIAPLGKLHSNNKIGIETLTEVMKVYPYLSMQHLQSADQIKRHYDSKDAEGNKIPLDKFKKEGKEKYCPKTYTFDDGKVIIKAGARVEEEKVKRLYWASKEVNSQFFRVYGIDKPLEEGNPDDILTMVIYNSPEEYKLNSVLYGYDTNNGGMYIEPEGTFFTYEREAQESTYTLEELFRHEYTHYLQGRYAVPGQWGRTKLYDNDRLTWYEEGGAELFAGSTRTSGILPRKSIVSNIHNTTRNNRYKLSDTVHSKYGASFEFYNYACMFMDYMYNKDMGILNKLNDLAKNNDVDGYDNYIRDLSSNYALNDKYQDHMQERIDNYENLTVPFVADDYLVRHAYKNPNEIYSEISEVAKLKDAKSEVKKSQYFSTFTLRGSYTGGASKGKLEDQKAMNKFIDDSLKKLDTYSWSGYKTLTAYFTNYKVDSSNRVTYDVVFHGYLPNEGDSKNSLPYGKINGTYKGTEKEKIKFSSEGSFDPDGKIVSYEWDFGDGNKSNEENPEHSYDKVGTYTVKLKVTDDKGESSVSTTTAEIKDLSENKLPVIYMHVPKSGALNQKVVFYGKGTYDPDGSIAGYQWDFGDGSDFSSEQNPSHVYTKKGEYTVTLRVMDSSGQMSEKTMKIKITDPVYPIGTEKEPNNSKETASGPIVPGIPVSGTIENTSDQDYFYFDVITPGEVKIDINKLGYGGATWVVYDENNNAVSYATDDGQNLSGKFKADKPGRYYIHLYMFNGSYMPYRINIEGSVGR

SEQ ID NO: 16 - protein, 191 aa, Artificial Sequence
  derived and/or modified protein sequence (wt) from Homo sapiens__NP_001133.1__HsAMELX
MGTWILFACLLGAAFAMPLPPHPGHPGYINFSYEVLTPLKWYQSIRPPYPSYGYEPMGGWLHHQIIPVLSQQHPPTHTLQPHHHIPVVPAQQPVIPQQPMMPVPGQHSMTPIQHHQPNLPPPAQQPYQPQPVQPQPHQPMQPQPPVHPMQPLPPQPPLPPMFPMQPLPPMLPDLTLEAWPSTDKTKREEVD

SEQ ID NO: 17 - protein, 44 aa, Artificial Sequence
  derived and/or modified protein sequence (wt) from Homo sapiens__NP_001133.1__HsAMELX-TRAP
MPLPPHPGHPGYINFSYEVLTPLKWYQSIRPPYPSYGYEPMGGW

SEQ ID NO: 18 - protein, 55 aa, Artificial Sequence
  derived and/or modified protein sequence (wt) from Homo sapiens__NP_001133.1__HsAMELX-LRAP
MPLPPHPGHPGYINFSYEVLTPLKWYQSIRPPPMLPDLTLEAWPSTDKTKREEVD

SEQ ID NO: 19 - protein, 68 aa, Artificial Sequence
  derived and/or modified protein sequence (wt) from Homo sapiens__NP_001133.1__HLA-A2-SP_HsAMELX(17-60)
MAVMAPRTLVLLLSGALALTQTWAMPLPPHPGHPGYINFSYEVLTPLKWYQSIRPPYPSYGYEPMGGW

SEQ ID NO: 20 - protein, 79 aa, Artificial Sequence
  derived and/or modified protein sequence (wt) from Homo sapiens__NP_001133.1__HLA-A2-SP_HsAMELX(17-47,168-191)
MAVMAPRTLVLLLSGALALTQTWAMPLPPHPGHPGYINFSYEVLTPLKWYQSIRPPPMLPDLTLEAWPSTDKTKREEVD

SEQ ID NO: 21 - protein, 192 aa, Artificial Sequence
  derived and/or modified protein sequence (wt) from Homo sapiens__NP_001134.1__HsAMELY
MGTWILFACLVGAAFAMPLPPHPGHPGYINFSYEVLTPLKWYQSMIRPPYSSYGYEPMGGWLHHQIIPVVSQQHPLTHTLQSHHHIPVVPAQQPRVRQQALMPVPGQQSMTPTQHHQPNLPLPAQQPFQPQPVQPQPHQPMQPQPPVQPMQPLLPQPPLPPMFPLRPLPPILPDLHLEAWPATDKTKQEEVD

SEQ ID NO: 22 - protein, 45 aa, Artificial Sequence
  derived and/or modified protein sequence (wt) from Homo sapiens__NP_001134.1__HsAMELY-TRAP
MPLPPHPGHPGYINFSYEVLTPLKWYQSMIRPPYSSYGYEPMGGW

SEQ ID NO: 23 - protein, 56 aa, Artificial Sequence
  derived and/or modified protein sequence (wt) from Homo sapiens__NP_001134.1__HsAMELY-LRAP
MPLPPHPGHPGYINFSYEVLTPLKWYQSMIRPPPILPDLHLEAWPATDKTKQEEVD

SEQ ID NO: 24 - protein, 69 aa, Artificial Sequence
  derived and/or modified protein sequence (wt) from Homo sapiens__NP_001134.1__HLA-A2-SP_HsAMELY(17-61)
MAVMAPRTLVLLLSGALALTQTWAMPLPPHPGHPGYINFSYEVLTPLKWYQSMIRPPYSSYGYEPMGGW

SEQ ID NO: 25 - protein, 80 aa, Artificial Sequence
  derived and/or modified protein sequence (wt) from Homo sapiens__NP_001134.1__HLA-A2-SP_HsAMELY(17-48,169-192)
MAVMAPRTLVLLLSGALALTQTWAMPLPPHPGHPGYINFSYEVLTPLKWYQSMIRPPPILPDLHLEAWPATDKTKQEEVD

SEQ ID NO: 26 - protein, 189 aa, Artificial Sequence
  derived and/or modified protein sequence (wt) from Sus scrofa__NP_999071.1__SsAMELX-001-1
MGTWILFACLLGAAFSMPLPPHPGHPGYINFSYEVLTPLKWYQNMIRHPYTSYGYEPMGGWLHHQIIPVVSQQTPQSHALQPHHHIPMVPAQQPGIPQQPMMPLPGQHSMTPTQHHQPNLPLPAQQPFQPQPVQPQPHQPLQPQSPMHPIQPLLPQPPLPPMFSMQSLLPDLPLEAWPATDKTKREEVD

SEQ ID NO: 27 - protein, 45 aa, Artificial Sequence
  derived and/or modified protein sequence (wt) from Sus scrofa__NP_999071.1__SsAMELX-TRAP
MPLPPHPGHPGYINFSYEVLTPLKWYQNMIRHPYTSYGYEPMGGW

SEQ ID NO: 28 - protein, 56 aa, Artificial Sequence
  derived and/or modified protein sequence (wt) from Sus scrofa__NP_999071.1__SsAMELX-LRAP
MPLPPHPGHPGYINFSYEVLTPLKWYQNMIRHPSLLPDLPLEAWPATDKTKREEVD

SEQ ID NO: 29 - protein, 69 aa, Artificial Sequence
  derived and/or modified protein sequence (wt) from Sus scrofa__NP_999071.1__HLA-A2-SP_SsAMEL(17-61)
MAVMAPRTLVLLLSGALALTQTWAMPLPPHPGHPGYINFSYEVLTPLKWYQNMIRHPYTSYGYEPMGGW

SEQ ID NO: 30 - protein, 80 aa, Artificial Sequence
  derived and/or modified protein sequence (wt) from Sus scrofa__NP_999071.1__HLA-A2-SP_SsAMEL(17-49,167-189)
MAVMAPRTLVLLLSGALALTQTWAMPLPPHPGHPGYINFSYEVLTPLKWYQNMIRHPSLLPDLPLEAWPATDKTKREEVD

SEQ ID NO: 31 - protein, 177 aa, Artificial Sequence
  derived and/or modified protein sequence (wt) from Sus scrofa__P45561-2__SsAMELX-001-2
MGTWILFACLLGAAFSMPLPPHPGHPGYINFSYIRHPYTSYGYEPMGGWLHHQIIPVVSQQTPQSHALQPHHHIPMVPAQQPGIPQQPMMPLPGQHSMTPTQHHQPNLPLPAQQPFQPQPVQPQPHQPLQPQSPMHPIQPLLPQPPLPPMFSMQSLLPDLPLEAWPATDKTKREEVD

SEQ ID NO: 32 - protein, 189 aa, Artificial Sequence
  derived and/or modified protein sequence (wt) from Sus scrofa__NP_998965.1__SsAMELX-001-3
MGTWIFFACLLGASLAMPLPPHPGHPGYINFSYEVLTPLKWYQNMIRHPYTSYGYEPMGGWLHHQIIPVVSQQTPQSHALQPHHHIPMVPAQQPGIPQQPMMPLPGQHSMTPTQHHQPNLPLPAQQPFQPQPVQPQPHQPLQPQSPMHPIQPLLPQPPLPPMFSMQSLLPDLPLEAWPATDKTKREEVD

SEQ ID NO: 33 - protein, 72 aa, Artificial Sequence
  derived and/or modified protein sequence (wt) from Sus scrofa__K7GPB2__SsAMELX-002
MGTWILFACLLGAAFSMPLPPHPGHPGYINFSYEVLTPLKWYQNMIRHPSLLPDLPLEAWPATDKTKREEVD

SEQ ID NO: 34 - protein, 203 aa, Artificial Sequence
  derived and/or modified protein sequence (wt) from Sus scrofa__K7GLD0__SsAMELX-003
MGTWILFACLLGAAFSMPLPPHPGHPGYINFSYEDLYLEAIRIDRTAFVLTPLKWYQNMIRHPYTSYGYEPMGGWLHHQIIPVVSQQTPQSHALQPHHHIPMVPAQQPGIPQQPMMPLPGQHSMTPTQHHQPNLPLPAQQPFQPQPVQPQPHQPLQPQSPMHPIQPLLPQPPLPPMFSMQSLLPDLPLEAWPATDKTKREEVD

SEQ ID NO: 35 - protein, 165 aa, Artificial Sequence
  derived and/or modified protein sequence (wt) from Sus scrofa__K7GPE9__SsAMELX-004
MGTWILFACLLGAAFSMPLPPHPGHPGYINFSYEVLTPLKWYQNMIRHPTPQSHALQPHHHIPMVPAQQPGIPQQPMMPLPGQHSMTPTQHHQPNLPLPAQQPFQPQPVQPQPHQPLQPQSPMHPIQPLLPQPPLPPMFSMQSLLPDLPLEAWPATDKTKREEVD

SEQ ID NO: 36 - protein, 173 aa, Artificial Sequence
  derived and/or modified protein sequence (wt) from Sus scrofa__J9JIM4__SsAMELX-201
MPLPPHPGHPGYINFSYEVLTPLKWYQNMIRHPYTSYGYEPMGGWLHHQIIPVVSQQTPQSHALQPHHHIPMVPAQQPGIPQQPMMPLPGQHSMTPTQHHQPNLPLPAQQPFQPQPVQPQPHQPLQPQSPMHPIQPLLPQPPLPPMFSMQSLLPDLPLEAWPATDKTKREEVD

SEQ ID NO: 37 - protein, 986 aa, Artificial Sequence
  derived and/or modified protein sequence (wt) from Homo sapiens__NP_006120.1__HsBMP1
MPGVARLPLLLGLLLLPRPGRPLDLADYTYDLAEEDDSEPLNYKDPCKAAAFLGDIALDEEDLRAFQVQQAVDLRRHTARKSSIKAAVPGNTSTPSCQSTNGQPQRGACGRWRGRSRSRRAATSRPERVWPDGVIPFVIGGNFTGSQRAVFRQAMRHWEKHTCVTFLERTDEDSYIVFTYRPCGCCSYVGRRGGGPQAISIGKNCDKFGIVVHELGHVVGFWHEHTRPDRDRHVSIVRENIQPGQEYNFLKMEPQEVESLGETYDFDSIMHYARNTFSRGIFLDTIVPKYEVNGVKPPIGQRTRLSKGDIAQARKLYKCPACGETLQDSTGNFSSPEYPNGYSAHMHCVWRISVTPGEKIILNFTSLDLYRSRLCWYDYVEVRDGFWRKAPLRGRFCGSKLPEPIVSTDSRLWVEFRSSSNWVGKGFFAVYEAICGGDVKKDYGHIQSPNYPDDYRPSKVCIWRIQVSEGFHVGLTFQSFEIERHDSCAYDYLEVRDGHSESSTLIGRYCGYEKPDDIKSTSSRLWLKFVSDGSINKAGFAVNFFKEVDECSRPNRGGCEQRCLNTLGSYKCSCDPGYELAPDKRRCEAACGGFLTKLNGSITSPGWPKEYPPNKNCIWQLVAPTQYRISLQFDFFETEGNDVCKYDFVEVRSGLTADSKLHGKFCGSEKPEVITSQYNNMRVEFKSDNTVSKKGFKAHFFSDKDECSKDNGGCQQDCVNTFGSYECQCRSGFVLHDNKHDCKEAGCDHKVTSTSGTITSPNWPDKYPSKKECTWAISSTPGHRVKLTFMEMDIESQPECAYDHLEVFDGRDAKAPVLGRFCGSKKPEPVLATGSRMFLRFYSDNSVQRKGFQASHATECGGQVRADVKTKDLYSHAQFGDNNYPGGVDCEWVIVAEEGYGVELVFQTFEVEEETDCGYDYMELFDGYDSTAPRLGRYCGSGPPEEVYSAGDSVLVKFHSDDTITKKGFHLRYTSTKFQDTLHSRK

SEQ ID NO: 38 - protein, 396 aa, Artificial Sequence
  derived and/or modified protein sequence (wt) from Homo sapiens__NP_001191.1__HsBMP2
MVAGTRCLLALLLPQVLLGGAAGLVPELGRRKFAAASSGRPSSQPSDEVLSEFELRLLSMFGLKQRPTPSRDAVVPPYMLDLYRRHSGQPGSPAPDHRLERAASRANTVRSFHHEESLEELPETSGKTTRRFFFNLSSIPTEEFITSAELQVFREQMQDALGNNSSFHHRINIYEIIKPATANSKFPVTRLLDTRLVNQNASRWESFDVTPAVMRWTAQGHANHGFVVEVAHLEEKQGVSKRHVRISRSLHQDEHSWSQIRPLLVTFGHDGKGHPLHKREKRQAKHKQRKRLKSSCKRHPLYVDFSDVGWNDWIVAPPGYHAFYCHGECPFPLADHLNSTNHAIVQTLVNSVNSKIPKACCVPTELSAISMLYLDENEKVVLKNYQDMVVEGCGCR

SEQ ID NO: 39 - protein, 408 aa, Artificial Sequence
  derived and/or modified protein sequence (wt) from Homo sapiens__NP_001193.2__HsBMP4
MIPGNRMLMVVLLCQVLLGGASHASLIPETGKKKVAEIQGHAGGRRSGQSHELLRDFEATLLQMFGLRRRPQPSKSAVIPDYMRDLYRLQSGEEEEEQIHSTGLEYPERPASRANTVRSFHHEEHLENIPGTSENSAFRFLFNLSSIPENEVISSAELRLFREQVDQGPDWERGFHRINIYEVMKPPAEVVPGHLITRLLDTRLVHHNVTRWETFDVSPAVLRWTREKQPNYGLAIEVTHLHQTRTHQGQHVRISRSLPQGSGNWAQLRPLLVTFGHDGRGHALTRRRRAKRSPKHHSQRARKKNKNCRRHSLYVDFSDVGWNDWIVAPPGYQAFYCHGDCPFPLADHLNSTNHAIVQTLVNSVNSSIPKACCVPTELSAISMLYLDEYDKVVLKNYQEMVVEGCGCR

SEQ ID NO: 40 - protein, 513 aa, Artificial Sequence
  derived and/or modified protein sequence (wt) from Homo sapiens__NP_001709.1__HsBMP6
MPGLGRRAQWLCWWWGLLCSCCGPPPLRPPLPAAAAAAAGGQLLGDGGSPGRTEQPPPSPQSSSGFLYRRLKTQEKREMQKEILSVLGLPHRPRPLHGLQQPQPPALRQQEEQQQQQQLPRGEPPPGRLKSAPLFMLDLYNALSADNDEDGASEGERQQSWPHEAASSSQRRQPPPGAAHPLNRKSLLAPGSGSGGASPLTSAQDSAFLNDADMVMSFVNLVEYDKEFSPRQRHHKEFKFNLSQIPEGEVVTAAEFRIYKDCVMGSFKNQTFLISIYQVLQEHQHRDSDLFLLDTRVVWASEEGWLEFDITATSNLWVVTPQHNMGLQLSVVTRDGVHVHPRAAGLVGRDGPYDKQPFMVAFFKVSEVHVRTTRSASSRRRQQSRNRSTQSQDVARVSSASDYNSSELKTACRKHELYVSFQDLGWQDWIIAPKGYAANYCDGECSFPLNAHMNATNHAIVQTLVHLMNPEYVPKPCCAPTKLNAISVLYFDDNSNVILKKYRNMVVRACGCH

SEQ ID NO: 41 - protein, 431 aa, Artificial Sequence
  derived and/or modified protein sequence (wt) from Homo sapiens__NP_001710.1__HsBMP7
MHVRSLRAAAPHSFVALWAPLFLLRSALADFSLDNEVHSSFIHRRLRSQERREMQREILSILGLPHRPRPHLQGKHNSAPMFMLDLYNAMAVEEGGGPGGQGFSYPYKAVFSTQGPPLASLQDSHFLTDADMVMSFVNLVEHDKEFFHPRYHHREFRFDLSKIPEGEAVTAAEFRIYKDYIRERFDNETFRISVYQVLQEHLGRESDLFLLDSRTLWASEEGWLVFDITATSNHWVVNPRHNLGLQLSVETLDGQSINPKLAGLIGRHGPQNKQPFMVAFFKATEVHFRSIRSTGSKQRSQNRSKTPKNQEALRMANVAENSSSDQRQACKKHELYVSFRDLGWQDWIIAPEGYAAYYCEGECAFPLNSYMNATNHAIVQTLVHFINPETVPKPCCAPTQLNAISVLYFDDSSNVILKKYRNMVVRACGCH

SEQ ID NO: 42 - protein, 99 aa, Artificial Sequence
  derived and/or modified protein sequence (wt) from Homo sapiens__NP_006264.2__HsCCL7
MKASAALLCLLLTAAAFSPQGLAQPVGINTSTTCCYRFINKKIPKQRLESYRRTTSSHCPREAVIFKTKLDKEICADPTQKWVQDFMKHLDKKTQTPKL

SEQ ID NO: 43 - protein, 1207 aa, Artificial Sequence
  derived and/or modified protein sequence (wt) from Homo sapiens__NP_001954.2__HsEGF
MLLTLIILLPVVSKFSFVSLSAPQHWSCPEGTLAGNGNSTCVGPAPFLIFSHGNSIFRIDTEGTNYEQLVVDAGVSVIMDFHYNEKRIYWVDLERQLLQRVFLNGSRQERVCNIEKNVSGMAINWINEEVIWSNQQEGIITVTDMKGNNSHILLSALKYPANVAVDPVERFIFWSSEVAGSLYRADLDGVGVKALLETSEKITAVSLDVLDKRLFWIQYNREGSNSLICSCDYDGGSVHISKHPTQHNLFAMSLFGDRIFYSTWKMKTIWIANKHTGKDMVRINLHSSFVPLGELKVVHPLAQPKAEDDTWEPEQKLCKLRKGNCSSTVCGQDLQSHLCMCAEGYALSRDRKYCEDVNECAFWNHGCTLGCKNTPGSYYCTCPVGFVLLPDGKRCHQLVSCPRNVSECSHDCVLTSEGPLCFCPEGSVLERDGKTCSGCSSPDNGGCSQLCVPLSPVSWECDCFPGYDLQLDEKSCAASGPQPFLLFANSQDIRHMHFDGTDYGTLLSQQMGMVYALDHDPVENKIYFAHTALKWIERANMDGSQRERLIEEGVDVPEGLAVDWIGRRFYWTDRGKSLIGRSDLNGKRSKIITKENISQPRGIAVHPMAKRLFWTDTGINPRIESSSLQGLGRLVIASSDLIWPSGITIDFLTDKLYWCDAKQSVIEMANLDGSKRRRLTQNDVGHPFAVAVFEDYVWFSDWAMPSVMRVNKRTGKDRVRLQGSMLKPSSLVVVHPLAKPGADPCLYQNGGCEHICKKRLGTAWCSCREGFMKASDGKTCLALDGHQLLAGGEVDLKNQVTPLDILSKTRVSEDNITESQHMLVAEIMVSDQDDCAPVGCSMYARCISEGEDATCQCLKGFAGDGKLCSDIDECEMGVPVCPPASSKCINTEGGYVCRCSEGYQGDGIHCLDIDECQLGEHSCGENASCTNTEGGYTCMCAGRLSEPGLICPDSTPPPHLREDDHHYSVRNSDSECPLSHDGYCLHDGVCMYIEALDKYACNCVVGYIGERCQYRDLKWWELRHAGHGQQQKVIVVAVCVVVLVMLLLLSLWGAHYYRTQKLLSKNPKNPYEESSRDVRSRRPADTEDGMSSCPQPWFVVIKEHQDLKNGGQPVAGEDGQAADGSMQPTSWRQEPQLCGMGTEQGCWIPVSSDKGSCPQVMERSFHMPSYGTQTLEGGVEKPHSLLSANPLWQQRALDPPHQMELTQ

SEQ ID NO: 44 - protein, 169 aa, Artificial Sequence
  derived and/or modified protein sequence (wt) from Homo sapiens__NP_001423.1__HsEREG
MTAGRRMEMLCAGRVPALLLCLGFHLLQAVLSTTVIPSCIPGESSDNCTALVQTEDNPRVAQVSITKCSSDMNGYCLHGQCIYLVDMSQNYCRCEVGYTGVRCEHFFLTVHQPLSKEYVALTVILIILFLITVVGSTYYFCRWYRNRKSKEPKKEYERVTSGDPELPQV

SEQ ID NO: 45 - protein, 155 aa, Artificial Sequence
  derived and/or modified protein sequence (wt) from Homo sapiens__NP_000791.1__HsFGF1
MAEGEITTFTALTEKFNLPPGNYKKPKLLYCSNGGHFLRILPDGTVDGTRDRSDQHIQLQLSAESVGEVYIKSTETGQYLAMDTDGLLYGSQTPNEECLFLERLEENHYNTYISKKHAEKNWFVGLKKNGSCKRGPRTHYGQKAILFLPLPVSSD

SEQ ID NO: 46 - protein, 288 aa, Artificial Sequence
  derived and/or modified protein sequence (wt) from Homo sapiens__NP_001997.5__HsFGF2
MVGVGGGDVEDVTPRPGGCQISGRGARGCNGIPGAAAWEAALPRRRPRRHPSVNPRSRAAGSPRTRGRRTEERPSGSRLGDRGRGRALPGGRLGGRGRGRAPERVGGRGRGRGTAAPRAAPAARGSRPGPAGTMAAGSITTLPALPEDGGSGAFPPGHFKDPKRLYCKNGGFFLRIHPDGRVDGVREKSDPHIKLQLQAEERGVVSIKGVCANRYLAMKEDGRLLASKCVTDECFFFERLESNNYNTYRSRKYTSWYVALKRTGQYKLGSKTGPGQKAILFLPMSAKS

SEQ ID NO: 47 - protein, 194 aa, Artificial Sequence
  derived and/or modified protein sequence (wt) from Homo sapiens__NP_002000.1__HsFGF7
MHKWILTWILPTLLYRSCFHIICLVGTISLACNDMTPEQMATNVNCSSPERHTRSYDYMEGGDIRVRRLFCRTQWYLRIDKRGKVKGTQEMKNNYNIMEIRTVAVGIVAIKGVESEFYLAMNKEGKLYAKKECNEDCNFKELILENHYNTYASAKWTHNGGEMFVALNQKGIPVRGKKTKKEQKTAHFLPMAIT

SEQ ID NO: 48 - protein, 208 aa, Artificial Sequence
  derived and/or modified protein sequence (wt) from Homo sapiens__NP_001936.1__HsHBEGF
MKLLPSVVLKLFLAAVLSALVTGESLERLRRGLAAGTSNPDPPTVSTDQLLPLGGGRDRKVRDLQEADLDLLRVTLSSKPQALATPNKEEHGKRKKKGKGLGKKRDPCLRKYKDFCIHGECKYVKELRAPSCICHPGYHGERCHGLSLPVENRLYTYDHTTILAVVAVVLSSVCLLVIVGLLMFRYHRRGGYDVENEEKVKLGMTNSH

SEQ ID NO: 49 - protein, 728 aa, Artificial Sequence
  derived and/or modified protein sequence (wt) from Homo sapiens__NP_000592.3__HsHGF
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVSITKSGIKCQPWSSMIPHEHSFLPSSYRGKDLQENYCRNPRGEEGGPWCFTSNPEVRYEVCDIPQCSEVECMTCNGESYRGLMDHTESGKICQRWDHQTPHRHKFLPERYPDKGFDDNYCRNPDGQPRPWCYTLDPHTRWEYCAIKTCADNTMNDTDVPLETTECIQGQGEGYRGTVNTIWNGIPCQRWDSQYPHEHDMTPENFKCKDLRENYCRNPDGSESPWCFTTDPNIRVGYCSQIPNCDMSHGQDCYRGNGKNYMGNLSQTRSGLTCSMWDKNMEDLHRHIFWEPDASKLNENYCRNPDDDAHGPWCYTGNPLIPWDYCPISRCEGDTTPTIVNLDHPVISCAKTKQLRVVNGIPTRTNIGWMVSLRYRNKHICGGSLIKESWVLTARQCFPSRDLKDYEAWLGIHDVHGRGDEKCKQVLNVSQLVYGPEGSDLVLMKLARPAVLDDFVSTIDLPNYGCTIPEKTSCSVYGWGYTGLINYDGLLRVAHLYIMGNEKCSQHHRGKVTLNESEICAGAEKIGSGPCEGDYGGPLVCEQHKMRMVLGVIVPGRGCAIPNRPGIFVRVAYYAKWIHKIILTYKVPQS

SEQ ID NO: 50 - protein, 641 aa, Artificial Sequence
  derived and/or modified protein sequence (wt) from Homo sapiens__NP_005336.3 __HsHSPA1A
MAKAAAIGIDLGTTYSCVGVFQHGKVEIIANDQGNRTTPSYVAFTDTERLIGDAAKNQVALNPQNTVFDAKRLIGRKFGDPVVQSDMKHWPFQVINDGDKPKVQVSYKGETKAFYPEEISSMVLTKMKEIAEAYLGYPVTNAVITVPAYFNDSQRQATKDAGVIAGLNVLRIINEPTAAAIAYGLDRTGKGERNVLIFDLGGGTFDVSILTIDDGIFEVKATAGDTHLGGEDFDNRLVNHFVEEFKRKHKKDISQNKRAVRRLRTACERAKRTLSSSTQASLEIDSLFEGIDFYTSITRARFEELCSDLFRSTLEPVEKALRDAKLDKAQIHDLVLVGGSTRIPKVQKLLQDFFNGRDLNKSINPDEAVAYGAAVQAAILMGDKSENVQDLLLLDVAPLSLGLETAGGVMTALIKRNSTIPTKQTQIFTTYSDNQPGVLIQVYEGERAMTKDNNLLGRFELSGIPPAPRGVPQIEVTFDIDANGILNVTATDKSTGKANKITITNDKGRLSKEEIERMVQEAEKYKAEDEVQRERVSAKNALESYAFNMKSAVEDEGLKGKISEADKKKVLDKCQEVISWLDANTLAEKDEFEHKRKELEQVCNPIISGLYQGAGGPGPGGFGAQGPKGGSGSGPTIEEVD

SEQ ID NO: 51 - protein, 641 aa, Artificial Sequence; identical to SEQ ID NO: 50
  derived and/or modified protein sequence (wt) from Homo sapiens__NP_005337.2 __HsHSPA1B

SEQ ID NO: 52 - protein, 641 aa, Artificial Sequence
  derived and/or modified protein sequence (wt) from Homo sapiens__NP_005518.3 __HsHSPA1L
MATAKGIAIGIDLGTTYSCVGVFQHGKVEIIANDQGNRTTPSYVAFTDTERLIGDAAKNQVAMNPQNTVFDAKRLIGRKFNDPVVQADMKLWPFQVINEGGKPKVLVSYKGENKAFYPEEISSMVLTKLKETAEAFLGHPVTNAVITVPAYFNDSQRQATKDAGVIAGLNVLRIINEPTAAAIAYGLDKGGQGERHVLIFDLGGGTFDVSILTIDDGIFEVKATAGDTHLGGEDFDNRLVSHFVEEFKRKHKKDISQNKRAVRRLRTACERAKRTLSSSTQANLEIDSLYEGIDFYTSITRARFEELCADLFRGTLEPVEKALRDAKMDKAKIHDIVLVGGSTRIPKVQRLLQDYFNGRDLNKSINPDEAVAYGAAVQAAILMGDKSEKVQDLLLLDVAPLSLGLETAGGVMTALIKRNSTIPTKQTQIFTTYSDNQPGVLIQVYEGERAMTKDNNLLGRFDLTGIPPAPRGVPQIEVTFDIDANGILNVTATDKSTGKVNKITITNDKGRLSKEEIERMVLDAEKYKAEDEVQREKIAAKNALESYAFNMKSVVSDEGLKGKISESDKNKILDKCNELLSWLEVNQLAEKDEFDHKRKELEQMCNPIITKLYQGGCTGPACGTGYVPGRPATGPTIEEVD

SEQ ID NO: 53 - protein, 639 aa, Artificial Sequence
  derived and/or modified protein sequence (wt) from Homo sapiens__NP_068814.2 __HsHSPA2
MSARGPAIGIDLGTTYSCVGVFQHGKVEIIANDQGNRTTPSYVAFTDTERLIGDAAKNQVAMNPTNTIFDAKRLIGRKFEDATVQSDMKHWPFRVVSEGGKPKVQVEYKGETKTFFPEEISSMVLTKMKEIAEAYLGGKVHSAVITVPAYFNDSQRQATKDAGTITGLNVLRIINEPTAAAIAYGLDKKGCAGGEKNVLIFDLGGGTFDVSILTIEDGIFEVKSTAGDTHLGGEDFDNRMVSHLAEEFKRKHKKDIGPNKRAVRRLRTACERAKRTLSSSTQASIEIDSLYEGVDFYTSITRARFEELNADLFRGTLEPVEKALRDAKLDKGQIQEIVLVGGSTRIPKIQKLLQDFFNGKELNKSINPDEAVAYGAAVQAAILIGDKSENVQDLLLLDVTPLSLGIETAGGVMTPLIKRNTTIPTKQTQTFTTYSDNQSSVLVQVYEGERAMTKDNNLLGKFDLTGIPPAPRGVPQIEVTFDIDANGILNVTAADKSTGKENKITITNDKGRLSKDDIDRMVQEAERYKSEDEANRDRVAAKNALESYTYNIKQTVEDEKLRGKISEQDKNKILDKCQEVINWLDRNQMAEKDEYEHKQKELERVCNPIISKLYQGGPGGGSGGGGSGASGGPTIEEVD

SEQ ID NO: 54 - protein, 840 aa, Artificial Sequence
  derived and/or modified protein sequence (wt) from Homo sapiens__NP_002145.3 __HsHSPA4
MSVVGIDLGFQSCYVAVARAGGIETIANEYSDRCTPACISFGPKNRSIGAAAKSQVISNAKNTVQGFKRFHGRAFSDPFVEAEKSNLAYDIVQLPTGLTGIKVTYMEEERNFTTEQVTAMLLSKLKETAESVLKKPVVDCVVSVPCFYTDAERRSVMDATQIAGLNCLRLMNETTAVALAYGIYKQDLPALEEKPRNVVFVDMGHSAYQVSVCAFNRGKLKVLATAFDTTLGGRKFDEVLVNHFCEEFGKKYKLDIKSKIRALLRLSQECEKLKKLMSANASDLPLSIECFMNDVDVSGTMNRGKFLEMCNDLLARVEPPLRSVLEQTKLKKEDIYAVEIVGGATRIPAVKEKISKFFGKELSTTLNADEAVTRGCALQCAILSPAFKVREFSITDVVPYPISLRWNSPAEEGSSDCEVFSKNHAAPFSKVLTFYRKEPFTLEAYYSSPQDLPYPDPAIAQFSVQKVTPQSDGSSSKVKVKVRVNVHGIFSVSSASLVEVHKSEENEEPMETDQNAKEEEKMQVDQEEPHVEEQQQQTPAENKAESEEMETSQAGSKDKKMDQPPQAKKAKVKTSTVDLPIENQLLWQIDREMLNLYIENEGKMIMQDKLEKERNDAKNAVEEYVYEMRDKLSGEYEKFVSEDDRNSFTLKLEDTENWLYEDGEDQPKQVYVDKLAELKNLGQPIKIRFQESEERPKLFEELGKQIQQYMKIISSFKNKEDQYDHLDAADMTKVEKSTNEAMEWMNNKLNLQNKQSLTMDPVVKSKEIEAKIKELTSTCSPIISKPKPKVEPPKEEQKNAEQNGPVDGQGDNPGPQAAEQGTDTAVPSDSDKKLPEMDID

SEQ ID NO: 55 - protein, 839 aa, Artificial Sequence
  derived and/or modified protein sequence (wt) from Homo sapiens__NP_055093.2 __HsHSPA4L
MSVVGIDLGFLNCYIAVARSGGIETIANEYSDRCTPACISLGSRTRAIGNAAKSQIVTNVRNTIHGFKKLHGRSFDDPIVQTERIRLPYELQKMPNGSAGVKVRYLEEERPFAIEQVTGMLLAKLKETSENALKKPVADCVISIPSFFTDAERRSVMAAAQVAGLNCLRLMNETTAVALAYGIYKQDLPPLDEKPRNVVFIDMGHSAYQVLVCAFNKGKLKVLATTFDPYLGGRNFDEALVDYFCDEFKTKYKINVKENSRALLRLYQECEKLKKLMSANASDLPLNIECFMNDLDVSSKMNRAQFEQLCASLLARVEPPLKAVMEQANLQREDISSIEIVGGATRIPAVKEQITKFFLKDISTTLNADEAVARGCALQCAILSPAFKVREFSITDLVPYSITLRWKTSFEDGSGECEVFCKNHPAPFSKVITFHKKEPFELEAFYTNLHEVPYPDARIGSFTIQNVFPQSDGDSSKVKVKVRVNIHGIFSVASASVIEKQNLEGDHSDAPMETETSFKNENKDNMDKMQVDQEEGHQKCHAEHTPEEEIDHTGAKTKSAVSDKQDRLNQTLKKGKVKSIDLPIQSSLCRQLGQDLLNSYIENEGKMIMQDKLEKERNDAKNAVEEYVYDFRDRLGTVYEKFITPEDLSKLSAVLEDTENWLYEDGEDQPKQVYVDKLQELKKYGQPIQMKYMEHEERPKALNDLGKKIQLVMKVIEAYRNKDERYDHLDPTEMEKVEKCISDAMSWLNSKMNAQNKLSLTQDPVVKVSEIVAKSKELDNFCNPIIYKPKPKAEVPEDKPKANSEHNGPMDGQSGTETKSDSTKDSSQHTKSSGEMEVD

SEQ ID NO: 56 - protein, 654 aa, Artificial Sequence
  derived and/or modified protein sequence (wt) from Homo sapiens__NP_005338.1__HsHSPA5
MKLSLVAAMLLLLSAARAEEEDKKEDVGTVVGIDLGTTYSCVGVFKNGRVEIIANDQGNRITPSYVAFTPEGERLIGDAAKNQLTSNPENTVFDAKRLIGRTWNDPSVQQDIKFLPFKVVEKKTKPYIQVDIGGGQTKTFAPEEISAMVLTKMKETAEAYLGKKVTHAVVTVPAYFNDAQRQATKDAGTIAGLNVMRIINEPTAAAIAYGLDKREGEKNILVFDLGGGTFDVSLLTIDNGVFEVVATNGDTHLGGEDFDQRVMEHFIKLYKKKTGKDVRKDNRAVQKLRREVEKAKRALSSQHQARIEIESFYEGEDFSETLTRAKFEELNMDLFRSTMKPVQKVLEDSDLKKSDIDEIVLVGGSTRIPKIQQLVKEFFNGKEPSRGINPDEAVAYGAAVQAGVLSGDQDTGDLVLLDVCPLTLGIETVGGVMTKLIPRNTVVPTKKSQIFSTASDNQPTVTIKVYEGERPLTKDNHLLGTFDLTGIPPAPRGVPQIEVTFEIDVNGILRVTAEDKGTGNKNKITITNDQNRLTPEEIERMVNDAEKFAEEDKKLKERIDTRNELESYAYSLKNQIGDKEKLGGKLSSEDKETMEKAVEEKIEWLESHQDADIEDFKAKKKELEEIVQPIISKLYGSAGPPPTGEEDTAEKDEL

SEQ ID NO: 57 - protein, 643 aa, Artificial Sequence
  derived and/or modified protein sequence (wt) from Homo sapiens__NP_002146.2__HsHSPA6
MQAPRELAVGIDLGTTYSCVGVFQQGRVEILANDQGNRTTPSYVAFTDTERLVGDAAKSQAALNPHNTVFDAKRLIGRKFADTTVQSDMKHWPFRVVSEGGKPKVRVCYRGEDKTFYPEEISSMVLSKMKETAEAYLGQPVKHAVITVPAYFNDSQRQATKDAGAIAGLNVLRIINEPTAAAIAYGLDRRGAGERNVLIFDLGGGTFDVSVLSIDAGVFEVKATAGDTHLGGEDFDNRLVNHFMEEFRRKHGKDLSGNKRALRRLRTACERAKRTLSSSTQATLEIDSLFEGVDFYTSITRARFEELCSDLFRSTLEPVEKALRDAKLDKAQIHDVVLVGGSTRIPKVQKLLQDFFNGKELNKSINPDEAVAYGAAVQAAVLMGDKCEKVQDLLLLDVAPLSLGLETAGGVMTTLIQRNATIPTKQTQTFTTYSDNQPGVFIQVYEGERAMTKDNNLLGRFELSGIPPAPRGVPQIEVTFDIDANGILSVTATDRSTGKANKITITNDKGRLSKEEVERMVHEAEQYKAEDEAQRDRVAAKNSLEAHVFHVKGSLQEESLRDKIPEEDRRKMQDKCREVLAWLEHNQLAEKEEYEHQKRELEQICRPIFSRLYGGPGVPGGSSCGTQARQGDPSTGPIIEEVD

SEQ ID NO: 58 - protein, 367 aa, Artificial Sequence
  derived and/or modified protein sequence (wt) from Homo sapiens__P48741__HsHSPA7
MQAPRELAVGIDLGTTYSCVGVFQQGRVEILANDQGNRTTPSYVAFTDTERLVGDAAKSQAALNPHNTVFDAKRLIGRKFADTTVQSDMKHWPFQVVSEGGKPKVRVCYRGEDKTFYPEEISSMVLSKMKETAEAYLGQPVKHAVITVPTYFSNSQRQATKDAGAIAGLKVLPIINEATAAAIAYGLDRRGAGKRNVLIFDLGGGTFDVSVLSIDAGVFEVKATAGDTHLGGEDFDNRLVNHFMEEFRRKHGKDLSGNKRALRRLRTACERAKRTPSSSTQATLEIDSLFEGVDFYKSITRARFEELCSDLFRSTLEPVEKALRDAKLDKAQIHDFVLGGGLHSHPQGAEVAAGLLQRQGAEQEHQP

SEQ ID NO: 59 - protein, 646 aa, Artificial Sequence
  derived and/or modified protein sequence (wt) from Homo sapiens__NP_006588.1 __HsHSPA8
MSKGPAVGIDLGTTYSCVGVFQHGKVEIIANDQGNRTTPSYVAFTDTERLIGDAAKNQVAMNPTNTVFDAKRLIGRRFDDAVVQSDMKHWPFMVVNDAGRPKVQVEYKGETKSFYPEEVSSMVLTKMKEIAEAYLGKTVTNAVVTVPAYFNDSQRQATKDAGTIAGLNVLRIINEPTAAAIAYGLDKKVGAERNVLIFDLGGGTFDVSILTIEDGIFEVKSTAGDTHLGGEDFDNRMVNHFIAEFKRKHKKDISENKRAVRRLRTACERAKRTLSSSTQASIEIDSLYEGIDFYTSITRARFEELNADLFRGTLDPVEKALRDAKLDKSQIHDIVLVGGSTRIPKIQKLLQDFFNGKELNKSINPDEAVAYGAAVQAAILSGDKSENVQDLLLLDVTPLSLGIETAGGVMTVLIKRNTTIPTKQTQTFTTYSDNQPGVLIQVYEGERAMTKDNNLLGKFELTGIPPAPRGVPQIEVTFDIDANGILNVSAVDKSTGKENKITITNDKGRLSKEDIERMVQEAEKYKAEDEKQRDKVSSKNSLESYAFNMKATVEDEKLQGKINDEDKQKILDKCNEIINWLDKNQTAEKEEFEHQQKELEKVCNPIITKLYQSAGGMPGGMPGGFPGGGAPPSGGASSGPTIEEVD

SEQ ID NO: 60 - protein, 679 aa, Artificial Sequence
  derived and/or modified protein sequence (wt) from Homo sapiens__NP_004125.3 __HsHSPA9
MISASRAAAARLVGAAASRGPTAARHQDSWNGLSHEAFRLVSRRDYASEAIKGAVVGIDLGTTNSCVAVMEGKQAKVLENAEGARTTPSVVAFTADGERLVGMPAKRQAVTNPNNTFYATKRLIGRRYDDPEVQKDIKNVPFKIVRASNGDAWVEAHGKLYSPSQIGAFVLMKMKETAENYLGHTAKNAVITVPAYFNDSQRQATKDAGQISGLNVLRVINEPTAAALAYGLDKSEDKVIAVYDLGGGTFDISILEIQKGVFEVKSTNGDTFLGGEDFDQALLRHIVKEFKRETGVDLTKDNMALQRVREAAEKAKCELSSSVQTDINLPYLTMDSSGPKHLNMKLTRAQFEGIVTDLIRRTIAPCQKAMQDAEVSKSDIGEVILVGGMTRMPKVQQTVQDLFGRAPSKAVNPDEAVAIGAAIQGGVLAGDVTDVLLLDVTPLSLGIETLGGVFTKLINRNTTIPTKKSQVFSTAADGQTQVEIKVCQGEREMAGDNKLLGQFTLIGIPPAPRGVPQIEVTFDIDANGIVHVSAKDKGTGREQQIVIQSSGGLSKDDIENMVKNAEKYAEEDRRKKERVEAVNMAEGIIHDTETKMEEFKDQLPADECNKLKEEISKMRELLARKDSETGENIRQAASSLQQASLKLFEMAYKKMASEREGSGSSGTGEQKEDQKEEKQ

SEQ ID NO: 61 - protein, 675 aa, Artificial Sequence
  derived and/or modified protein sequence (wt) from Homo sapiens__NP_079291.2__HsHSPA12A
MADKEAGGSDGPRETAPTSAYSSPARSLGDTGITPLSPSHIVNDTDSNVSEQQSFLVVVAVDFGTTSSGYAYSFTKEPECIHVMRRWEGGDPGVSNQKTPTTILLTPERKFHSFGYAARDFYHDLDPNEAKQWLYLEKFKMKLHTTGDLTMDTDLTAANGKKVKALEIFAYALQYFKEQALKELSDQAGSEFENSDVRWVITVPAIWKQPAKQFMRQAAYQAGLASPENSEQLIIALEPEAASIYCRKLRLHQMIELSSKAAVNGYSGSDTVGAGFTQAKEHIRRNRQSRTFLVENVIGEIWSELEEGDKYVVVDSGGGTVDLTVHQIRLPEGHLKELYKATGGPYGSLGVDYEFEKLLYKIFGEDFIEQFKIKRPAAWVDLMIAFESRKRAAAPDRTNPLNITLPFSFIDYYKKFRGHSVEHALRKSNVDFVKWSSQGMLRMSPDAMNALFKPTIDSIIEHLRDLFQKPEVSTVKFLFLVGGFAEAPLLQQAVQAAFGDQCRIIIPQDVGLTILKGAVLFGLDPAVIKVRRSPLTYGVGVLNRYVEGKHPPEKLLVKDGTRWCTDVFDKFISADQSVALGELVKRSYTPAKPSQLVIVINIYSSEHDNVSFITDPGVKKCGTLRLDLTGTSGTAVPARREIQTLMQFGDTEIKATAIDIATSKSVKVGIDFLNY

SEQ ID NO: 62 - protein, 686 aa, Artificial Sequence
  derived and/or modified protein sequence (wt) from Homo sapiens__NP_443202.3 __HsHSPA12B
MLAVPEMGLQGLYIGSSPERSPVPSPPGSPRTQESCGIAPLTPSQSPKPEVRAPQQASFSVVVAIDFGTTSSGYAFSFASDPEAIHMMRKWEGGDPGVAHQKTPTCLLLTPEGAFHSFGYTARDYYHDLDPEEARDWLYFEKFKMKIHSATDLTLKTQLEAVNGKTMPALEVFAHALRFFREHALQELREQSPSLPEKDTVRWVLTVPAIWKQPAKQFMREAAYLAGLVSRENAEQLLIALEPEAASVYCRKLRLHQLLDLSGRAPGGGRLGERRSIDSSFRQAREQLRRSRHSRTFLVESGVGELWAEMQAGDRYVVADCGGGTVDLTVHQLEQPHGTLKELYKASGGPYGAVGVDLAFEQLLCRIFGEDFIATFKRQRPAAWVDLTIAFEARKRTAGPHRAGALNISLPFSFIDFYRKQRGHNVETALRRSSVNFVKWSSQGMLRMSCEAMNELFQPTVSGIIQHIEALLARPEVQGVKLLFLVGGFAESAVLQHAVQAALGARGLRVVVPHDVGLTILKGAVLFGQAPGVVRVRRSPLTYGVGVLNRFVPGRHPPEKLLVRDGRRWCTDVFERFVAAEQSVALGEEVRRSYCPARPGQRRVLINLYCCAAEDARFITDPGVRKCGALSLELEPADCGQDTAGAPPGRREIRAAMQFGDTEIKVTAVDVSTNRSVRASIDFLSN

SEQ ID NO: 63 - protein, 471 aa, Artificial Sequence
  derived and/or modified protein sequence (wt) from Homo sapiens__NP_008879.3__HsHSPA13
MAREMTILGSAVLTLLLAGYLAQQYLPLPTPKVIGIDLGTTYCSVGVFFPGTGKVKVIPDENGHISIPSMVSFTDNDVYVGYESVELADSNPQNTIYDAKRFIGKIFTAEELEAEIGRYPFKVLNKNGMVEFSVTSNETITVSPEYVGSRLLLKLKEMAEAYLGMPVANAVISVPAEFDLKQRNSTIEAANLAGLKILRVINEPTAAAMAYGLHKADVFHVLVIDLGGGTLDVSLLNKQGGMFLTRAMSGNNKLGGQDFNQRLLQYLYKQIYQTYGFVPSRKEEIHRLRQAVEMVKLNLTLHQSAQLSVLLTVEEQDRKEPHSSDTELPKDKLSSADDHRVNSGFGRGLSDKKSGESQVLFETEISRKLFDTLNEDLFQKILVPIQQVLKEGHLEKTEIDEVVLVGGSTRIPRIRQVIQEFFGKDPNTSVDPDLAVVTGVAIQAGIDGGSWPLQVSALEIPNKHLQKTNFN

SEQ ID NO: 64 - protein, 509 aa, Artificial Sequence
  derived and/or modified protein sequence (wt) from Homo sapiens__NP_057383.2__HsHSPA14
MAAIGVHLGCTSACVAVYKDGRAGVVANDAGDRVTPAVVAYSENEEIVGLAAKQSRIRNISNTVMKVKQILGRSSSDPQAQKYIAESKCLVIEKNGKLRYEIDTGEETKFVNPEDVARLIFSKMKETAHSVLGSDANDVVITVPFDFGEKQKNALGEAARAAGFNVLRLIHEPSAALLAYGIGQDSPTGKSNILVFKLGGTSLSLSVMEVNSGIYRVLSTNTDDNIGGAHFTETLAQYLASEFQRSFKHDVRGNARAMMKLTNSAEVAKHSLSTLGSANCFLDSLYEGQDFDCNVSRARFELLCSPLFNKCIEAIRGLLDQNGFTADDINKVVLCGGSSRIPKLQQLIKDLFPAVELLNSIPPDEVIPIGAAIEAGILIGKENLLVEDSLMIECSARDILVKGVDESGASRFTVLFPSGTPLPARRQHTLQAPGSISSVCLELYESDGKNSAKEETKFAQVVLQDLDKKENGLRDILAVLTMKRDGSLHVTCTDQETGKCEAISIEIAS

SEQ ID NO: 65 - protein, 858 aa, Artificial Sequence
  derived and/or modified protein sequence (wt) from Homo sapiens__NP_006635.2 __HsHSPH1
MSVVGLDVGSQSCYIAVARAGGIETIANEFSDRCTPSVISFGSKNRTIGVAAKNQQITHANNTVSNFKRFHGRAFNDPFIQKEKENLSYDLVPLKNGGVGIKVMYMGEEHLFSVEQITAMLLTKLKETAENSLKKPVTDCVISVPSFFTDAERRSVLDAAQIVGLNCLRLMNDMTAVALNYGIYKQDLPSLDEKPRIVVFVDMGHSAFQVSACAFNKGKLKVLGTAFDPFLGGKNFDEKLVEHFCAEFKTKYKLDAKSKIRALLRLYQECEKLKKLMSSNSTDLPLNIECFMNDKDVSGKMNRSQFEELCAELLQKIEVPLYSLLEQTHLKVEDVSAVEIVGGATRIPAVKERIAKFFGKDISTTLNADEAVARGCALQCAILSPAFKVREFSVTDAVPFPISLIWNHDSEDTEGVHEVFSRNHAAPFSKVLTFLRRGPFELEAFYSDPQGVPYPEAKIGRFVVQNVSAQKDGEKSRVKVKVRVNTHGIFTISTASMVEKVPTEENEMSSEADMECLNQRPPENPDTDKNVQQDNSEAGTQPQVQTDAQQTSQSPPSPELTSEENKIPDADKANEKKVDQPPEAKKPKIKVVNVELPIEANLVWQLGKDLLNMYIETEGKMIMQDKLEKERNDAKNAVEEYVYEFRDKLCGPYEKFICEQDHQNFLRLLTETEDWLYEEGEDQAKQAYVDKLEELMKIGTPVKVRFQEAEERPKMFEELGQRLQHYAKIAADFRNKDEKYNHIDESEMKKVEKSVNEVMEWMNNVMNAQAKKSLDQDPVVRAQEIKTKIKELNNTCEPVVTQPKPKIESPKLERTPNGPNIDKKEEDLEDKNNFGAEPPHQNGECYPNEKNSVNMDLD

SEQ ID NO: 66 - protein, 999 aa, Artificial Sequence
  derived and/or modified protein sequence (wt) from Homo sapiens__NP_006380.1 __HsHYOU1
MADKVRRQRPRRRVCWALVAVLLADLLALSDTLAVMSVDLGSESMKVAIVKPGVPMEIVLNKESRRKTPVIVTLKENERFFGDSAASMAIKNPKATLRYFQHLLGKQADNPHVALYQARFPEHELTFDPQRQTVHFQISSQLQFSPEEVLGMVLNYSRSLAEDFAEQPIKDAVITVPVFFNQAERRAVLQAARMAGLKVLQLINDNTATALSYGVFRRKDINTTAQNIMFYDMGSGSTVCTIVTYQMVKTKEAGMQPQLQIRGVGFDRTLGGLEMELRLRERLAGLFNEQRKGQRAKDVRENPRAMAKLLREANRLKTVLSANADHMAQIEGLMDDVDFKAKVTRVEFEELCADLFERVPGPVQQALQSAEMSLDEIEQVILVGGATRVPRVQEVLLKAVGKEELGKNINADEAAAMGAVYQAAALSKAFKVKPFVVRDAVVYPILVEFTREVEEEPGIHSLKHNKRVLFSRMGPYPQRKVITFNRYSHDFNFHINYGDLGFLGPEDLRVFGSQNLTTVKLKGVGDSFKKYPDYESKGIKAHFNLDESGVLSLDRVESVFETLVEDSAEEESTLTKLGNTISSLFGGGTTPDAKENGTDTVQEEEESPAEGSKDEPGEQVELKEEAEAPVEDGSQPPPPEPKGDATPEGEKATEKENGDKSEAQKPSEKAEAGPEGVAPAPEGEKKQKPARKRRMVEEIGVELVVLDLPDLPEDKLAQSVQKLQDLTLRDLEKQEREKAANSLEAFIFETQDKLYQPEYQEVSTEEQREEISGKLSAASTWLEDEGVGATTVMLKEKLAELRKLCQGLFFRVEERKKWPERLSALDNLLNHSSMFLKGARLIPEMDQIFTEVEMTTLEKVINETWAWKNATLAEQAKLPATEKPVLLSKDIEAKMMALDREVQYLLNKAKFTKPRPRPKDKNGTRAEPPLNASASDQGEKVIPPAGQTEDAEPISEPEKVETGSEPGDTEPLELGGPGAEPEQKEQSTGQKRPLKNDEL

SEQ ID NO: 67 - protein, 732 aa, Artificial Sequence
  derived and/or modified protein sequence (wt) from Homo sapiens__NP_005339.3 __HsHSP90AA1
MPEETQTQDQPMEEEEVETFAFQAEIAQLMSLIINTFYSNKEIFLRELISNSSDALDKIRYESLTDPSKLDSGKELHINLIPNKQDRTLTIVDTGIGMTKADLINNLGTIAKSGTKAFMEALQAGADISMIGQFGVGFYSAYLVAEKVTVITKHNDDEQYAWESSAGGSFTVRTDTGEPMGRGTKVILHLKEDQTEYLEERRIKEIVKKHSQFIGYPITLFVEKERDKEVSDDEAEEKEDKEEEKEKEEKESEDKPEIEDVGSDEEEEKKDGDKKKKKKIKEKYIDQEELNKTKPIWTRNPDDITNEEYGEFYKSLTNDWEDHLAVKHFSVEGQLEFRALLFVPRRAPFDLFENRKKKNNIKLYVRRVFIMDNCEELIPEYLNFIRGVVDSEDLPLNISREMLQQSKILKVIRKNLVKKCLELFTELAEDKENYKKFYEQFSKNIKLGIHEDSQNRKKLSELLRYYTSASGDEMVSLKDYCTRMKENQKHIYYITGETKDQVANSAFVERLRKHGLEVIYMIEPIDEYCVQQLKEFEGKTLVSVTKEGLELPEDEEEKKKQEEKKTKFENLCKIMKDILEKKVEKVVVSNRLVTSPCCIVTSTYGWTANMERIMKAQALRDNSTMGYMAAKKHLEINPDHSIIETLRQKAEADKNDKSVKDLVILLYETALLSSGFSLEDPQTHANRIYRMIKLGLGIDEDDPTADDTSAAVTEEMPPLEGDDDTSRMEEVD

SEQ ID NO: 68 - protein, 112 aa, Artificial Sequence [sequence omitted]

SEQ ID NO: 69 - protein, 724 aa, Artificial Sequence
  derived and/or modified protein sequence (wt) from Homo sapiens__NP_031381.2__HsHSP90AB1
MPEEVHHGEEEVETFAFQAEIAQLMSLIINTFYSNKEIFLRELISNASDALDKIRYESLTDPSKLDSGKELKIDIIPNPQERTLTLVDTGIGMTKADLINNLGTIAKSGTKAFMEALQAGADISMIGQFGVGFYSAYLVAEKVVVITKHNDDEQYAWESSAGGSFTVRADHGEPIGRGTKVILHLKEDQTEYLEERRVKEVVKKHSQFIGYPITLYLEKEREKEISDDEAEEEKGEKEEEDKDDEEKPKIEDVGSDEEDDSGKDKKKKTKKIKEKYIDQEELNKTKPIWTRNPDDITQEEYGEFYKSLTNDWEDHLAVKHFSVEGQLEFRALLFIPRRAPFDLFENKKKKNNIKLYVRRVFIMDSCDELIPEYLNFIRGVVDSEDLPLNISREMLQQSKILKVIRKNIVKKCLELFSELAEDKENYKKFYEAFSKNLKLGIHEDSTNRRRLSELLRYHTSQSGDEMTSLSEYVSRMKETQKSIYYITGESKEQVANSAFVERVRKRGFEVVYMTEPIDEYCVQQLKEFDGKSLVSVTKEGLELPEDEEEKKKMEESKAKFENLCKLMKEILDKKVEKVTISNRLVSSPCCIVTSTYGWTANMERIMKAQALRDNSTMGYMMAKKHLEINPDHPIVETLRQKAEADKNDKAVKDLVVLLFETALLSSGFSLEDPQTHSNRIYRMIKLGLGIDEDEVAAEEPNAAVPDEIPPLEGDEDASRMEEVD

SEQ ID NO: 70 - protein, 803 aa, Artificial Sequence
  derived and/or modified protein sequence (wt) from Homo sapiens__NP_003290.1__HsHSP90B1
MRALWVLGLCCVLLTFGSVRADDEVDVDGTVEEDLGKSREGSRTDDEVVQREEEAIQLDGLNASQIRELREKSEKFAFQAEVNRMMKLIINSLYKNKEIFLRELISNASDALDKIRLISLTDENALSGNEELTVKIKCDKEKNLLHVTDTGVGMTREELVKNLGTIAKSGTSEFLNKMTEAQEDGQSTSELIGQFGVGFYSAFLVADKVIVTSKHNNDTQHIWESDSNEFSVIADPRGNTLGRGTTITLVLKEEASDYLELDTIKNLVKKYSQFINFPIYVWSSKTETVEEPMEEEEAAKEEKEESDDEAAVEEEEEEKKPKTKKVEKTVWDWELMNDIKPIWQRPSKEVEEDEYKAFYKSFSKESDDPMAYIHFTAEGEVTFKSILFVPTSAPRGLFDEYGSKKSDYIKLYVRRVFITDDFHDMMPKYLNFVKGVVDSDDLPLNVSRETLQQHKLLKVIRKKLVRKTLDMIKKIADDKYNDTFWKEFGTNIKLGVIEDHSNRTRLAKLLRFQSSHHPTDITSLDQYVERMKEKQDKIYFMAGSSRKEAESSPFVERLLKKGYEVIYLTEPVDEYCIQALPEFDGKRFQNVAKEGVKFDESEKTKESREAVEKEFEPLLNWMKDKALKDKIEKAVVSQRLTESPCALVASQYGWSGNMERIMKAQAYQTGKDISTNYYASQKKTFEINPRHPLIRDMLRRIKEDEDDKTVLDLAVVLFETATLRSGYLLPDTKAYGDRIERMLRLSLNIDPDAKVEEEPEEEPEETAEDTTEDTEQDEDEEMDVGTDEEEETAKESTAEKDEL

SEQ ID NO: 71 - protein, 704 aa, Artificial Sequence
  derived and/or modified protein sequence (wt) from Homo sapiens__NP_057376.2__HsTRAP1
MARELRALLLWGRRLRPLLRAPALAAVPGGKPILCPRRTTAQLGPRRNPAWSLQAGRLFSTQTAEDKEEPLHSIISSTESVQGSTSKHEFQAETKKLLDIVARSLYSEKEVFIRELISNASDALEKLRHKLVSDGQALPEMEIHLQTNAEKGTITIQDTGIGMTQEELVSNLGTIARSGSKAFLDALQNQAEASSKIIGQFGVGFYSAFMVADRVEVYSRSAAPGSLGYQWLSDGSGVFEIAEASGVRTGTKIIIHLKSDCKEFSSEARVRDVVTKYSNFVSFPLYLNGRRMNTLQAIWMMDPKDVREWQHEEFYRYVAQAHDKPRYTLHYKTDAPLNIRSIFYVPDMKPSMFDVSRELGSSVALYSRKVLIQTKATDILPKWLRFIRGVVDSEDIPLNLSRELLQESALIRKLRDVLQQRLIKFFIDQSKKDAEKYAKFFEDYGLFMREGIVTATEQEVKEDIAKLLRYESSALPSGQLTSLSEYASRMRAGTRNIYYLCAPNRHLAEHSPYYEAMKKKDTEVLFCFEQFDELTLLHLREFDKKKLISVETDIVVDHYKEEKFEDRSPAAECLSEKETEELMAWMRNVLGSRVTNVKVTLRLDTHPAMVTVLEMGAARHFLRMQQLAKTQEERAQLLQPTLEINPRHALIKKLNQLRASEPGLAQLLVDQIYENAMIAAGLVDDPRAMVGRLNELLVKALERH

SEQ ID NO: 72 - protein, 153 aa, Artificial Sequence
  derived and/or modified protein sequence (wt) from Homo sapiens__NP_000609.1__HsIGF1
MGKISSLPTQLFKCCFCDFLKVKMHTMSSSHLFYLALCLLTFTSSATAGPETLCGAELVDALQFVCGDRGFYFNKPTGYGSSSRRAPQTGIVDECCFRSCDLRRLEMYCAPLKPAKSARSVRAQRHTDMPKTQKEVHLKNASRGSAGNKNYRM

SEQ ID NO: 73 - protein, 180 aa, Artificial Sequence
  derived and/or modified protein sequence (wt) from Homo sapiens__NP_000603.1__HsIGF2
MGIPMGKSMLVLLTFLAFASCCIAAYRPSETLCGGELVDTLQFVCGDRGFYFSRPASRVSRRSRGIVEECCFRSCDLALLETYCATPAKSERDVSTPPTVLPDNFPRYPVGKFFQYDTWKQSTQRLRRGLPALLRARRGHVLAKELEAFREAKRHRPLIALPTQDPAHGGAPPEMASNRK

SEQ ID NO: 74 - protein, 212 aa, Artificial Sequence
  derived and/or modified protein sequence (wt) from Homo sapiens__NP_000591.1__HsIL6
MNSFSTSAFGPVAFSLGLLLVLPAAFPAPVPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 75 - protein, 426 aa, Artificial Sequence
  derived and/or modified protein sequence (wt) from Homo sapiens__NP_002183.1__HsINHBA
MPLLWLRGFLLASCWIIVRSSPTPGSEGHSAAPDCPSCALAALPKDVPNSQPEMVEAVKKHILNMLHLKKRPDVTQPVPKAALLNAIRKLHVGKVGENGYVEIEDDIGRRAEMNELMEQTSEIITFAESGTARKTLHFEISKEGSDLSVVERAEVWLFLKVPKANRTRTKVTIRLFQQQKHPQGSLDTGEEAEEVGLKGERSELLLSEKVVDARKSTWHVFPVSSSIQRLLDQGKSSLDVRIACEQCQESGASLVLLGKKKKKEEEGEGKKKGGGEGGAGADEEKEQSHRPFLMLQARQSEDHPHRRRRRGLECDGKVNICCKKQFFVSFKDIGWNDWIIAPSGYHANYCEGECPSHIAGTSGSSLSFHSTVINHYRMRGHSPFANLKSCCVPTKLRPMSMLYYDDGQNIIKKDIQNMIVEECGCS

SEQ ID NO: 76 - protein, 407 aa, Artificial Sequence
  derived and/or modified protein sequence (wt) from Homo sapiens__NP_002184.2__HsINHBB
MDGLPGRALGAACLLLLAAGWLGPEAWGSPTPPPTPAAPPPPPPPGSPGGSQDTCTSCGGFRRPEELGRVDGDFLEAVKRHILSRLQMRGRPNITHAVPKAAMVTALRKLHAGKVREDGRVEIPHLDGHASPGADGQERVSEIISFAETDGLASSRVRLYFFISNEGNQNLFVVQASLWLYLKLLPYVLEKGSRRKVRVKVYFQEQGHGDRWNMVEKRVDLKRSGWHTFPLTEAIQALFERGERRLNLDVQCDSCQELAVVPVFVDPGEESHRPFVVVQARLGDSRHRIRKRGLECDGRTNLCCRQQFFIDFRLIGWNDWIIAPTGYYGNYCEGSCPAYLAGVPGSASSFHTAVVNQYRMRGLNPGTVNSCCIPTKLSTMSMLYFDDEYNIVKRDVPNMIVEECGCA

SEQ ID NO: 77 - protein, 1152 aa, Artificial Sequence
  derived and/or modified protein sequence (wt) from Homo sapiens__NP_000623.2__HsITGAM
MALRVLLLTALTLCHGFNLDTENAMTFQENARGFGQSVVQLQGSRVVVGAPQEIVAANQRGSLYQCDYSTGSCEPIRLQVPVEAVNMSLGLSLAATTSPPQLLACGPTVHQTCSENTYVKGLCFLFGSNLRQQPQKFPEALRGCPQEDSDIAFLIDGSGSIIPHDFRRMKEFVSTVMEQLKKSKTLFSLMQYSEEFRIHFTFKEFQNNPNPRSLVKPITQLLGRTHTATGIRKVVRELFNITNGARKNAFKILVVITDGEKFGDPLGYEDVIPEADREGVIRYVIGVGDAFRSEKSRQELNTIASKPPRDHVFQVNNFEALKTIQNQLREKIFAIEGTQTGSSSSFEHEMSQEGFSAAITSNGPLLSTVGSYDWAGGVFLYTSKEKSTFINMTRVDSDMNDAYLGYAAAIILRNRVQSLVLGAPRYQHIGLVAMFRQNTGMWESNANVKGTQIGAYFGASLCSVDVDSNGSTDLVLIGAPHYYEQTRGGQVSVCPLPRGRARWQCDAVLYGEQGQPWGRFGAALTVLGDVNGDKLTDVAIGAPGEEDNRGAVYLFHGTSGSGISPSHSQRIAGSKLSPRLQYFGQSLSGGQDLTMDGLVDLTVGAQGHVLLLRSQPVLRVKAIMEFNPREVARNVFECNDQVVKGKEAGEVRVCLHVQKSTRDRLREGQIQSVVTYDLALDSGRPHSRAVFNETKNSTRRQTQVLGLTQTCETLKLQLPNCIEDPVSPIVLRLNFSLVGTPLSAFGNLRPVLAEDAQRLFTALFPFEKNCGNDNICQDDLSITFSFMSLDCLVVGGPREFNVTVTVRNDGEDSYRTQVTFFFPLDLSYRKVSTLQNQRSQRSWRLACESASSTEVSGALKSTSCSINHPIFPENSEVTFNITFDVDSKASLGNKLLLKANVTSENNMPRTNKTEFQLELPVKYAVYMVVTSHGVSTKYLNFTASENTSRVMQHQYQVSNLGQRSLPISLVFLVPVRLNQTVIWDRPQVTFSENLSSTCHTKERLPSHSDFLAELRKAPVVNCSIAVCQRIQCDIPFFGIQEEFNATLKGNLSFDWYIKTSHNHLLIVSTAEILFNDSVFTLLPGQGAFVRSQTETKVEPFEVPNPLPLIVGSSVGGLLLLALITAALYKLGFFKRQYKDMMSEGGPPGAEPQ

SEQ ID NO: 78 - protein, 467 aa, Artificial Sequence [sequence omitted]

SEQ ID NO: 79 - protein, 707 aa, Artificial Sequence
  derived and/or modified protein sequence (wt) from Homo sapiens__NP_004985.2__HsMMP9
MSLWQPLVLVLLVLGCCFAAPRQRQSTLVLFPGDLRTNLTDRQLAEEYLYRYGYTRVAEMRGESKSLGPALLLLQKQLSLPETGELDSATLKAMRTPRCGVPDLGRFQTFEGDLKWHHHNITYWIQNYSEDLPRAVIDDAFARAFALWSAVTPLTFTRVYSRDADIVIQFGVAEHGDGYPFDGKDGLLAHAFPPGPGIQGDAHFDDDELWSLGKGVVVPTRFGNADGAACHFPFIFEGRSYSACTTDGRSDGLPWCSTTANYDTDDRFGFCPSERLYTQDGNADGKPCQFPFIFQGQSYSACTTDGRSDGYRWCATTANYDRDKLFGFCPTRADSTVMGGNSAGELCVFPFTFLGKEYSTCTSEGRGDGRLWCATTSNFDSDKKWGFCPDQGYSLFLVAAHEFGHALGLDHSSVPEALMYPMYRFTEGPPLHKDDVNGIRHLYGPRPEPEPRPPTTTTPQPTAPPTVCPTGPPTVHPSERPTAGPTGPPSAGPTGPPTAGPSTATTVPLSPVDDACNVNIFDAIAEIGNQLYLFKDGKYWRFSEGRGSRPQGPFLIADKWPALPRKLDSVFEERLSKKLFFFSGRQVWVYTGASVLGPRRLDKLGLGADVAQVTGALRSGRGKMLLFSGRRLWRFDVKAQMVDPRSASEVDRMFPGVPLDTHDVFQYREKAYFCQDRFYWRVSSRSELNQVDQVGYVTYDILQCPED

SEQ ID NO: 80 - protein, 471 aa, Artificial Sequence
  derived and/or modified protein sequence (wt) from Homo sapiens__NP_002418.1__HsMMP13
MHPGVLAAFLFLSWTHCRALPLPSGGDEDDLSEEDLQFAERYLRSYYHPTNLAGILKENAASSMTERLREMQSFFGLEVTGKLDDNTLDVMKKPRCGVPDVGEYNVFPRTLKWSKMNLTYRIVNYTPDMTHSEVEKAFKKAFKVWSDVTPLNFTRLHDGIADIMISFGIKEHGDFYPFDGPSGLLAHAFPPGPNYGGDAHFDDDETWTSSSKGYNLFLVAAHEFGHSLGLDHSKDPGALMFPIYTYTGKSHFMLPDDDVQGIQSLYGPGDEDPNPKHPKTPDKCDPSLSLDAITSLRGETMIFKDRFFWRLHPQQVDAELFLTKSFWPELPNRIDAAYEHPSHDLIFIFRGRKFWALNGYDILEGYPKKISELGLPKEVKKISAAVHFEDTGKTLLFSGNQVWRYDDTNHIMDKDYPRLIEEDFPGIGDKVDAVYEKNGYIYFFNGPIQFEYSIWSNRIVRVMPANSILWC

SEQ ID NO: 81 - protein, 355 aa, Artificial Sequence
  derived and/or modified protein sequence (wt) from Homo sapiens__NP_001286.1__HsCCR1
METPNTTEDYDTTTEFDYGDATPCQKVNERAFGAQLLPPLYSLVFVIGLVGNILVVLVLVQYKRLKNMTSIYLLNLAISDLLFLFTLPFWIDYKLKDDWVFGDAMCKILSGFYYTGLYSEIFFIILLTIDRYLAIVHAVFALRARTVTFGVITSIIIWALAILASMPGLYFSKTQWEFTHHTCSLHFPHESLREWKLFQALKLNLFGLVLPLLVMIICYTGIIKILLRRPNEKKSKAVRLIFVIMIIFFLFWTPYNLTILISVFQDFLFTHECEQSRHLDLAVQVTEVIAYTHCCVNPVIYAFVGERFRKYLRQLFHRRVAVHLVKWLPFLSVDRLERVSSTSPSTGEHELSAGF

SEQ ID NO: 82 - protein, 211 aa, Artificial Sequence [sequence omitted]

SEQ ID NO: 83 - protein, 241 aa, Artificial Sequence
  derived and/or modified protein sequence (wt) from Homo sapiens__NP_002599.1__HsPDGFB
MNRCWALFLSLCCYLRLVSAEGDPIPEELYEMLSDHSIRSFDDLQRLLHGDPGEEDGAELDLNMTRSHSGGELESLARGRRSLGSLTIAEPAMIAECKTRTEVFEISRRLIDRTNANFLVWPPCVEVQRCSGCCNNRNVQCRPTQVQLRPVQVRKIEIVRKKPIFKKATVTLEDHLACKCETVAAARPVTRSPGGSQEQRAKTPQTRVTIRTVRVRRPPKGKHRKFKHTHDKTALKETLGA

SEQ ID NO: 84 - protein, 345 aa, Artificial Sequence
  derived and/or modified protein sequence (wt) from Homo sapiens__NP_057289.1__HsPDGFC
MSLFGLLLLTSALAGQRQGTQAESNLSSKFQFSSNKEQNGVQDPQHERIITVSTNGSIHSPRFPHTYPRNTVLVWRLVAVEENVWIQLTFDERFGLEDPEDDICKYDFVEVEEPSDGTILGRWCGSGTVPGKQISKGNQIRIRFVSDEYFPSEPGFCIHYNIVMPQFTEAVSPSVLPPSALPLDLLNNAITAFSTLEDLIRYLEPERWQLDLEDLYRPTWQLLGKAFVFGRKSRVVDLNLLTEEVRLYSCTPRNFSVSIREELKRTDTIFWPGCLLVKRCGGNCACCLHNCNECQCVPSKVTKKYHEVLQLRPKTGVRGLHKSLTDVALEHHEECDCVCRGSTGG

SEQ ID NO: 85 - protein, 364 aa, Artificial Sequence
  derived and/or modified protein sequence (wt) from Homo sapiens__NP_149126.1__HsPDGFD
MHRLIFVYTLICANFCSCRDTSATPQSASIKALRNANLRRDDLYRRDETIQVKGNGYVQSPRFPNSYPRNLLLTWRLHSQENTRIQLVFDNQFGLEEAENDICRYDFVEVEDISETSTIIRGRWCGHKEVPPRIKSRTNQIKITFKSDDYFVAKPGFKIYYSLLEDFQPAAASETNWESVTSSISGVSYNSPSVTDPTLIADALDKKIAEFDTVEDLLKYFNPESWQEDLENMYLDTPRYRGRSYHDRKSKVDLDRLNDDAKRYSCTPRNYSVNIREELKLANVVFFPRCLLVQRCGGNCGCGTVNWRSCTCNSGKTVKKYHEVLQFEPGHIKRRGRAKTMALVDIQLDHHERCDCICSSRPPR

SEQ ID NO: 86 - protein, 225 aa, Artificial Sequence
  derived and/or modified protein sequence (wt) from Homo sapiens__NP_003946.3__HsSOCS3
MVTHSKFPAAGMSRPLDTSLRLKTFSSKSEYQLVVNAVRKLQESGFYWSAVTGGEANLLLSAEPAGTFLIRDSSDQRHFFTLSVKTQSGTKNLRIQCEGGSFSLQSDPRSTQPVPRFDCVLKLVHHYMPPPGAPSFPSPPTEPSSEVPEQPSAQPLPGSPPRRAYYIYSGGEKIPLVLSRPLSSNVATLQHLCRKTVNGHLDSYEKVTQLPGPIREFLDQYDAPL

SEQ ID NO: 87 - protein, 160 aa, Artificial Sequence
  derived and/or modified protein sequence (wt) from Homo sapiens__NP_003227.1__HsTGFA
MVPSAGQLALFALGIVLAACQALENSTSPLSADPPVAAAVVSHFNDCPDSHTQFCFHGTCRFLVQEDKPACVCHSGYVGARCEHADLLAVVAASQKKQAITALVVVSIVALAVLIITCVLIHCCQVRKHCEWCRALICRHEKPSALLKGRTACCHSETVV

SEQ ID NO: 88 - protein, 390 aa, Artificial Sequence
  derived and/or modified protein sequence (wt) from Homo sapiens__NP_000651.3__HsTGFB1
MPPSGLRLLPLLLPLLWLLVLTPGRPAAGLSTCKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHRRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 89 - protein, 414 aa, Artificial Sequence
  derived and/or modified protein sequence (wt) from Homo sapiens__NP_003229.1__HsTGFB2
MHYCVLSAFLILHLVTVALSLSTCSTLDMDQFMRKRIEAIRGQILSKLKLTSPPEDYPEPEEVPPEVISIYNSTRDLLQEKASRRAAACERERSDEEYYAKEVYKIDMPPFFPSENAIPPTFYRPYFRIVRFDVSAMEKNASNLVKAEFRVFRLQNPKARVPEQRIELYQILKSKDLTSPTQRYIDSKVVKTRAEGEWLSFDVTDAVHEWLHHKDRNLGFKISLHCPCCTFVPSNNYIIPNKSEELEARFAGIDGTSTYTSGDQKTIKSTRKKNSGKTPHLLLMLLPSYRLESQQTNRRKKRALDAAYCFRNVQDNCCLRPLYIDFKRDLGWKWIHEPKGYNANFCAGACPYLWSSDTQHSRVLSLYNTINPEASASPCCVSQDLEPLTILYYIGKTPKIEQLSNMIVKSCKCS

SEQ ID NO: 90 - protein, 412 aa, Artificial Sequence
  derived and/or modified protein sequence (wt) from Homo sapiens__NP_003230.1__HsTGFB3
MKMHLQRALVVLALLNFATVSLSLSTCTTLDFGHIKKKRVEAIRGQILSKLRLTSPPEPTVMTHVPYQVLALYNSTRELLEEMHGEREEGCTQENTESEYYAKEIHKFDMIQGLAEHNELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKGVDNEDDHGRGDLGRLKKQKDHHNPHLILMMIPPHRLDNPGQGGQRKKRALDTNYCFRNLEENCCVRPLYIDFRQDLGWKWVHEPKGYYANFCSGPCPYLRSADTTHSTVLGLYNTLNPEASASPCCVPQDLEPLTILYYVGRTPKVEQLSNMVVKSCKCS

SEQ ID NO: 91 - protein, 461 aa, Artificial Sequence
  derived and/or modified protein sequence (wt) from Homo sapiens__NP_001057.1__HsTNFRSF1B
MAPVAVWAALAVGLELWAAAHALPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDFALPVGLIVGVTALGLLIIGVVNCVIMTQVKKKPLCLQREAKVPHLPADKARGTQGPEQQHLLITAPSSSSSSLESSASALDRRAPTRNQPQAPGVEASGAGEARASTGSSDSSPGGHGTQVNVTCIVNVCSSSDHSSQCSSQASSTMGDTDSSPSESPKDEQVPFSKEECAFRSQLETPETLLGSTEEKPLPLGVPDAGMKPS

SEQ ID NO: 92 - protein, 170 aa, Artificial Sequence
  derived and/or modified protein sequence (wt) from Homo sapiens__NP_002623.2__HsPGF
MPVMRLFPCFLQLLAGLALPAVPPQQWALSAGNGSSEVEVVPFQEVWGRSYCRALERLVDVVSEYPSEVEHMFSPSCVSLLRCTGCCGDENLHCVPVETANVTMQLLKIRSGDRPSYVELTFSQHVRCECRPLREKMKPERRRPKGRGKRRREKQRPTDCHLCGDAVPRR

SEQ ID NO: 93 - protein, 412 aa, Artificial Sequence
  derived and/or modified protein sequence (wt) from Homo sapiens__NP_001020537.2__HsVEGFA
MTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRYKSWSVYVGARCCLMPWSLPGPHPCGPCSERRKHLFVQDPQTCKCSCKNTDSRCKARQLELNERTCRCDKPRR

SEQ ID NO: 94 - protein, 232 aa, Artificial Sequence
  derived and/or modified protein sequence (wt) from Homo sapiens__NP_001165094.1__HsVEGFA
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRYKSWSVYVGARCCLMPWSLPGPHPCGPCSERRKHLFVQDPQTCKCSCKNTDSRCKARQLELNERTCRCDKPRR

SEQ ID NO: 95 - protein, 207 aa, Artificial Sequence
  derived and/or modified protein sequence (wt) from Homo sapiens__NP_003368.1__HsVEGFB
MSPLLRRLLLAALLQLAPAQAPVSQPDAPGHQRKVVSWIDVYTRATCQPREVVVPLTVELMGTVAKQLVPSCVTVQRCGGCCPDDGLECVPTGQHQVRMQILMIRYPSSQLGEMSLEEHSQCECRPKKKDSAVKPDRAATPHHRPQPRSVPGWDSAPGAPSPADITHPTPAPGPSAHAAPSTTSALTPGPAAAAADAAASSVAKGGA

SEQ ID NO: 96 - protein, 419 aa, Artificial Sequence
  derived and/or modified protein sequence (wt) from Homo sapiens__NP_005420.1__HsVEGFC
MHLLGFFSVACSLLAAALLPGPREAPAAAAAFESGLDLSDAEPDAGEATAYASKDLEEQLRSVSSVDELMTVLYPEYWKMYKCQLRKGGWQHNREQANLNSRTEETIKFAAAHYNTEILKSIDNEWRKTQCMPREVCIDVGKEFGVATNTFFKPPCVSVYRCGGCCNSEGLQCMNTSTSYLSKTLFEITVPLSQGPKPVTISFANHTSCRCMSKLDVYRQVHSIIRRSLPATLPQCQAANKTCPTNYMWNNHICRCLAQEDFMFSSDAGDDSTDGFHDICGPNKELDEETCQCVCRAGLRPASCGPHKELDRNSCQCVCKNKLFPSQCGANREFDENTCQCVCKRTCPRNQPLNPGKCACECTESPQKCLLKGKKFHHQTCSCYRRPCTNRQKACEPGFSYSEEVCRCVPSYWKRPQMS

SEQ ID NO: 97 - protein, 354 aa, Artificial Sequence
  derived and/or modified protein sequence (wt) from Homo sapiens__NP_004460.1__HsVEGFD
MYREWVVVNVFMMLYVQLVQGSSNEHGPVKRSSQSTLERSEQQIRAASSLEELLRITHSEDWKLWRCRLRLKSFTSMDSRSASHRSTRFAATFYDIETLKVIDEEWQRTQCSPRETCVEVASELGKSTNTFFKPPCVNVFRCGGCCNEESLICMNTSTSYISKQLFEISVPLTSVPELVPVKVANHTGCKCLPTAPRHPYSIIRRSIQIPEEDRCSHSKKLCPIDMLWDSNKCKCVLQEENPLAGTEDHSHLQEPALCGPHMMFDEDRCECVCKTPCPKDLIQHPKNCSCFECKESLETCCQKHKLFHPDTCSCEDRCPFHTRPCASGKTACAKHCRFPKEKRAAQGPHSRKNP

SEQ ID NO: 98 - RNA, 662 nt, Artificial Sequence
  derived and/or modified CDS sequence (wt) from EMCV____EMCV-IRES
uugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaau

SEQ ID NO: 99 - RNA, 72 nt, Artificial Sequence
  derived and/or modified CDS sequence (wt) from Homo sapiens__AAA59606.1__signal peptide-HLA-A2-SP
auggccgucauggcgccccgaacccucguccugcuacucucgggggcucuggcccugacccagaccugggcg

SEQ ID NO: 100 - RNA, 69 nt, Artificial Sequence
  derived and/or modified CDS sequence (wt) from Homo sapiens__AAA61213.1__signal peptide-HsPLAT
auggaugcaaugaagagagggcucugcugugugcugcugcuguguggagcagucuucguuucgcccagc

SEQ ID NO: 101 - RNA, 81 nt, Artificial Sequence
  derived and/or modified CDS sequence (wt) from Homo sapiens__NP_000790.2__signal peptide-HsEPO
augggggugcacgaauguccugccuggcuguggcuucuccugucccugcugucgcucccucugggccucccaguccugggc

SEQ ID NO: 102 - RNA, 54 nt, Artificial Sequence
  derived and/or modified CDS sequence (wt) from Homo sapiens__NP_000468.1__signal peptide-HsALB
augaaguggguaaccuuuauuucccuucuuuuucucuuuagcucggcuuauucc

SEQ ID NO: 103 - RNA, 18 nt, Artificial Sequence
  derived and/or modified CDS sequence (wt) from Artificial____cleavage site-Furin
agaaggcggcgcaagaga

SEQ ID NO: 104 - RNA, 630 nt, Artificial Sequence
  derived and/or modified CDS sequence (wt) from Homo sapiens__NP_061986.1__HsFGF21
auggacucggacgagaccggguucgagcacucaggacuguggguuucugugcuggcuggucuucugcugggagccugccaggcacaccccaucccugacuccaguccucuccugcaauucgggggccaaguccggcagcgguaccucuacacagaugaugcccagcagacagaagcccaccuggagaucagggaggaugggacgguggggggcgcugcugaccagagccccgaaagucuccugcagcugaaagccuugaagccgggaguuauucaaaucuugggagucaagacauccagguuccugugccagcggccagauggggcccuguauggaucgcuccacuuugacccugaggccugcagcuuccgggagcugcuucuugaggacggauacaauguuuaccaguccgaagcccacggccucccgcugcaccugccagggaacaaguccccacaccgggacccugcaccccgaggaccagcucgcuuccugccacuaccaggccugccccccgcacucccggagccacccggaauccuggccccccagccccccgaugugggcuccucggacccucugagcauggugggaccuucccagggccgaagccccagcuacgcuuccuga

SEQ ID NO: 105 - RNA, 630 nt, Artificial Sequence
  derived and/or modified CDS sequence (wt) from Homo sapiens__NP_061986.1__HsFGF21
auggacucggacgagaccggguucgagcacucaggacuguggguuucugugcuggcuggucuucugcugggagccugccaggcacaccccaucccugacuccaguccucuccugcaauucgggggccaaguccggcagcgguaccucuacacagaugaugcccagcagacagaagcccaccuggagaucagggaggaugggacgguggggggcgcugcugaccagagccccgaaagucuccugcagcugaaagccuugaagccgggaguuauucaaaucuugggagucaagacauccagguuccugugccagcggccagauggggcccuguauggaucgcuccacuuugacccugaggccugcagcuuccgggagcugcuucuugaggacggauacaauguuuaccaguccgaagcccacggccucccgcugcaccucccagggaacaaguccccacaccgggacccugcaccccgaggaccagcucgcuuccugccacuaccaggccugccccccgcacucccggagccacccggaauccuggccccccagccccccgaugugggcuccucggacccucugagcauggugggaccuucccagggccgaagccccagcuacgcuuccuga

SEQ ID NO: 106 - RNA, 1410 nt, Artificial Sequence
  derived and/or modified CDS sequence (wt) from Homo sapiens__NP_002412.1__HsMMP1
augcacagcuuuccuccacugcugcugcugcuguucugggguguggugucucacagcuucccagcgacucuagaaacacaagagcaagauguggacuuaguccagaaauaccuggaaaaauacuacaaccugaagaaugaugggaggcaaguugaaaagcggagaaauaguggcccagugguugaaaaauugaagcaaaugcaggaauucuuugggcugaaagugacugggaaaccagaugcugaaacccugaaggugaugaagcagcccagauguggagugccugauguggcucaguuuguccucacugaggggaacccucgcugggagcaaacacaucugaccuacaggauugaaaauuacacgccagauuugccaagagcagauguggaccaugccauugagaaagccuuccaacucuggaguaaugucacaccucugacauucaccaaggucucugagggucaagcagacaucaugauaucuuuugucaggggagaucaucgggacaacucuccuuuugauggaccuggaggaaaucuugcucaugcuuuucaaccaggcccagguauuggaggggaugcucauuuugaugaagaugaaagguggaccaacaauuucagagaguacaacuuacaucguguugcagcucaugaacucggccauucucuuggacucucccauucuacugauaucggggcuuugauguacccuagcuacaccuucaguggugauguucagcuagcucaggaugacauugauggcauccaagccauauauggacguucccaaaauccuguccagcccaucggcccacaaaccccaaaagcgugugacaguaagcuaaccuuugaugcuauaacuacgauucggggagaagugauguucuuuaaagacagauucuacaugcgcacaaaucccuucuacccggaaguugagcucaauuucauuucuguuuucuggccacaacugccaaaugggcuugaagcugcuuacgaauuugccgacagagaugaaguccgguuuuucaaagggaauaaguacugggcuguucagggacagaaugugcuacacggauaccccaaggacaucuacagcuccuuuggcuucccuagaacugugaagcauaucgaugcugcucuuucugaggaaaacacuggaaaaaccuacuucuuuguugcuaacaaauacuggagguaugaugaauauaaacgaucuauggauccagguuaucccaaaaugauagcacaugacuuuccuggaauuggccacaaaguugaugcaguuuucaugaaagauggauuuuucuauuucuuucauggaacaagacaauacaaauuugauccuaaaacgaagagaauuuugacucuccagaaagcuaauagcugguucaacugcaggaaaaauuga

SEQ ID NO: 107 - RNA, 1410 nt, Artificial Sequence
  derived and/or modified CDS sequence (wt) from Homo sapiens__NP_002412.1__HsMMP1
augcacagcuuuccuccacugcugcugcugcuguucugggguguggugucucacagcuucccagcgacucuagaaacacaagagcaagauguggacuuaguccagaaauaccuggaaaaauacuacaaccugaagaaugaugggaggcaaguugaaaagcggagaaauaguggcccagugguugaaaaauugaagcaaaugcaggaguucuuugggcugaaagugacugggaaaccagaugcugaaacccugaaggugaugaagcagcccagauguggagugccugauguggcucaguuuguccucacugaggggaacccucgcugggagcaaacacaucugaccuacaggauugaaaauuacacgccagauuugccaagagcagauguggaccaugccauugagaaagccuuccaacucuggaguaaugucacaccucugacauucaccaaggucucugagggucaagcagacaucaugauaucuuuugucaggggagaucaucgggacaacucuccuuuugauggaccuggaggaaaucuugcucaugcuuuucaaccaggcccagguauuggaggggaugcucauuuugaugaagaugaaagguggaccaacaauuucagagaguacaacuuacaucguguugcagcucaugaacucggccauucucuuggacucucccauucuacugauaucggggcuuugauguacccuagcuacaccuucaguggugauguucagcuagcucaggaugacauugauggcauccaagccauauauggacguucccaaaauccuguccagcccaucggcccacaaaccccaaaagcgugugacaguaagcuaaccuuugaugcuauaacuacgauucggggagaagugauguucuuuaaagacagauucuacaugcgcacaaaucccuucuacccggaaguugagcucaauuucauuucuguuuucuggccacaacugccaaaugggcuugaagcugcuuacgaauuugccgacagagaugaaguccgguuuuucaaagggaauaaguacugggcuguucagggacagaaugugcuacacggauaccccaaggacaucuacagcuccuuuggcuucccuagaacugugaagcauaucgaugcugcucuuucugaggaaaacacuggaaaaaccuacuucuuuguugcuaacaaauacuggagguaugaugaauauaaacgaucuauggauccagguuaucccaaaaugauagcacaugacuuuccuggaauuggccacaaaguugaugcaguuuucaugaaagauggauuuuucuauuucuuucauggaacaagacaauacaaauuugauccuaaaacgaagagaauuuugacucuccagaaagcuaauagcugguucaacugcaggaaaaauuga

SEQ ID NO: 108 - RNA, 1170 nt, Artificial Sequence
  derived and/or modified CDS sequence (wt) from Homo sapiens__NP_002412.1__HsMMP1(1-19,100-469)
augcacagcuuuccuccacugcugcugcugcuguucugggguguggugucucacagcuuuguccucacugaggggaacccucgcugggagcaaacacaucugaccuacaggauugaaaauuacacgccagauuugccaagagcagauguggaccaugccauugagaaagccuuccaacucuggaguaaugucacaccucugacauucaccaaggucucugagggucaagcagacaucaugauaucuuuugucaggggagaucaucgggacaacucuccuuuugauggaccuggaggaaaucuugcucaugcuuuucaaccaggcccagguauuggaggggaugcucauuuugaugaagaugaaagguggaccaacaauuucagagaguacaacuuacaucguguugcagcucaugaacucggccauucucuuggacucucccauucuacugauaucggggcuuugauguacccuagcuacaccuucaguggugauguucagcuagcucaggaugacauugauggcauccaagccauauauggacguucccaaaauccuguccagcccaucggcccacaaaccccaaaagcgugugacaguaagcuaaccuuugaugcuauaacuacgauucggggagaagugauguucuuuaaagacagauucuacaugcgcacaaaucccuucuacccggaaguugagcucaauuucauuucuguuuucuggccacaacugccaaaugggcuugaagcugcuuacgaauuugccgacagagaugaaguccgguuuuucaaagggaauaaguacugggcuguucagggacagaaugugcuacacggauaccccaaggacaucuacagcuccuuuggcuucccuagaacugugaagcauaucgaugcugcucuuucugaggaaaacacuggaaaaaccuacuucuuuguugcuaacaaauacuggagguaugaugaauauaaacgaucuauggauccagguuaucccaaaaugauagcacaugacuuuccuggaauuggccacaaaguugaugcaguuuucaugaaagauggauuuuucuauuucuuucauggaacaagacaauacaaauuugauccuaaaacgaagagaauuuugacucuccagaaagcuaauagcugguucaacugcaggaaaaauuga

SEQ ID NO: 109 - RNA, 3357 nt, Artificial Sequence
  derived and/or modified CDS sequence (wt) from Clostridium histolyticum__BAA77453.1__ColG
augaaaaaaaauauuuuaaagauucuuauggauaguuauucuaaagaaucuaaaauucaaacuguacguaggguuacgaguguaucacuuuuagcgguauaucuuacuaugaauacuucaaguuuaguuuuagcaaaaccaauagaaaauacuaaugauacuaguauaaaaaauguggagaaauuaagaaaugcuccaaaugaagagaauaguaaaaagguagaagauaguaaaaaugauaagguagaacaugugaaaaauauagaagaggcaaagguugagcaaguugcacccgaaguaaaaucuaaaucaacuuuaagaagugcuucuauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaauucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcuuuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaauucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacuaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacuaguagaggcaaaaauucaguacaugcuuacaaaaaagcaggaacauauaauguuacauuaaaaguaacugacgauaagggugcaacagcuacagaaagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaa

SEQ ID NO: 110 - RNA, 3357 nt, Artificial Sequence
  derived and/or modified CDS sequence (wt) from Clostridium histolyticum__BAA77453.1__ColG
augaaaaaaaauauuuuaaagauucuuauggauaguuauucuaaagaaucuaaaauucaaacuguacguaggguuacgaguguaucacuuuuagcgguauaucuuacuaugaauacuucaaguuuaguuuuagcaaaaccaauagaaaauacuaaugauacaaguauaaaaaauguggagaaauuaagaaaugcuccaaaugaagagaauaguaaaaagguagaagauaguaaaaaugauaagguagaacaugugaaaaauauagaagaggcaaagguugagcaaguugcacccgaaguaaaaucuaaaucaacuuuaagaagugcuucuauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaguucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcauuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaguucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacaaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacaaguagaggcaaaaauucaguacaugcuuacaaaaaagcaggaacauauaauguuacauuaaaaguaacugacgauaagggugcaacagcuacagagagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaa

SEQ ID NO: 111 - RNA, 3081 nt, Artificial Sequence
  derived and/or modified CDS sequence (wt) from Clostridium histolyticum__BAA77453.1__HsALB(1-18)_ColG(111-1118)
augaaguggguaaccuuuauuucccuucuuuuucucuuuagcucggcuuauuccauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaauucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcuuuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaauucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacuaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacuaguagaggcaaaaauucaguacaugcuuacaaaaaagcaggaacauauaauguuacauuaaaaguaacugacgauaagggugcaacagcuacagaaagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaa

SEQ ID NO: 112 - RNA, 3081 nt, Artificial Sequence
  derived and/or modified CDS sequence (wt) from Clostridium histolyticum__BAA77453.1__HsALB(1-18)_ColG(111-1118)
augaaguggguaaccuuuauuucccuucuuuuucucuuuagcucggcuuauuccauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaguucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcauuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaguucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacaaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacaaguagaggcaaaaauucaguacaugcuuacaaaaaagcaggaacauauaauguuacauuaaaaguaacugacgauaagggugcaacagcuacagagagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaa

SEQ ID NO: 113 - RNA, 3429 nt, Artificial Sequence
  derived and/or modified CDS sequence (wt) from Clostridium histolyticum__BAA77453.1__HsALB(1-18)_ColG(1-110)_CS-F_ColG(111-1 118)
augaaguggguaaccuuuauuucccuucuuuuucucuuuagcucggcuuauuccaugaaaaaaaauauuuuaaagauucuuauggauaguuauucuaaagaaucuaaaauucaaacuguacguaggguuacgaguguaucacuuuuagcgguauaucuuacuaugaauacuucaaguuuaguuuuagcaaaaccaauagaaaauacuaaugauacuaguauaaaaaauguggagaaauuaagaaaugcuccaaaugaagagaauaguaaaaagguagaagauaguaaaaaugauaagguagaacaugugaaaaauauagaagaggcaaagguugagcaaguugcacccgaaguaaaaucuaaaucaacuuuaagaagugcuucuagaaggcggcgcaagagaauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaauucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcuuuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaauucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacuaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacuaguagaggcaaaaauucaguacaugcuuacaaaaaagcaggaacauauaauguuacauuaaaaguaacugacgauaagggugcaacagcuacagaaagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaa

SEQ ID NO: 114 - RNA, 3429 nt, Artificial Sequence
  derived and/or modified CDS sequence (wt) from Clostridium histolyticum__BAA77453.1__HsALB(1-18)_ColG(1-110)_CS-F_ColG(111-1 118)
augaaguggguaaccuuuauuucccuucuuuuucucuuuagcucggcuuauuccaugaaaaaaaauauuuuaaagauucuuauggauaguuauucuaaagaaucuaaaauucaaacuguacguaggguuacgaguguaucacuuuuagcgguauaucuuacuaugaauacuucaaguuuaguuuuagcaaaaccaauagaaaauacuaaugauacaaguauaaaaaauguggagaaauuaagaaaugcuccaaaugaagagaauaguaaaaagguagaagauaguaaaaaugauaagguagaacaugugaaaaauauagaagaggcaaagguugagcaaguugcacccgaaguaaaaucuaaaucaacuuuaagaagugcuucuagaaggcggcgcaagagaauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaguucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcauuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaguucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacaaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacaaguagaggcaaaaauucaguacaugcuuacaaaaaagcaggaacauauaauguuacauuaaaaguaacugacgauaagggugcaacagcuacagagagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaa

SEQ ID NO: 115 - RNA, 3105 nt, Artificial Sequence
  derived and/or modified CDS sequence (wt) from Clostridium histolyticum__BAA34542.1__ColH
augaauuuuuuaaaaauuauuuuaaauagggggaagacuaugaaaaggaaauguuuaucuaaaaggcuuauguuagcuauaacaauggcuacaauauuuacagugaacaguacauuaccaauuuaugcagcuguagauaaaaauaaugcaacagcagcuguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcuuucagacacuguacauucuaaauauggugcuaguuuugaauucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaa

SEQ ID NO: 116 - RNA, 3105 nt, Artificial Sequence
  derived and/or modified CDS sequence (wt) from Clostridium histolyticum__BAA34542.1__ColH
augaauuuuuuaaaaauuauuuuaaauagggggaagacuaugaaaaggaaauguuuaucuaaaaggcuuauguuagcuauaacaauggcuacaauauuuacagugaacaguacauuaccaauuuaugcagcuguagauaaaaauaaugcaacagcagcuguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcugucagacacuguacauucuaaauauggugcuaguuuugaguucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaa

SEQ ID NO: 117 - RNA, 3066 nt, Artificial Sequence
  derived and/or modified CDS sequence (wt) from Clostridium histolyticum__BAA34542.1__ColH
augaaaaggaaauguuuaucuaaaaggcuuauguuagcuauaacaauggcuacaauauuuacagugaacaguacauuaccaauuuaugcagcuguagauaaaaauaaugcaacagcagcuguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcuuucagacacuguacauucuaaauauggugcuaguuuugaauucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaa

SEQ ID NO: 118 - RNA, 3066 nt, Artificial Sequence
  derived and/or modified CDS sequence (wt) from Clostridium histolyticum__BAA34542.1__ColH
augaaaaggaaauguuuaucuaaaaggcuuauguuagcuauaacaauggcuacaauauuuacagugaacaguacauuaccaauuuaugcagcuguagauaaaaauaaugcaacagcagcuguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcugucagacacuguacauucuaaauauggugcuaguuuugaguucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaa

SEQ ID NO: 119 - RNA, 3000 nt, Artificial Sequence
  derived and/or modified CDS sequence (wt) from Clostridium histolyticum__BAA34542.1__HsALB(1-18)_ColH(41-1021)
augaaguggguaaccuuuauuucccuucuuuuucucuuuagcucggcuuauuccguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcuuucagacacuguacauucuaaauauggugcuaguuuugaauucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaa

SEQ ID NO: 120 - RNA, 3000 nt, Artificial Sequence
  derived and/or modified CDS sequence (wt) from Clostridium histolyticum__BAA34542.1__HsALB(1-18)_ColH(41-1021)
augaaguggguaaccuuuauuucccuucuuuuucucuuuagcucggcuuauuccguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcugucagacacuguacauucuaaauauggugcuaguuuugaguucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaa

SEQ ID NO: 121 - RNA, 3138 nt, Artificial Sequence
  derived and/or modified CDS sequence (wt) from Clostridium histolyticum__BAA34542.1__HsALB(1-18)_ColH(1-40)_CS-F_ColH(41-102 1)
augaaguggguaaccuuuauuucccuucuuuuucucuuuagcucggcuuauuccaugaaaaggaaauguuuaucuaaaaggcuuauguuagcuauaacaauggcuacaauauuuacagugaacaguacauuaccaauuuaugcagcuguagauaaaaauaaugcaacagcagcuagaaggcggcgcaagagaguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcuuucagacacuguacauucuaaauauggugcuaguuuugaauucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaa

SEQ ID NO: 122 - RNA, 3138 nt, Artificial Sequence
  derived and/or modified CDS sequence (wt) from Clostridium histolyticum__BAA34542.1__HsALB(1-18)_ColH(1-40)_CS-F_ColH(41-102 1)
augaaguggguaaccuuuauuucccuucuuuuucucuuuagcucggcuuauuccaugaaaaggaaauguuuaucuaaaaggcuuauguuagcuauaacaauggcuacaauauuuacagugaacaguacauuaccaauuuaugcagcuguagauaaaaauaaugcaacagcagcuagaaggcggcgcaagagaguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcugucagacacuguacauucuaaauauggugcuaguuuugaguucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaa

SEQ ID NO: 123 - RNA, 576 nt, Artificial Sequence
  derived and/or modified CDS sequence (wt) from Homo sapiens__NP_001133.1__HsAMELX
auggggaccuggauuuuauuugccugccuccugggagcagcuuuugccaugccucuaccaccucauccugggcacccugguuauaucaacuucagcuaugaggugcuuaccccuuugaagugguaccagagcauaaggccaccguacccuuccuaugguuacgagcccauggguggauggcugcaccaccaaaucauccccgugcugucccaacagcaccccccgacucacacccugcagccucaucaccacaucccaguggugccagcucagcagcccgugaucccccagcaaccaaugaugcccguuccuggccaacacuccaugacuccaauccaacaccaccagccaaaccucccuccgcccgcccagcagcccuaccagccccagccuguucagccacagccucaccagcccaugcagccccagccaccugugcaccccaugcagccccugccgccacagccaccucugccuccgauguuccccaugcagccccugccucccaugcuuccugaucugacucuggaagcuuggccaucaacagacaagaccaagcgggaggaaguggauuaa

SEQ ID NO: 124 - RNA, 576 nt, Artificial Sequence
  derived and/or modified CDS sequence (wt) from Homo sapiens__NP_001133.1__HsAMELX
auggggaccuggauuuuauuugccugccuccugggagcagcuuuugccaugccucuaccaccucauccugggcacccugguuauaucaacuucagcuaugaggugcuuaccccuuugaagugguaccagagcauaaggccaccguacccuuccuaugguuacgagcccauggguggauggcugcaccaccaaaucauccccgugcugucccaacagcaccccccgacucacacccugcagccucaucaccacaucccaguggugccagcucagcagcccgugaucccccagcaaccaaugaugcccguuccuggccaacacuccaugacuccaauccaacaccaccagccaaaccucccuccgcccgcccagcagcccuaccagccccagccuguucagccacagccucaccagcccaugcagccccagccaccugugcaccccaugcagccccugccgccacagccaccucugccuccgauguuccccaugcagccccugccucccaugcuuccugaucugacucuggaagcauggccaucaacagacaagaccaagcgggaggaaguggauuaa

SEQ ID NO: 125 - RNA, 135 nt, Artificial Sequence
  derived and/or modified CDS sequence (wt) from Homo sapiens__NP_001133.1__HsAMELX-TRAP
augccucuaccaccucauccugggcacccugguuauaucaacuucagcuaugaggugcuuaccccuuugaagugguaccagagcauaaggccaccguacccuuccuaugguuacgagcccauggguggaugguaa

SEQ ID NO: 126 - RNA, 168 nt, Artificial Sequence
  derived and/or modified CDS sequence (wt) from Homo sapiens__NP_001133.1__HsAMELX-LRAP
augccucuaccaccucauccugggcacccugguuauaucaacuucagcuaugaggugcuuaccccuuugaagugguaccagagcauaaggccaccucccaugcuuccugaucugacucuggaagcuuggccaucaacagacaagaccaagcgggaggaaguggauuaa

SEQ ID NO: 127 - RNA, 168 nt, Artificial Sequence
  derived and/or modified CDS sequence (wt) from Homo sapiens__NP_001133.1__HsAMELX-LRAP
augccucuaccaccucauccugggcacccugguuauaucaacuucagcuaugaggugcuuaccccuuugaagugguaccagagcauaaggccaccucccaugcuuccugaucugacucuggaagcauggccaucaacagacaagaccaagcgggaggaaguggauuaa

SEQ ID NO: 128 - RNA, 207 nt, Artificial Sequence
  derived and/or modified CDS sequence (wt) from Homo sapiens__NP_001133.1__HLA-A2-SP_HsAMELX(17-60)
auggccgucauggcgccccgaacccucguccugcuacucucgggggcucuggcccugacccagaccugggcgaugccucuaccaccucauccugggcacccugguuauaucaacuucagcuaugaggugcuuaccccuuugaagugguaccagagcauaaggccaccguacccuuccuaugguuacgagcccauggguggaugguaa

SEQ ID NO: 129 - RNA, 240 nt, Artificial Sequence
  derived and/or modified CDS sequence (wt) from Homo sapiens__NP_001133.1__HLA-A2-SP_HsAMELX(17-47,168-191)
auggccgucauggcgccccgaacccucguccugcuacucucgggggcucuggcccugacccagaccugggcgaugccucuaccaccucauccugggcacccugguuauaucaacuucagcuaugaggugcuuaccccuuugaagugguaccagagcauaaggccaccucccaugcuuccugaucugacucuggaagcauggccaucaacagacaagaccaagcgggaggaaguggauuaa

SEQ ID NO: 130 - RNA, 579 nt, Artificial Sequence
  derived and/or modified CDS sequence (wt) from Homo sapiens__NP_001134.1__HsAMELY
auggggaccuggauuuuguuugccugccuugugggagcagcuuuugccaugccucuaccaccucauccugggcacccugguuauaucaacuucagcuaugaggugcucaccccuuugaagugguaccagagcaugauaagaccaccauacucuuccuaugguuacgagcccauggguggauggcugcaccaccaaaucauccccguggugucccaacagcacccccugacucacacccugcagucucaucaccacaucccaguggugccagcucagcagcccaggguccgccagcaagcacugaugccuguuccuggccagcaauccaugacuccaacccaacaccaucagccaaaccucccucugccugcccagcagcccuuccagccccagccuguucagccacagccucaccagcccaugcagccccagccaccugugcaacccaugcagccccugcugccacagccaccucugccuccaauguucccccugcggccccugccccccauacuuccugaucugcaucuggaagcuuggccagcaacagacaagaccaagcaggaggaaguggauuaa

SEQ ID NO: 131 - RNA, 579 nt, Artificial Sequence
  derived and/or modified CDS sequence (wt) from Homo sapiens__NP_001134.1__HsAMELY
auggggaccuggauuuuguuugccugccuugugggagcagcuuuugccaugccucuaccaccucauccugggcacccugguuauaucaacuucagcuaugaggugcucaccccuuugaagugguaccagagcaugauaagaccaccauacucuuccuaugguuacgagcccauggguggauggcugcaccaccaaaucauccccguggugucccaacagcacccccugacucacacccugcagucucaucaccacaucccaguggugccagcucagcagcccaggguccgccagcaagcacugaugccuguuccuggccagcaauccaugacuccaacccaacaccaucagccaaaccucccucugccugcccagcagcccuuccagccccagccuguucagccacagccucaccagcccaugcagccccagccaccugugcaacccaugcagccccugcugccacagccaccucugccuccaauguucccccugcggccccugccccccauacuuccugaucugcaucuggaagcauggccagcaacagacaagaccaagcaggaggaaguggauuaa

SEQ ID NO: 132 - RNA, 138 nt, Artificial Sequence
  derived and/or modified CDS sequence (wt) from Homo sapiens__NP_001134.1__HsAMELY-TRAP
augccucuaccaccucauccugggcacccugguuauaucaacuucagcuaugaggugcucaccccuuugaagugguaccagagcaugauaagaccaccauacucuuccuaugguuacgagcccauggguggaugguaa

SEQ ID NO: 133 - RNA, 171 nt, Artificial Sequence
  derived and/or modified CDS sequence (wt) from Homo sapiens__NP_001134.1__HsAMELY-LRAP
augccucuaccaccucauccugggcacccugguuauaucaacuucagcuaugaggugcucaccccuuugaagugguaccagagcaugauaagaccaccccccauacuuccugaucugcaucuggaagcuuggccagcaacagacaagaccaagcaggaggaaguggauuaa

SEQ ID NO: 134 - RNA, 171 nt, Artificial Sequence
  derived and/or modified CDS sequence (wt) from Homo sapiens__NP_001134.1__HsAMELY-LRAP
augccucuaccaccucauccugggcacccugguuauaucaacuucagcuaugaggugcucaccccuuugaagugguaccagagcaugauaagaccaccccccauacuuccugaucugcaucuggaagcauggccagcaacagacaagaccaagcaggaggaaguggauuaa

SEQ ID NO: 135 - RNA, 210 nt, Artificial Sequence
  derived and/or modified CDS sequence (wt) from Homo sapiens__NP_001134.1__HLA-A2-SP_HsAMELY(17-61)
auggccgucauggcgccccgaacccucguccugcuacucucgggggcucuggcccugacccagaccugggcgaugccucuaccaccucauccugggcacccugguuauaucaacuucagcuaugaggugcucaccccuuugaagugguaccagagcaugauaagaccaccauacucuuccuaugguuacgagcccauggguggaugguaa

SEQ ID NO: 136 - RNA, 243 nt, Artificial Sequence
  derived and/or modified CDS sequence (wt) from Homo sapiens__NP_001134.1__HLA-A2-SP_HsAMELY(17-48,169-192)
auggccgucauggcgccccgaacccucguccugcuacucucgggggcucuggcccugacccagaccugggcgaugccucuaccaccucauccugggcacccugguuauaucaacuucagcuaugaggugcucaccccuuugaagugguaccagagcaugauaagaccaccccccauacuuccugaucugcaucuggaagcauggccagcaacagacaagaccaagcaggaggaaguggauuaa

SEQ ID NO: 137 - RNA, 570 nt, Artificial Sequence
  derived and/or modified CDS sequence (wt) from Sus scrofa__NP_999071.1__SsAMELX-001-1
auggggaccuggauuuuguuugcuugccuccugggagcagccuucucuaugccucuaccaccucauccugggcacccugguuauaucaacuucagcuaugaggugcuuaccccucugaagugguaccagaacaugauaagacauccguacacuuccuauggguacgaacccauggguggauggcugcaccaccaaaucauacccguggugucgcagcagacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcuuggccagcaacagacaagaccaagcgggaggaaguggauuaa

SEQ ID NO: 138 - RNA, 570 nt, Artificial Sequence
  derived and/or modified CDS sequence (wt) from Sus scrofa__NP_999071.1__SsAMELX-001-1
auggggaccuggauuuuguuugcuugccuccugggagcagccuucucuaugccucuaccaccucauccugggcacccugguuauaucaacuucagcuaugaggugcuuaccccucugaagugguaccagaacaugauaagacauccguacacuuccuauggguacgaacccauggguggauggcugcaccaccaaaucauacccguggugucgcagcagacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcauggccagcaacagacaagaccaagcgggaggaaguggauuaa

SEQ ID NO: 139 - RNA, 138 nt, Artificial Sequence
  derived and/or modified CDS sequence (wt) from Sus scrofa__NP_999071.1__SsAMELX-TRAP
augccucuaccaccucauccugggcacccugguuauaucaacuucagcuaugaggugcuuaccccucugaagugguaccagaacaugauaagacauccguacacuuccuauggguacgaacccauggguggaugguaa

SEQ ID NO: 140 - RNA, 171 nt, Artificial Sequence
  derived and/or modified CDS sequence (wt) from Sus scrofa__NP_999071.1__SsAMELX-LRAP
augccucuaccaccucauccugggcacccugguuauaucaacuucagcuaugaggugcuuaccccucugaagugguaccagaacaugauaagacauccgucucugcuuccugaccugccucuggaagcuuggccagcaacagacaagaccaagcgggaggaaguggauuaa

SEQ ID NO: 141 - RNA, 171 nt, Artificial Sequence
  derived and/or modified CDS sequence (wt) from Sus scrofa__NP_999071.1__SsAMELX-LRAP
augccucuaccaccucauccugggcacccugguuauaucaacuucagcuaugaggugcuuaccccucugaagugguaccagaacaugauaagacauccgucucugcuuccugaccugccucuggaagcauggccagcaacagacaagaccaagcgggaggaaguggauuaa

SEQ ID NO: 142 - RNA, 210 nt, Artificial Sequence
  derived and/or modified CDS sequence (wt) from Sus scrofa__NP_999071.1__HLA-A2-SP_SsAMEL(17-61)
auggccgucauggcgccccgaacccucguccugcuacucucgggggcucuggcccugacccagaccugggcgaugccucuaccaccucauccugggcacccugguuauaucaacuucagcuaugaggugcuuaccccucugaagugguaccagaacaugauaagacauccguacacuuccuauggguacgaacccauggguggaugguaa

SEQ ID NO: 143 - RNA, 243 nt, Artificial Sequence
  derived and/or modified CDS sequence (wt) from Sus scrofa__NP_999071.1__HLA-A2-SP_SsAMEL(17-49,167-189)
auggccgucauggcgccccgaacccucguccugcuacucucgggggcucuggcccugacccagaccugggcgaugccucuaccaccucauccugggcacccugguuauaucaacuucagcuaugaggugcuuaccccucugaagugguaccagaacaugauaagacauccgucucugcuuccugaccugccucuggaagcauggccagcaacagacaagaccaagcgggaggaaguggauuaa

SEQ ID NO: 144 - RNA, 534 nt, Artificial Sequence
  derived and/or modified CDS sequence (wt) from Sus scrofa__P45561-2__SsAMELX-001-2
auggggaccuggauuuuguuugcuugccuccugggagcagccuucucuaugccucuaccaccucauccugggcacccugguuauaucaacuucagcuauauaagacauccguacacuuccuauggguacgaacccauggguggauggcugcaccaccaaaucauacccguggugucgcagcagacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcuuggccagcaacagacaagaccaagcgggaggaaguggauuaa

SEQ ID NO: 145 - RNA, 570 nt, Artificial Sequence
  derived and/or modified CDS sequence (wt) from Sus scrofa__NP_998965.1__SsAMELX-001-3
auggggaccuggauuuucuuugccugccuuuugggagcaucccuugcuaugccucuaccaccucauccugggcacccugguuauaucaacuucagcuaugaggugcuuaccccucugaagugguaccagaacaugauaagacauccguacacuuccuauggguacgaacccauggguggauggcugcaccaccaaaucauacccguggugucgcagcagacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcuuggccagcaacagacaagaccaagcgggaggaaguggauuaa

SEQ ID NO: 146 - RNA, 219 nt, Artificial Sequence
  derived and/or modified CDS sequence (wt) from Sus scrofa__K7GPB2__SsAMELX-002
auggggaccuggauuuuguuugcuugccuccugggagcagccuucucuaugccucuaccaccucauccugggcacccugguuauaucaacuucagcuaugaggugcuuaccccucugaagugguaccagaacaugauaagacauccgucucugcuuccugaccugccucuggaagcuuggccagcaacagacaagaccaagcgggaggaaguggauuaa

SEQ ID NO: 147 - RNA, 612 nt, Artificial Sequence
  derived and/or modified CDS sequence (wt) from Sus scrofa__K7GLD0__SsAMELX-003
auggggaccuggauuuuguuugcuugccuccugggagcagccuucucuaugccucuaccaccucauccugggcacccugguuauaucaacuucagcuaugaggacuuauacuuggaggcuauccguauugacaggacugcauucgugcuuaccccucugaagugguaccagaacaugauaagacauccguacacuuccuaugguuacgaacccauggguggauggcugcaccaccaaaucauucccguggugucgcagcagacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcuuggccagcaacagacaagaccaagcgggaggaaguggauuaa

SEQ ID NO: 148 - RNA, 498 nt, Artificial Sequence
  derived and/or modified CDS sequence (wt) from Sus scrofa__K7GPE9__SsAMELX-004
auggggaccuggauuuuguuugcuugccuccugggagcagccuucucuaugccucuaccaccucauccugggcacccugguuauaucaacuucagcuaugaggugcuuaccccucugaagugguaccagaacaugauaagacauccgacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcuuggccagcaacagacaagaccaagcgggaggaaguggauuaa

SEQ ID NO: 149 - RNA, 522 nt, Artificial Sequence
  derived and/or modified CDS sequence (wt) from Sus scrofa__J9JIM4__SsAMELX-201
augccucuaccaccucauccugggcacccugguuauaucaacuucagcuaugaggugcuuaccccucugaagugguaccagaacaugauaagacauccguacacuuccuauggguacgaacccauggguggauggcugcaccaccaaaucauacccguggugucgcagcagacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcuuggccagcaacagacaagaccaagcgggaggaaguggauuaa

SEQ ID NO: 150 - RNA, 2961 nt, Artificial Sequence
  derived and/or modified CDS sequence (wt) from Homo sapiens__NP_006120.1__HsBMP1
augcccggcguggcccgccugccgcugcugcucgggcugcugcugcucccgcgucccggccggccgcuggacuuggccgacuacaccuaugaccuggcggaggaggacgacucggagccccucaacuacaaagaccccugcaaggcggcugccuuucuuggggacauugcccuggacgaagaggaccugagggccuuccagguacagcaggcuguggaucucagacggcacacagcucguaaguccuccaucaaagcugcaguuccaggaaacacuucuacccccagcugccagagcaccaacgggcagccucagaggggagccugugggagauggagagguagaucccguagccggcgggcggcgacgucccgaccagagcguguguggcccgauggggucauccccuuugucauugggggaaacuucacugguagccagagggcagucuuccggcaggccaugaggcacugggagaagcacaccugugucaccuuccuggagcgcacugacgaggacagcuauauuguguucaccuaucgaccuugcgggugcugcuccuacgugggucgccgcggcgggggcccccaggccaucuccaucggcaagaacugugacaaguucggcauugugguccacgagcugggccacgucgucggcuucuggcacgaacacacucggccagaccgggaccgccacguuuccaucguucgugagaacauccagccagggcaggaguauaacuuccugaagauggagccucaggagguggagucccugggggagaccuaugacuucgacagcaucaugcauuacgcucggaacacauucuccaggggcaucuuccuggauaccauuguccccaaguaugaggugaacggggugaaaccucccauuggccaaaggacacggcucagcaagggggacauugcccaagcccgcaagcuuuacaagugcccagccuguggagagacccugcaagacagcacaggcaacuucuccuccccugaauaccccaauggcuacucugcucacaugcacugcguguggcgcaucucugucacacccggggagaagaucauccugaacuucacgucccuggaccuguaccgcagccgccugugcugguacgacuauguggagguccgagauggcuucuggaggaaggcgccccuccgaggccgcuucugcggguccaaacucccugagccuaucgucuccacugacagccgccucuggguugaauuccgcagcagcagcaauuggguuggaaagggcuucuuugcagucuacgaagccaucugcgggggugaugugaaaaaggacuauggccacauucaaucgcccaacuacccagacgauuaccggcccagcaaagucugcaucuggcggauccaggugucugagggcuuccacgugggccucacauuccaguccuuugagauugagcgccacgacagcugugccuacgacuaucuggaggugcgcgacgggcacagugagagcagcacccucaucgggcgcuacuguggcuaugagaagccugaugacaucaagagcacguccagccgccucuggcucaaguucgucucugacggguccauuaacaaagcgggcuuugccgucaacuuuuucaaagagguggacgagugcucucggcccaaccgcgggggcugugagcagcggugccucaacacccugggcagcuacaagugcagcugugaccccggguacgagcuggccccagacaagcgccgcugugaggcugcuuguggcggauuccucaccaagcucaacggcuccaucaccagcccgggcuggcccaaggaguacccccccaacaagaacugcaucuggcagcugguggcccccacccaguaccgcaucucccugcaguuugacuucuuugagacagagggcaaugaugugugcaaguacgacuucguggaggugcgcaguggacucacagcugacuccaagcugcauggcaaguucugugguucugagaagcccgaggucaucaccucccaguacaacaacaugcgcguggaguucaaguccgacaacaccguguccaaaaagggcuucaaggcccacuucuucucagacaaggacgagugcuccaaggauaacggcggcugccagcaggacugcgucaacacguucggcaguuaugagugccaaugccgcaguggcuucguccuccaugacaacaagcacgacugcaaagaagccggcugugaccacaaggugacauccaccagugguaccaucaccagccccaacuggccugacaaguaucccagcaagaaggagugcacgugggccaucuccagcacccccgggcaccgggucaagcugaccuucauggagauggacaucgagucccagccugagugugccuacgaccaccuagagguguucgacgggcgagacgccaaggcccccguccucggccgcuucugugggagcaagaagcccgagcccguccuggccacaggcagccgcauguuccugcgcuucuacucagauaacucgguccagcgaaagggcuuccaggccucccacgccacagagugcgggggccagguacgggcagacgugaagaccaaggaccuuuacucccacgcccaguuuggcgacaacaacuacccuggggguguggacugugagugggucauuguggccgaggaaggcuacggcguggagcucguguuccagaccuuugagguggaggaggagaccgacugcggcuaugacuacauggagcucuucgacggcuacgacagcacagcccccaggcuggggcgcuacuguggcucagggccuccugaggagguguacucggcgggagauucuguccuggugaaguuccacucggaugacaccaucaccaaaaaagguuuccaccugcgauacaccagcaccaaguuccaggacacacuccacagcaggaaguga

SEQ ID NO: 151 - RNA, 1191 nt, Artificial Sequence
  derived and/or modified CDS sequence (wt) from Homo sapiens__NP_001191.1__HsBMP2
augguggccgggacccgcugucuucuagcguugcugcuuccccagguccuccugggcggcgcggcuggccucguuccggagcugggccgcaggaaguucgcggcggcgucgucgggccgccccucaucccagcccucugacgagguccugagcgaguucgaguugcggcugcucagcauguucggccugaaacagagacccacccccagcagggacgccguggugccccccuacaugcuagaccuguaucgcaggcacucaggucagccgggcucacccgccccagaccaccgguuggagagggcagccagccgagccaacacugugcgcagcuuccaccaugaagaaucuuuggaagaacuaccagaaacgagugggaaaacaacccggagauucuucuuuaauuuaaguucuauccccacggaggaguuuaucaccucagcagagcuucagguuuuccgagaacagaugcaagaugcuuuaggaaacaauagcaguuuccaucaccgaauuaauauuuaugaaaucauaaaaccugcaacagccaacucgaaauuccccgugaccagacuuuuggacaccagguuggugaaucagaaugcaagcaggugggaaaguuuugaugucacccccgcugugaugcgguggacugcacagggacacgccaaccauggauucgugguggaaguggcccacuuggaggagaaacaaggugucuccaagagacauguuaggauaagcaggucuuugcaccaagaugaacacagcuggucacagauaaggccauugcuaguaacuuuuggccaugauggaaaagggcauccucuccacaaaagagaaaaacgucaagccaaacacaaacagcggaaacgccuuaaguccagcuguaagagacacccuuuguacguggacuucagugacgugggguggaaugacuggauuguggcucccccgggguaucacgccuuuuacugccacggagaaugcccuuuuccucuggcugaucaucugaacuccacuaaucaugccauuguucagacguuggucaacucuguuaacucuaagauuccuaaggcaugcugugucccgacagaacucagugcuaucucgaugcuguaccuugacgagaaugaaaagguuguauuaaagaacuaucaggacaugguuguggaggguugugggugucgcuag

SEQ ID NO: 152 - RNA, 1227 nt, Artificial Sequence
  derived and/or modified CDS sequence (wt) from Homo sapiens__NP_001193.2__HsBMP4
augauuccugguaaccgaaugcugauggucguuuuauuaugccaaguccugcuaggaggcgcgagccaugcuaguuugauaccugagacggggaagaaaaaagucgccgagauucagggccacgcgggaggacgccgcucagggcagagccaugagcuccugcgggacuucgaggcgacacuucugcagauguuugggcugcgccgccgcccgcagccuagcaagagugccgucauuccggacuacaugcgggaucuuuaccggcuucagucuggggaggaggaggaagagcagauccacagcacuggucuugaguauccugagcgcccggccagccgggccaacaccgugaggagcuuccaccacgaagaacaucuggagaacaucccagggaccagugaaaacucugcuuuucguuuccucuuuaaccucagcagcaucccugagaacgaggugaucuccucugcagagcuucggcucuuccgggagcagguggaccagggcccugauugggaaaggggcuuccaccguauaaacauuuaugagguuaugaagcccccagcagaaguggugccugggcaccucaucacacgacuacuggacacgagacugguccaccacaaugugacacggugggaaacuuuugaugugagcccugcgguccuucgcuggacccgggagaagcagccaaacuaugggcuagccauugaggugacucaccuccaucagacucggacccaccagggccagcaugucaggauuagccgaucguuaccucaagggagugggaauugggcccagcuccggccccuccuggucaccuuuggccaugauggccggggccaugccuugacccgacgccggagggccaagcguagcccuaagcaucacucacagcgggccaggaagaagaauaagaacugccggcgccacucgcucuauguggacuucagcgaugugggcuggaaugacuggauuguggccccaccaggcuaccaggccuucuacugccauggggacugccccuuuccacuggcugaccaccucaacucaaccaaccaugccauugugcagacccuggucaauucugucaauuccaguauccccaaagccuguugugugcccacugaacugagugccaucuccaugcuguaccuggaugaguaugauaaggugguacugaaaaauuaucaggagaugguaguagagggaugugggugccgcuga

SEQ ID NO: 153 - RNA, 1542 nt, Artificial Sequence
  derived and/or modified CDS sequence (wt) from Homo sapiens__NP_001709.1__HsBMP6
augccggggcuggggcggagggcgcaguggcugugcugguggugggggcugcugugcagcugcugcgggcccccgccgcugcggccgcccuugcccgcugccgcggccgccgccgccggggggcagcugcugggggacggcgggagccccggccgcacggagcagccgccgccgucgccgcaguccuccucgggcuuccuguaccggcggcucaagacgcaggagaagcgggagaugcagaaggagaucuugucggugcuggggcucccgcaccggccccggccccugcacggccuccaacagccgcagcccccggcgcuccggcagcaggaggagcagcagcagcagcagcagcugccucgcggagagcccccucccgggcgacugaaguccgcgccccucuucaugcuggaucuguacaacgcccuguccgccgacaacgacgaggacggggcgucggagggggagaggcagcaguccuggccccacgaagcagccagcucgucccagcgucggcagccgcccccgggcgccgcgcacccgcucaaccgcaagagccuucuggcccccggaucuggcagcggcggcgcguccccacugaccagcgcgcaggacagcgccuuccucaacgacgcggacauggucaugagcuuugugaaccugguggaguacgacaaggaguucuccccucgucagcgacaccacaaagaguucaaguucaacuuaucccagauuccugagggugagguggugacggcugcagaauuccgcaucuacaaggacuguguuauggggaguuuuaaaaaccaaacuuuucuuaucagcauuuaucaagucuuacaggagcaucagcacagagacucugaccuguuuuuguuggacacccguguaguaugggccucagaagaaggcuggcuggaauuugacaucacggccacuagcaaucuguggguugugacuccacagcauaacauggggcuucagcugagcguggugacaagggauggaguccacguccacccccgagccgcaggccuggugggcagagacggcccuuacgacaagcagcccuucaugguggcuuucuucaaagugagugaggugcacgugcgcaccaccaggucagccuccagccggcgccgacaacagagucguaaucgcucuacccagucccaggacguggcgcgggucuccagugcuucagauuacaacagcagugaauugaaaacagccugcaggaagcaugagcuguaugugaguuuccaagaccugggauggcaggacuggaucauugcacccaagggcuaugcugccaauuacugugauggagaaugcuccuucccacucaacgcacacaugaaugcaaccaaccacgcgauugugcagaccuugguucaccuuaugaaccccgaguauguccccaaaccgugcugugcgccaacuaagcuaaaugccaucucgguucuuuacuuugaugacaacuccaaugucauucugaaaaaauacaggaauaugguuguaagagcuuguggaugccacuaa

SEQ ID NO: 154 - RNA, 1296 nt, Artificial Sequence
  derived and/or modified CDS sequence (wt) from Homo sapiens__NP_001710.1__HsBMP7
augcacgugcgcucacugcgagcugcggcgccgcacagcuucguggcgcucugggcaccccuguuccugcugcgcuccgcccuggccgacuucagccuggacaacgaggugcacucgagcuucauccaccggcgccuccgcagccaggagcggcgggagaugcagcgcgagauccucuccauuuugggcuugccccaccgcccgcgcccgcaccuccagggcaagcacaacucggcacccauguucaugcuggaccuguacaacgccauggcgguggaggagggcggcgggcccggcggccagggcuucuccuaccccuacaaggccgucuucaguacccagggccccccucuggccagccugcaagauagccauuuccucaccgacgccgacauggucaugagcuucgucaaccucguggaacaugacaaggaauucuuccacccacgcuaccaccaucgagaguuccgguuugaucuuuccaagaucccagaaggggaagcugucacggcagccgaauuccggaucuacaaggacuacauccgggaacgcuucgacaaugagacguuccggaucagcguuuaucaggugcuccaggagcacuugggcagggaaucggaucucuuccugcucgacagccguacccucugggccucggaggagggcuggcugguguuugacaucacagccaccagcaaccacuggguggucaauccgcggcacaaccugggccugcagcucucgguggagacgcuggaugggcagagcaucaaccccaaguuggcgggccugauugggcggcacgggccccagaacaagcagcccuucaugguggcuuucuucaaggccacggagguccacuuccgcagcauccgguccacggggagcaaacagcgcagccagaaccgcuccaagacgcccaagaaccaggaagcccugcggauggccaacguggcagagaacagcagcagcgaccagaggcaggccuguaagaagcacgagcuguaugucagcuuccgagaccugggcuggcaggacuggaucaucgcgccugaaggcuacgccgccuacuacugugagggggagugugccuucccucugaacuccuacaugaacgccaccaaccacgccaucgugcagacgcugguccacuucaucaacccggaaacggugcccaagcccugcugugcgcccacgcagcucaaugccaucuccguccucuacuucgaugacagcuccaacgucauccugaagaaauacagaaacauggugguccgggccuguggcugccacuag

SEQ ID NO: 155 - RNA, 300 nt, Artificial Sequence
  derived and/or modified CDS sequence (wt) from Homo sapiens__NP_006264.2__HsCCL7
augaaagccucugcagcacuucugugucugcugcucacagcagcugcuuucagcccccaggggcuugcucagccaguugggauuaauacuucaacuaccugcugcuacagauuuaucaauaagaaaaucccuaagcagaggcuggagagcuacagaaggaccaccaguagccacuguccccgggaagcuguaaucuucaagaccaaacuggacaaggagaucugugcugaccccacacagaaguggguccaggacuuuaugaagcaccuggacaagaaaacccaaacuccaaagcuuuga

SEQ ID NO: 156 - RNA, 3624 nt, Artificial Sequence
  derived and/or modified CDS sequence (wt) from Homo sapiens__NP_001954.2__HsEGF
augcugcucacucuuaucauucuguugccaguaguuucaaaauuuaguuuuguuagucucucagcaccgcagcacuggagcuguccugaagguacucucgcaggaaaugggaauucuacuuguguggguccugcacccuucuuaauuuucucccauggaaauaguaucuuuaggauugacacagaaggaaccaauuaugagcaauuggugguggaugcuggugucucagugaucauggauuuucauuauaaugagaaaagaaucuauuggguggauuuagaaagacaacuuuugcaaagaguuuuucugaaugggucaaggcaagagagaguauguaauauagagaaaaauguuucuggaauggcaauaaauuggauaaaugaagaaguuauuuggucaaaucaacaggaaggaaucauuacaguaacagauaugaaaggaaauaauucccacauucuuuuaagugcuuuaaaauauccugcaaauguagcaguugauccaguagaaagguuuauauuuuggucuucagagguggcuggaagccuuuauagagcagaucucgauggugugggagugaaggcucuguuggagacaucagagaaaauaacagcugugucauuggaugugcuugauaagcggcuguuuuggauucaguacaacagagaaggaagcaauucucuuauuugcuccugugauuaugauggagguucuguccacauuaguaaacauccaacacagcauaauuuguuugcaaugucccuuuuuggugaccguaucuucuauucaacauggaaaaugaagacaauuuggauagccaacaaacacacuggaaaggacaugguuagaauuaaccuccauucaucauuuguaccacuuggugaacugaaaguagugcauccacuugcacaacccaaggcagaagaugacacuugggagccugagcagaaacuuugcaaauugaggaaaggaaacugcagcagcacugugugugggcaagaccuccagucacacuugugcaugugugcagagggauacgcccuaagucgagaccggaaguacugugaagauguuaaugaaugugcuuuuuggaaucauggcuguacucuuggguguaaaaacaccccuggauccuauuacugcacgugcccuguaggauuuguucugcuuccugaugggaaacgaugucaucaacuuguuuccuguccacgcaaugugucugaaugcagccaugacuguguucugacaucagaaggucccuuauguuucuguccugaaggcucagugcuugagagagaugggaaaacauguagcgguuguuccucacccgauaaugguggauguagccagcucugcguuccucuuagcccaguauccugggaaugugauugcuuuccuggguaugaccuacaacuggaugaaaaaagcugugcagcuucaggaccacaaccauuuuugcuguuugccaauucucaagauauucgacacaugcauuuugauggaacagacuauggaacucugcucagccagcagaugggaaugguuuaugcccuagaucaugacccuguggaaaauaagauauacuuugcccauacagcccugaaguggauagagagagcuaauauggaugguucccagcgagaaaggcuuauugaggaaggaguagaugugccagaaggucuugcuguggacuggauuggccguagauucuauuggacagacagagggaaaucucugauuggaaggagugauuuaaaugggaaacguuccaaaauaaucacuaaggagaacaucucucaaccacgaggaauugcuguucauccaauggccaagagauuauucuggacugauacagggauuaauccacgaauugaaaguucuucccuccaaggccuuggccgucugguuauagccagcucugaucuaaucuggcccaguggaauaacgauugacuucuuaacugacaaguuguacuggugcgaugccaagcagucugugauugaaauggccaaucuggaugguucaaaacgccgaagacuuacccagaaugauguaggucacccauuugcuguagcaguguuugaggauuaugugugguucucagauugggcuaugccaucaguaaugagaguaaacaagaggacuggcaaagauagaguacgucuccaaggcagcaugcugaagcccucaucacugguugugguucauccauuggcaaaaccaggagcagaucccugcuuauaucaaaacggaggcugugaacauauuugcaaaaagaggcuuggaacugcuugguguucgugucgugaagguuuuaugaaagccucagaugggaaaacgugucuggcucuggauggucaucagcuguuggcagguggugaaguugaucuaaagaaccaaguaacaccauuggacaucuuguccaagacuagagugucagaagauaacauuacagaaucucaacacaugcuaguggcugaaaucauggugucagaucaagaugacugugcuccugugggaugcagcauguaugcucgguguauuucagagggagaggaugccacaugucaguguuugaaaggauuugcuggggauggaaaacuauguucugauauagaugaaugugagaugggugucccagugugccccccugccuccuccaagugcaucaacaccgaaggugguuaugucugccggugcucagaaggcuaccaaggagaugggauucacugucuugauauugaugagugccaacugggggagcacagcuguggagagaaugccagcugcacaaauacagagggaggcuauaccugcaugugugcuggacgccugucugaaccaggacugauuugcccugacucuacuccacccccucaccucagggaagaugaccaccacuauuccguaagaaauagugacucugaauguccccugucccacgauggguacugccuccaugauggugugugcauguauauugaagcauuggacaaguaugcaugcaacuguguuguuggcuacaucggggagcgaugucaguaccgagaccugaaguggugggaacugcgccacgcuggccacgggcagcagcagaaggucaucgugguggcugucugcgugguggugcuugucaugcugcuccuccugagccuguggggggcccacuacuacaggacucagaagcugcuaucgaaaaacccaaagaauccuuaugaggagucgagcagagaugugaggagucgcaggccugcugacacugaggaugggauguccucuugcccucaaccuugguuugugguuauaaaagaacaccaagaccucaagaaugggggucaaccaguggcuggugaggauggccaggcagcagaugggucaaugcaaccaacuucauggaggcaggagccccaguuauguggaaugggcacagagcaaggcugcuggauuccaguauccagugauaagggcuccuguccccagguaauggagcgaagcuuucauaugcccuccuaugggacacagacccuugaagggggugucgagaagccccauucucuccuaucagcuaacccauuauggcaacaaagggcccuggacccaccacaccaaauggagcugacucaguga

SEQ ID NO: 157 - RNA, 510 nt, Artificial Sequence
  derived and/or modified CDS sequence (wt) from Homo sapiens__NP_001423.1__HsEREG
augaccgcggggaggaggauggagaugcucugugccggcagggucccugcgcugcugcucugccuggguuuccaucuucuacaggcaguccucaguacaacugugauuccaucauguaucccaggagaguccagugauaacugcacagcuuuaguucagacagaagacaauccacguguggcucaagugucaauaacaaaguguagcucugacaugaauggcuauuguuugcauggacagugcaucuaucugguggacaugagucaaaacuacugcaggugugaaguggguuauacugguguccgaugugaacacuucuuuuuaaccguccaccaaccuuuaagcaaagaauauguggcuuugaccgugauucuuauuauuuuguuucuuaucacagucgucgguuccacauauuauuucugcagaugguacagaaaucgaaaaaguaaagaaccaaagaaggaauaugagagaguuaccucaggggauccagaguugccgcaagucuga

SEQ ID NO: 158 - RNA, 468 nt, Artificial Sequence
  derived and/or modified CDS sequence (wt) from Homo sapiens__NP_000791.1__HsFGF1
auggcugaaggggaaaucaccaccuucacagcccugaccgagaaguuuaaucugccuccagggaauuacaagaagcccaaacuccucuacuguagcaacgggggccacuuccugaggauccuuccggauggcacaguggaugggacaagggacaggagcgaccagcacauucagcugcagcucagugcggaaagcgugggggagguguauauaaagaguaccgagacuggccaguacuuggccauggacaccgacgggcuuuuauacggcucacagacaccaaaugaggaauguuuguuccuggaaaggcuggaggagaaccauuacaacaccuauauauccaagaagcaugcagagaagaauugguuuguuggccucaagaagaaugggagcugcaaacgcgguccucggacucacuauggccagaaagcaaucuuguuucucccccugccagucucuucugauuaa

SEQ ID NO: 159 - RNA, 867 nt, Artificial Sequence
  derived and/or modified CDS sequence (wt) from Homo sapiens__NP_001997.5__HsFGF2
auggugggugugggggguggagauguagaagaugugacgccgcggcccggcgggugccagauuagcggacgcggugcccgcgguugcaacgggaucccgggcgcugcagcuugggaggcggcucuccccaggcggcguccgcggagacacccauccgugaaccccaggucccgggccgccggcucgccgcgcaccaggggccggcggacagaagagcggccgagcggcucgaggcugggggaccgcgggcgcggccgcgcgcugccgggcgggaggcuggggggccggggccggggccgugccccggagcgggucggaggccggggccggggccgggggacggcggcuccccgcgcggcuccagcggcucggggaucccggccgggccccgcagggaccauggcagccgggagcaucaccacgcugcccgccuugcccgaggauggcggcagcggcgccuucccgcccggccacuucaaggaccccaagcggcuguacugcaaaaacgggggcuucuuccugcgcauccaccccgacggccgaguugacgggguccgggagaagagcgacccucacaucaagcuacaacuucaagcagaagagagaggaguugugucuaucaaaggagugugugcuaaccguuaccuggcuaugaaggaagauggaagauuacuggcuucuaaauguguuacggaugaguguuucuuuuuugaacgauuggaaucuaauaacuacaauacuuaccggucaaggaaauacaccaguugguauguggcacugaaacgaacugggcaguauaaacuuggauccaaaacaggaccugggcagaaagcuauacuuuuucuuccaaugucugcuaagagcuga

SEQ ID NO: 160 - RNA, 585 nt, Artificial Sequence
  derived and/or modified CDS sequence (wt) from Homo sapiens__NP_002000.1__HsFGF7
augcacaaauggauacugacauggauccugccaacuuugcucuacagaucaugcuuucacauuaucugucuaguggguacuauaucuuuagcuugcaaugacaugacuccagagcaaauggcuacaaaugugaacuguuccagcccugagcgacacacaagaaguuaugauuacauggaaggaggggauauaagagugagaagacucuucugucgaacacagugguaccugaggaucgauaaaagaggcaaaguaaaagggacccaagagaugaagaauaauuacaauaucauggaaaucaggacaguggcaguuggaauuguggcaaucaaagggguggaaagugaauucuaucuugcaaugaacaaggaaggaaaacucuaugcaaagaaagaaugcaaugaagauuguaacuucaaagaacuaauucuggaaaaccauuacaacacauaugcaucagcuaaauggacacacaacggaggggaaauguuuguugccuuaaaucaaaaggggauuccuguaagaggaaaaaaaacgaagaaagaacaaaaaacagcccacuuucuuccuauggcaauaacuuaa

SEQ ID NO: 161 - RNA, 627 nt, Artificial Sequence
  derived and/or modified CDS sequence (wt) from Homo sapiens__NP_001936.1__HsHBEGF
augaagcugcugccgucgguggugcugaagcucuuucuggcugcaguucucucggcacuggugacuggcgagagccuggagcggcuucggagagggcuagcugcuggaaccagcaacccggacccucccacuguauccacggaccagcugcuaccccuaggaggcggccgggaccggaaaguccgugacuugcaagaggcagaucuggaccuuuugagagucacuuuauccuccaagccacaagcacuggccacaccaaacaaggaggagcacgggaaaagaaagaagaaaggcaaggggcuagggaagaagagggacccaugucuucggaaauacaaggacuucugcauccauggagaaugcaaauaugugaaggagcuccgggcucccuccugcaucugccacccggguuaccauggagagaggugucaugggcugagccucccaguggaaaaucgcuuauauaccuaugaccacacaaccauccuggccgugguggcuguggugcugucaucugucugucugcuggucaucguggggcuucucauguuuagguaccauaggagaggagguuaugauguggaaaaugaagagaaagugaaguugggcaugacuaauucccacuga

SEQ ID NO: 162 - RNA, 2187 nt, Artificial Sequence
  derived and/or modified CDS sequence (wt) from Homo sapiens__NP_000592.3__HsHGF
augugggugaccaaacuccugccagcccugcugcugcagcauguccuccugcaucuccuccugcuccccaucgccauccccuaugcagagggacaaaggaaaagaagaaauacaauucaugaauucaaaaaaucagcaaagacuacccuaaucaaaauagauccagcacugaagauaaaaaccaaaaaagugaauacugcagaccaaugugcuaauagauguacuaggaauaaaggacuuccauucacuugcaaggcuuuuguuuuugauaaagcaagaaaacaaugccucugguuccccuucaauagcaugucaaguggagugaaaaaagaauuuggccaugaauuugaccucuaugaaaacaaagacuacauuagaaacugcaucauugguaaaggacgcagcuacaagggaacaguaucuaucacuaagaguggcaucaaaugucagcccuggaguuccaugauaccacacgaacacagcuuuuugccuucgagcuaucgggguaaagaccuacaggaaaacuacugucgaaauccucgaggggaagaagggggacccugguguuucacaagcaauccagagguacgcuacgaagucugugacauuccucaguguucagaaguugaaugcaugaccugcaauggggagaguuaucgaggucucauggaucauacagaaucaggcaagauuugucagcgcugggaucaucagacaccacaccggcacaaauucuugccugaaagauaucccgacaagggcuuugaugauaauuauugccgcaaucccgauggccagccgaggccauggugcuauacucuugacccucacacccgcugggaguacugugcaauuaaaacaugcgcugacaauacuaugaaugacacugauguuccuuuggaaacaacugaaugcauccaaggucaaggagaaggcuacaggggcacugucaauaccauuuggaauggaauuccaugucagcguugggauucucaguauccucacgagcaugacaugacuccugaaaauuucaagugcaaggaccuacgagaaaauuacugccgaaauccagaugggucugaaucacccugguguuuuaccacugauccaaacauccgaguuggcuacugcucccaaauuccaaacugugauaugucacauggacaagauuguuaucgugggaauggcaaaaauuauaugggcaacuuaucccaaacaagaucuggacuaacauguucaaugugggacaagaacauggaagacuuacaucgucauaucuucugggaaccagaugcaaguaagcugaaugagaauuacugccgaaauccagaugaugaugcucauggacccuggugcuacacgggaaauccacucauuccuugggauuauugcccuauuucucguugugaaggugauaccacaccuacaauagucaauuuagaccaucccguaauaucuugugccaaaacgaaacaauugcgaguuguaaaugggauuccaacacgaacaaacauaggauggaugguuaguuugagauacagaaauaaacauaucugcggaggaucauugauaaaggagaguuggguucuuacugcacgacaguguuucccuucucgagacuugaaagauuaugaagcuuggcuuggaauucaugauguccacggaagaggagaugagaaaugcaaacagguucucaauguuucccagcugguauauggcccugaaggaucagaucugguuuuaaugaagcuugccaggccugcuguccuggaugauuuuguuaguacgauugauuuaccuaauuauggaugcacaauuccugaaaagaccaguugcaguguuuauggcuggggcuacacuggauugaucaacuaugauggccuauuacgaguggcacaucucuauauaaugggaaaugagaaaugcagccagcaucaucgagggaaggugacucugaaugagucugaaauaugugcuggggcugaaaagauuggaucaggaccaugugagggggauuaugguggcccacuuguuugugagcaacauaaaaugagaaugguucuuggugucauuguuccuggucguggaugugccauuccaaaucguccugguauuuuuguccgaguagcauauuaugcaaaauggauacacaaaauuauuuuaacauauaagguaccacagucauag

SEQ ID NO: 163 - RNA, 1926 nt, Artificial Sequence
  derived and/or modified CDS sequence (wt) from Homo sapiens__NP_005336.3 __HsHSPA1A
auggccaaagccgcggcgaucggcaucgaccugggcaccaccuacuccugcguggggguguuccaacacggcaagguggagaucaucgccaacgaccagggcaaccgcaccacccccagcuacguggccuucacggacaccgagcggcucaucggggaugcggccaagaaccagguggcgcugaacccgcagaacaccguguuugacgcgaagcggcugauuggccgcaaguucggcgacccgguggugcagucggacaugaagcacuggccuuuccaggugaucaacgacggagacaagcccaaggugcaggugagcuacaagggggagaccaaggcauucuaccccgaggagaucucguccauggugcugaccaagaugaaggagaucgccgaggcguaccugggcuacccggugaccaacgcggugaucaccgugccggccuacuucaacgacucgcagcgccaggccaccaaggaugcgggugugaucgcggggcucaacgugcugcggaucaucaacgagcccacggccgccgccaucgccuacggccuggacagaacgggcaagggggagcgcaacgugcucaucuuugaccugggcgggggcaccuucgacguguccauccugacgaucgacgacggcaucuucgaggugaaggccacggccggggacacccaccuggguggggaggacuuugacaacaggcuggugaaccacuucguggaggaguucaagagaaaacacaagaaggacaucagccagaacaagcgagccgugaggcggcugcgcaccgccugcgagagggccaagaggacccugucguccagcacccaggccagccuggagaucgacucccuguuugagggcaucgacuucuacacguccaucaccagggcgagguucgaggagcugugcuccgaccuguuccgaagcacccuggagcccguggagaaggcucugcgcgacgccaagcuggacaaggcccagauucacgaccugguccuggucgggggcuccacccgcauccccaaggugcagaagcugcugcaggacuucuucaacgggcgcgaccugaacaagagcaucaaccccgacgaggcuguggccuacggggcggcggugcaggcggccauccugaugggggacaaguccgagaacgugcaggaccugcugcugcuggacguggcuccccugucgcuggggcuggagacggccggaggcgugaugacugcccugaucaagcgcaacuccaccauccccaccaagcagacgcagaucuucaccaccuacuccgacaaccaacccggggugcugauccagguguacgagggcgagagggccaugacgaaagacaacaaucuguuggggcgcuucgagcugagcggcaucccuccggcccccaggggcgugccccagaucgaggugaccuucgacaucgaugccaacggcauccugaacgucacggccacggacaagagcaccggcaaggccaacaagaucaccaucaccaacgacaagggccgccugagcaaggaggagaucgagcgcauggugcaggaggcggagaaguacaaagcggaggacgaggugcagcgcgagagggugucagccaagaacgcccuggaguccuacgccuucaacaugaagagcgccguggaggaugaggggcucaagggcaagaucagcgaggcggacaagaagaaggugcuggacaagugucaagaggucaucucguggcuggacgccaacaccuuggccgagaaggacgaguuugagcacaagaggaaggagcuggagcagguguguaaccccaucaucagcggacuguaccagggugccgguggucccgggccugggggcuucggggcucagggucccaagggagggucugggucaggccccaccauugaggagguagauuag

SEQ ID NO: 164 - RNA, 1926 nt, Artificial Sequence
  derived and/or modified CDS sequence (wt) from Homo sapiens__NP_005337.2 __HsHSPA1B
auggccaaagccgcggcgaucggcaucgaccugggcaccaccuacuccugcguggggguguuccaacacggcaagguggagaucaucgccaacgaccagggcaaccgcaccacccccagcuacguggccuucacggacaccgagcggcucaucggggaugcggccaagaaccagguggcgcugaacccgcagaacaccguguuugacgcgaagcggcugauuggccgcaaguucggcgacccgguggugcagucggacaugaagcacuggccuuuccaggugaucaacgacggagacaagcccaaggugcaggugagcuacaagggggagaccaaggcauucuaccccgaggagaucucguccauggugcugaccaagaugaaggagaucgccgaggcguaccugggcuacccggugaccaacgcggugaucaccgugccggccuacuucaacgacucgcagcgccaggccaccaaggaugcgggugugaucgcggggcucaacgugcugcggaucaucaacgagcccacggccgccgccaucgccuacggccuggacagaacgggcaagggggagcgcaacgugcucaucuuugaccugggcgggggcaccuucgacguguccauccugacgaucgacgacggcaucuucgaggugaaggccacggccggggacacccaccuggguggggaggacuuugacaacaggcuggugaaccacuucguggaggaguucaagagaaaacacaagaaggacaucagccagaacaagcgagccgugaggcggcugcgcaccgccugcgagagggccaagaggacccugucguccagcacccaggccagccuggagaucgacucccuguuugagggcaucgacuucuacacguccaucaccagggcgagguucgaggagcugugcuccgaccuguuccgaagcacccuggagcccguggagaaggcucugcgcgacgccaagcuggacaaggcccagauucacgaccugguccuggucgggggcuccacccgcauccccaaggugcagaagcugcugcaggacuucuucaacgggcgcgaccugaacaagagcaucaaccccgacgaggcuguggccuacggggcggcggugcaggcggccauccugaugggggacaaguccgagaacgugcaggaccugcugcugcuggacguggcuccccugucgcuggggcuggagacggccggaggcgugaugacugcccugaucaagcgcaacuccaccauccccaccaagcagacgcagaucuucaccaccuacuccgacaaccaacccggggugcugauccagguguacgagggcgagagggccaugacgaaagacaacaaucuguuggggcgcuucgagcugagcggcaucccuccggcccccaggggcgugccccagaucgaggugaccuucgacaucgaugccaacggcauccugaacgucacggccacggacaagagcaccggcaaggccaacaagaucaccaucaccaacgacaagggccgccugagcaaggaggagaucgagcgcauggugcaggaggcggagaaguacaaagcggaggacgaggugcagcgcgagagggugucagccaagaacgcccuggaguccuacgccuucaacaugaagagcgccguggaggaugaggggcucaagggcaagaucagcgaggcggacaagaagaagguucuggacaagugucaagaggucaucucguggcuggacgccaacaccuuggccgagaaggacgaguuugagcacaagaggaaggagcuggagcagguguguaaccccaucaucagcggacuguaccagggugccgguggucccgggccuggcggcuucggggcucagggucccaagggagggucugggucaggcccuaccauugaggagguggauuag

SEQ ID NO: 165 - RNA, 1926 nt, Artificial Sequence
  derived and/or modified CDS sequence (wt) from Homo sapiens__NP_005518.3 __HsHSPA1L
auggcuacugccaagggaaucgccauaggcaucgaccugggcaccaccuacuccuguguggggguguuccagcacggcaagguggagaucaucgccaacgaccagggcaaccgcaccacccccagcuacguggccuucacagacaccgagcggcucauuggggaugcggccaagaaccagguagcaaugaauccccagaacacuguuuuugaugcuaaacgucugaucggcaggaaauuuaaugauccuguuguacaagcagauaugaaacuuuggccuuuucaagugauuaaugaaggaggcaagcccaaaguccuuguguccuacaaaggggagaauaaagcuuucuacccugaggaaaucucuucgaugguauugacuaaguugaaggagacugcugaggccuuuuugggccacccugucaccaaugcagugauuaccgugccagccuauuucaaugacucucaacgucaggcuacuaaggaugcaggugugauugcuggacuuaaugugcuaagaaucaucaaugagcccacggcugcugccauugccuaugguuuagauaaaggaggucaaggagaacgacauguccugauuuuugaucuggguggaggcacauuugaugugucaauucugaccauagaugaugggauuuuugagguaaaggccacugcuggggacacucaccuggguggggaggacuuugacaacaggcuugugagccacuucguggaggaguucaagaggaaacacaaaaaggacaucagccagaacaagcgagccgugaggcggcugcgcaccgccugcgagagggccaagaggacccugucguccagcacccaggccaaccuagaaauugauucacuuuaugaaggcauugacuucuauacauccaucaccagagcucgauuugaagaguugugugcagaccuguuuagggguacccuggagccuguagaaaaagcgcuucgggaugccaagauggauaaggcuaaaauccaugacauuguuuuaguagggggcuccacccgcauccccaaggugcagcggcugcuucaggacuacuucaauggacgugaucucaacaagagcaucaacccugaugaggccguagcauauggggcugcgguacaagcagccauccugaugggggacaagucugagaagguacaggaccugcugcugcuggacguggcuccccugucccuggggcuggagacggcugggggcgugaugacugcccugauaaagcgcaacuccaccauccccaccaagcagacacagauuuucaccaccuacucugacaaccaacccggggugcugauccagguguaugagggcgagagggccaugacaaaggacaacaaccugcuggggcgguuugaccugacuggaaucccuccagcacccaggggaguuccucagaucgaggugacguuugacauugaugccaaugguauucucaaugucacagccacggacaagagcaccggcaaggugaacaagaucaccaucaccaaugacaagggccgccugagcaaggaggagauugagcgcaugguucuggaugcugagaaauauaaagcugaagaugagguccagagggagaaaauugcugcaaagaaugccuuagaauccuaugcuuuuaacaugaagaguguugugagugaugaagguuugaagggcaagauuagugagucugauaaaaauaaaauauuggauaaaugcaacgagcuccuuucguggcuggaggucaaucaacuggcagagaaagaugaguuugaucauaagagaaaggaauuggagcagauguguaacccuaucaucacaaaacucuaccaaggaggaugcacugggccugccugcggaacaggguaugugccuggaaggccugccacaggccccacaauugaagaaguagauuaa

SEQ ID NO: 166 - RNA, 1920 nt, Artificial Sequence
  derived and/or modified CDS sequence (wt) from Homo sapiens__NP_068814.2 __HsHSPA2
augucugcccguggcccggcuaucggcaucgaccugggcaccaccuauucgugcgucggggucuuccaacauggcaagguggagaucaucgccaacgaccagggcaaucgcaccacccccagcuacguggccuucacggacaccgagcgccucaucggcgacgccgccaagaaccagguggccaugaaccccaccaacaccaucuucgacgccaagaggcugauuggacggaaauucgaggaugccacagugcagucggauaugaaacacuggccguuccggguggugagcgagggaggcaagcccaaagugcaaguagaguacaagggggagaccaagaccuucuucccagaggagauauccuccaugguccucacgaagaugaaggagaucgcggaagccuaccuggggggcaaggugcacagcgcggucauaacggucccggccuauuucaacgacucgcagcgccaggccaccaaggacgcaggcaccaucacggggcucaaugugcugcgcaucaucaacgagcccacggcggcggccaucgccuacggccuggacaagaagggcugcgcgggcggcgagaagaacgugcucaucuuugaccugggcgguggcacuuucgacguguccauccugaccaucgaggauggcaucuucgaggugaaguccacggccggcgacacccaccugggcggugaggacuucgacaaccgcauggugagccaccuggcggaggaguucaagcgcaagcacaagaaggacauugggcccaacaagcgcgccgugaggcggcugcgcaccgcuugcgagcgcgccaagcgcacccugagcucguccacgcaggcgagcaucgagaucgacucgcucuacgagggcguggacuucuauacguccaucacgcgcgcccgcuucgaggagcucaaugccgaccucuuucgcgggacccuggagccgguggagaaggcgcugcgcgacgccaagcuggacaagggccagauccaggagaucgugcuggugggcggcuccacucguauccccaagauccagaagcugcugcaggauuucuucaacggcaaggagcugaacaagagcaucaaccccgacgaggcgguggccuauggcgccgcggugcaggcggccauccucaucggcgacaaaucagagaaugugcaggaccugcugcuacucgacgugaccccguugucgcugggcaucgagacagcuggcggugucaugaccccacucaucaagaggaacaccacgauccccaccaagcagacgcagaccuucaccaccuacucggacaaccagagcagcguacuggugcagguauacgagggcgaacgggccaugaccaaggacaauaaccugcugggcaaguucgaccugaccgggauucccccugcgccucgcggggucccccaaaucgagguuaccuucgacauugacgccaauggcauccuuaacguuaccgccgccgacaagagcaccgguaaggaaaacaaaaucaccaucaccaaugacaaaggucgucugagcaaggacgacauugaccggauggugcaggaggcggagcgguacaaaucggaagaugaggcgaaucgcgaccgagucgcggccaaaaacgcccuggaguccuauaccuacaacaucaagcagacgguggaagacgagaaacugaggggcaagauuagcgagcaggacaaaaacaagauccucgacaagugucaggaggugaucaacuggcucgaccgaaaccagauggcagagaaagaugaguaugaacacaagcagaaagagcucgaaagaguuugcaaccccaucaucagcaaacuuuaccaaggugguccuggcggcggcagcggcggcggcgguucaggagccuccgggggacccaccaucgaagaaguggacuaa

SEQ ID NO: 167 - RNA, 2523 nt, Artificial Sequence
  derived and/or modified CDS sequence (wt) from Homo sapiens__NP_002145.3 __HsHSPA4
augucgguggugggcauagaccugggcuuccagagcugcuacgucgcuguggcccgcgccggcggcaucgagacuaucgcuaaugaguauagcgaccgcugcacgccggcuugcauuucuuuugguccuaagaaucguucaauuggagcagcagcuaaaagccagguaauuucuaaugcaaagaacacaguccaaggauuuaaaagauuccauggccgagcauucucugauccauuuguggaggcagaaaaaucuaaccuugcauaugauauugugcaguugccuacaggauuaacagguauaaaggugacauauauggaggaagagcgaaauuuuaccacugagcaagugacugccaugcuuuuguccaaacugaaggagacagccgaaaguguucuuaagaagccuguaguugacuguguuguuucgguuccuuguuucuauacugaugcagaaagacgaucagugauggaugcaacacagauugcuggucuuaauugcuugcgauuaaugaaugaaaccacugcaguugcucuugcauauggaaucuauaagcaggaucuuccugccuuagaagagaaaccaagaaauguaguuuuuguagacaugggccacucugcuuaucaaguuucuguaugugcauuuaauagaggaaaacugaaaguucuggccacugcauuugacacgacauugggagguagaaaauuugaugaaguguuaguaaaucacuucugugaagaauuugggaagaaauacaagcuagacauuaaguccaaaauccgugcauuauuacgacucucucaggagugugagaaacucaagaaauugaugagugcaaaugcuucagaucucccuuugagcauugaauguuuuaugaaugauguugauguaucuggaacuaugaauagaggcaaauuucuggagaugugcaaugaucucuuagcuagaguggagccaccacuucguaguguuuuggaacaaaccaaguuaaagaaagaagauauuuaugcaguggagauaguugguggugcuacacgaaucccugcgguaaaagagaagaucagcaaauuuuucgguaaagaacuuaguacaacauuaaaugcugaugaagcugucacucgaggcugugcauugcagugugccaucuuaucgccugcuuucaaagucagagaauuuucuaucacugauguaguaccauauccaauaucucugagauggaauucuccagcugaagaagggucaagugacugugaagucuuuuccaaaaaucaugcugcuccuuucucuaaaguucuuacauuuuauagaaaggaaccuuucacucuugaggccuacuacagcucuccucaggauuugcccuauccagauccugcuauagcucaguuuucaguucagaaagucacuccucagucugauggcuccaguucaaaagugaaagucaaaguucgaguaaauguccauggcauuuucaguguguccagugcaucuuuaguggagguucacaagucugaggaaaaugaggagccaauggaaacagaucagaaugcaaaggaggaagagaagaugcaaguggaccaggaggaaccacauguugaagagcaacagcagcagacaccagcagaaaauaaggcagagucugaagaaauggagaccucucaagcuggauccaaggauaaaaagauggaccaaccaccccaagccaagaaggcaaaagugaagaccaguacuguggaccugccaaucgagaaucagcuauuauggcagauagacagagagaugcucaacuuguacauugaaaaugaggguaagaugaucaugcaggauaaacuggagaaggagcggaaugaugcuaagaacgcaguggaggaauauguguaugaaaugagagacaagcuuaguggugaauaugagaaguuugugagugaagaugaucguaacaguuuuacuuugaaacuggaagauacugaaaauugguuguaugaggauggagaagaccagccaaagcaaguuuauguugauaaguuggcugaauuaaaaaaucuaggucaaccuauuaagauacguuuccaggaaucugaagaacgaccaaaauuauuugaagaacuagggaaacagauccaacaguauaugaaaauaaucagcucuuucaaaaacaaggaggaccaguaugaucauuuggaugcugcugacaugacaaagguagaaaaaagcacaaaugaagcaauggaguggaugaauaacaagcuaaaucugcagaacaagcagaguuugaccauggauccaguugucaagucaaaagagauugaagcuaaaauuaaggagcugacaaguacuuguagcccuauaauuucaaagcccaaacccaaaguggaaccuccaaaagaggaacaaaaaaaugcagagcagaauggaccaguggauggacaaggagacaacccaggcccccaggcugcugagcaggguacagacacagcugugccuucggauucagacaagaagcuuccugaaauggacauugauuga

SEQ ID NO: 168 - RNA, 2520 nt, Artificial Sequence
  derived and/or modified CDS sequence (wt) from Homo sapiens__NP_055093.2 __HsHSPA4L
augucugugguuggcauugaccucggcuuucucaacugcuacauugcugucgcgagaaguggcggcaucgagaccaucgccaaugaguacagcgacagguguaccccggccuguauaucauugggaucaagaacucgagccauuggaaaugcagcaaagagccagauagucacgaacguaagaaauacaauucauggcuucaaaaagcuucaugggcgaucauuugaugaucccauugugcaaacugaaaggaucaggcuucccuaugaacugcagaaaaugccuaauggaagugcaggaguuaaggugcgguacuuagaggaagagagaccuuuugcaauugagcaaguuacuggaaugcuguuagccaagcuuaaagagacuucagaaaaugcuuugaagaaaccaguggcugacugugugauuucaauuccuagcuuuuuuacugaugccgagagaagaucugugauggcugcagcccagguugcaggcuuaaauuguuuaagguugaugaaugaaacuacugcaguugcacuggcguauggaauuuauaaacaggaucuucccccauuagaugagaaaccaagaaauguaguauuuauugauaugggacauucugccuaucaggucuugguuugugcuuuuaacaaaggaaaacuuaaagucuuggcuacuaccuuugauccauauuuggguggcaggaacuuugaugaggcuuuaguagacuacuucugugaugaguucaagaccaaauauaagauaaaugugaaagaaaacucucgggccuuguugcguuuauaucaggaaugugaaaaacuaaagaagcuaaugagugcaaaugcaucagaucuuccauugaacauugaguguuucaugaaugaccuugauguuucuaguaaaaugaacagggcucaauuugaacaacugugugcuucccuuuuggccaggguugaaccaccuuuaaaagcaguaauggaacaagcuaacuuacaacgugaagacauuaguaguauagaaauuguaggaggagcaacacgaauuccugcagugaaagaacaaaucacuaaauucuuucuuaaagacauaaguaccacauuaaaugcugaugaagcuguugcaagaggaugugcguuacagugugcgauucucucaccagcauuuaaagugcgugaauuuuccauaacagaccuuguucccuauucaaucacauuaagguggaagaccucuuuugaagauggaaguggggaaugugaaguuuucuguaagaaccauccugccccauucucaaaagucauuacuuuccacaagaaggaaccauuugaacuagaagcauuuuauacuaauuuacaugaagugccuuauccugaugcaagaauugggagcuucacuauucagaauguuuuuccacagucugauggugauaguuccaaagugaagguuaaaguucguguuaacauccauggaaucuucaguguggcuagcgcaucaguaauugagaagcaaaauuuggaaggcgaucacagugaugcuccaauggagacagaaacuucauuuaaaaaugaaaacaaagauaauauggauaaaaugcagguugaucaagaagaagggcaucaaaaaugucaugcugaacacacuccagaagaggaaauugaucauacaggagccaaaacaaagucagcugucucagacaaacaagaccgauuaaaucagacacuuaaaaaaggaaaagucaaaaguauugaucuaccgauccagaguagccuauguagacaacuaggccaagaucuucucaacagcuacauugaaaaugaggggaagaugaucaugcaagauaaguuagagaaagaaagaaaugaugcuaagaaugccguugaagaauauguauaugauuuuagagacaggcugggcacugucuaugaaaaauucaucacuccagaagacuugaguaaacugucugcaguauuggaagacacagaaaauuggcuuuaugaagacggagaggaccaaccuaaacaaguuuauguggauaagcuucaagaacuaaagaaauacggccagccuauucaaaugaaguacauggagcaugaagagagaccaaaagccuuaaaugacuugggaaaaaagauccaacuugucaugaaagugauagaagcuuauagaaacaaggaugaaagauaugaucaucuggauccuacugaaauggaaaagguugaaaaauguaucagugaugccaugaguuggcugaauaguaagaugaaugcacagaacaaacuaagucucacucaagauccugugguaaaaguuucagaaauaguagcaaagucaaaggaacuggauaauuucuguaaccccaucauuuacaagcccaaaccaaaagcagaaguuccugaagacaaaccaaaagcuaauagugaacacaauggcccaauggauggacagaguggaacugaaacuaaaucagauucaacaaaagacagcucacagcauacuaaauccucuggagagauggaaguggacuaa

SEQ ID NO: 169 - RNA, 1965 nt, Artificial Sequence
  derived and/or modified CDS sequence (wt) from Homo sapiens__NP_005338.1__HsHSPA5
augaagcucucccugguggccgcgaugcugcugcugcucagcgcggcgcgggccgaggaggaggacaagaaggaggacgugggcacgguggucggcaucgaccuggggaccaccuacuccugcgucggcguguucaagaacggccgcguggagaucaucgccaacgaucagggcaaccgcaucacgccguccuaugucgccuucacuccugaaggggaacgucugauuggcgaugccgccaagaaccagcucaccuccaaccccgagaacacggucuuugacgccaagcggcucaucggccgcacguggaaugacccgucugugcagcaggacaucaaguucuugccguucaaggugguugaaaagaaaacuaaaccauacauucaaguugauauuggaggugggcaaacaaagacauuugcuccugaagaaauuucugccaugguucucacuaaaaugaaagaaaccgcugaggcuuauuugggaaagaagguuacccaugcaguuguuacuguaccagccuauuuuaaugaugcccaacgccaagcaaccaaagacgcuggaacuauugcuggccuaaauguuaugaggaucaucaacgagccuacggcagcugcuauugcuuauggccuggauaagagggagggggagaagaacauccugguguuugaccuggguggcggaaccuucgaugugucucuucucaccauugacaauggugucuucgaaguuguggccacuaauggagauacucaucuggguggagaagacuuugaccagcgugucauggaacacuucaucaaacuguacaaaaagaagacgggcaaagaugucaggaaagacaauagagcugugcagaaacuccggcgcgagguagaaaaggccaaacgggcccugucuucucagcaucaagcaagaauugaaauugaguccuucuaugaaggagaagacuuuucugagacccugacucgggccaaauuugaagagcucaacauggaucuguuccggucuacuaugaagcccguccagaaaguguuggaagauucugauuugaagaagucugauauugaugaaauuguucuuguugguggcucgacucgaauuccaaagauucagcaacugguuaaagaguucuucaauggcaaggaaccaucccguggcauaaacccagaugaagcuguagcguauggugcugcuguccaggcuggugugcucucuggugaucaagauacaggugaccugguacugcuugauguauguccccuuacacuugguauugaaacugugggaggugucaugaccaaacugauuccaaggaacacaguggugccuaccaagaagucucagaucuuuucuacagcuucugauaaucaaccaacuguuacaaucaaggucuaugaaggugaaagaccccugacaaaagacaaucaucuucuggguacauuugaucugacuggaauuccuccugcuccucguggggucccacagauugaagucaccuuugagauagaugugaaugguauucuucgagugacagcugaagacaaggguacagggaacaaaaauaagaucacaaucaccaaugaccagaaucgccugacaccugaagaaaucgaaaggaugguuaaugaugcugagaaguuugcugaggaagacaaaaagcucaaggagcgcauugauacuagaaaugaguuggaaagcuaugccuauucucuaaagaaucagauuggagauaaagaaaagcugggagguaaacuuuccucugaagauaaggagaccauggaaaaagcuguagaagaaaagauugaauggcuggaaagccaccaagaugcugacauugaagacuucaaagcuaagaagaaggaacuggaagaaauuguucaaccaauuaucagcaaacucuauggaagugcaggcccucccccaacuggugaagaggauacagcagaaaaagaugaguuguag

SEQ ID NO: 170 - RNA, 1932 nt, Artificial Sequence
  derived and/or modified CDS sequence (wt) from Homo sapiens__NP_002146.2__HsHSPA6
augcaggccccacgggagcucgcggugggcaucgaccugggcaccaccuacucgugcgugggcguguuucagcagggccgcguggagauccuggccaacgaccagggcaaccgcaccacgcccagcuacguggccuucaccgacaccgagcggcuggucggggacgcggccaagagccaggcggcccugaacccccacaacaccguguucgaugccaagcggcugaucgggcgcaaguucgcggacaccacggugcagucggacaugaagcacuggcccuuccggguggugagcgagggcggcaagcccaaggugcgcguaugcuaccgcggggaggacaagacguucuaccccgaggagaucucguccauggugcugagcaagaugaaggagacggccgaggcguaccugggccagcccgugaagcacgcagugaucaccgugcccgccuauuucaaugacucgcagcgccaggccaccaaggacgcgggggccaucgcggggcucaacguguugcggaucaucaaugagcccacggcagcugccaucgccuaugggcuggaccggcggggcgcgggagagcgcaacgugcucauuuuugaccugggugggggcaccuucgaugugucgguucucuccauugacgcuggugucuuugaggugaaagccacugcuggagauacccaccugggaggagaggacuucgacaaccggcucgugaaccacuucauggaagaauuccggcggaagcaugggaaggaccugagcgggaacaagcgugcccugcgcaggcugcgcacagccugugagcgcgccaagcgcacccuguccuccagcacccaggccacccuggagauagacucccuguucgagggcguggacuucuacacguccaucacucgugcccgcuuugaggaacugugcucagaccucuuccgcagcacccuggagccgguggagaaggcccugcgggaugccaagcuggacaaggcccagauucaugacgucguccugguggggggcuccacacgcauccccaaggugcagaaguugcugcaggacuucuucaacggcaaggagcugaacaagagcaucaacccugaugaggcuguggccuauggggcugcugugcaggcggccguguugaugggggacaaaugugagaaagugcaggaucuccugcugcuggauguggcuccccugucucuggggcuggagacagcagguggggugaugaccacgcugauccagaggaacgccacuauccccaccaagcagacccagacuuucaccaccuacucggacaaccagccuggggucuucauccagguguaugagggugagagggccaugaccaaggacaacaaccugcuggggcguuuugaacucaguggcaucccuccugccccacguggagucccccagauagaggugacuuuugacauugaugcuaauggcauccugagcgugacagccacugacaggagcacagguaaggcuaacaagaucaccaucaccaaugacaagggccggcugagcaaggaggagguggagaggaugguucaugaagccgagcaguacaaggcugaggaugaggcccagagggacagaguggcugccaaaaacucgcuggaggcccaugucuuccaugugaaagguucuuugcaagaggaaagccuuagggacaagauucccgaagaggacaggcgcaaaaugcaagacaagugucgggaaguccuugccuggcuggagcacaaccagcuggcagagaaggaggaguaugagcaucagaagagggagcuggagcaaaucugucgccccaucuucuccaggcucuauggggggccuggugucccugggggcagcaguuguggcacucaagcccgccagggggaccccagcaccggccccaucauugaggagguugauuga

SEQ ID NO: 171 - RNA, 1104 nt, Artificial Sequence
  derived and/or modified CDS sequence (wt) from Homo sapiens__P48741__HsHSPA7
augcaggccccacgggagcucgcggugggcaucgaccugggcaccaccuacucgugcgugggcguguuucagcagggccgcguggagauccuggccaacgaccagggcaaccgcaccacgcccagcuacguggccuucaccgacaccgagcggcuggucggggacgcggccaagagccaggcggcccugaacccccacaacaccguguucgaugccaagcggcugaucgggcgcaaguucgcggacaccacggugcagucggacaugaagcacuggcccuuccagguggugagcgagggcggcaagcccaaggugcgcguaugcuaccgcggggaggacaagacguucuaccccgaggagaucucguccauggugcugagcaagaugaaggagacggccgaggcguaccugggccagcccgugaagcacgcagugaucaccgugcccaccuauuucaguaacucgcagcgccaggccaccaaggacgcgggggccaucgcggggcucaaggugcugccgaucaucaaugaggccacggcagcagccaucgccuaugggcuggaccggcggggcgcgggaaagcgcaacgugcucauuuuugaccugggugggggcaccuucgaugugucgguucucuccauugacgccggugucuuugaggugaaagccacugcuggagauacccaccugggaggagaggacuucgacaaccggcucgugaaccacuucauggaagaauuccggcggaagcaugggaaggaccugagcgggaacaagcgugcccugcgcaggcugcgcacagccugugagcgcgccaagcgcaccccguccuccagcacccaggccacccuggagauagacucccuguucgagggcguggacuucuacaaguccaucacucgugcccgcuuugaggaacugugcucagaccucuuccgcagcacccuggagccgguggagaaggcccugcgggaugccaagcuggacaaggcccagauucaugacuucguccuggggggagggcuccacucgcauccccaaggugcagaaguugcugcaggacuucuucaacggcaaggagcugaacaagagcaucaacccuga

SEQ ID NO: 172 - RNA, 1941 nt, Artificial Sequence
  derived and/or modified CDS sequence (wt) from Homo sapiens__NP_006588.1 __HsHSPA8
auguccaagggaccugcaguugguauugaucuuggcaccaccuacucuuguguggguguuuuccagcacggaaaagucgagauaauugccaaugaucagggaaaccgaaccacuccaagcuaugucgccuuuacggacacugaacgguugaucggugaugccgcaaagaaucaaguugcaaugaaccccaccaacacaguuuuugaugccaaacgucugauuggacgcagauuugaugaugcuguuguccagucugauaugaaacauuggcccuuuaugguggugaaugaugcuggcaggcccaagguccaaguagaauacaagggagagaccaaaagcuucuauccagaggaggugucuucuaugguucugacaaagaugaaggaaauugcagaagccuaccuugggaagacuguuaccaaugcuguggucacagugccagcuuacuuuaaugacucucagcgucaggcuaccaaagaugcuggaacuauugcuggucucaauguacuuagaauuauuaaugagccaacugcugcugcuauugcuuacggcuuagacaaaaagguuggagcagaaagaaacgugcucaucuuugaccugggagguggcacuuuugaugugucaauccucacuauugaggauggaaucuuugaggucaagucuacagcuggagacacccacuuggguggagaagauuuugacaaccgaauggucaaccauuuuauugcugaguuuaagcgcaagcauaagaaggacaucagugagaacaagagagcuguaagacgccuccguacugcuugugaacgugcuaagcguacccucucuuccagcacccaggccaguauugagaucgauucucucuaugaaggaaucgacuucuauaccuccauuacccgugcccgauuugaagaacugaaugcugaccuguuccguggcacccuggacccaguagagaaagcccuucgagaugccaaacuagacaagucacagauucaugauauuguccugguuggugguucuacucguauccccaagauucagaagcuucuccaagacuucuucaauggaaaagaacugaauaagagcaucaacccugaugaagcuguugcuuauggugcagcuguccaggcagccaucuugucuggagacaagucugagaauguucaagauuugcugcucuuggaugucacuccucuuucccuugguauugaaacugcugguggagucaugacuguccucaucaagcguaauaccaccauuccuaccaagcagacacagaccuucacuaccuauucugacaaccagccuggugugcuuauucagguuuaugaaggcgagcgugccaugacaaaggauaacaaccugcuuggcaaguuugaacucacaggcauaccuccugcaccccgagguguuccucagauugaagucacuuuugacauugaugccaaugguauacucaaugucucugcuguggacaagaguacgggaaaagagaacaagauuacuaucacuaaugacaagggccguuugagcaaggaagacauugaacguaugguccaggaagcugagaaguacaaagcugaagaugagaagcagagggacaaggugucauccaagaauucacuugaguccuaugccuucaacaugaaagcaacuguugaagaugagaaacuucaaggcaagauuaacgaugaggacaaacagaagauucuggacaaguguaaugaaauuaucaacuggcuugauaagaaucagacugcugagaaggaagaauuugaacaucaacagaaagagcuggagaaaguuugcaaccccaucaucaccaagcuguaccagagugcaggaggcaugccaggaggaaugccugggggauuuccuggugguggagcuccucccucugguggugcuuccucagggcccaccauugaagagguugauuaa

SEQ ID NO: 173 - RNA, 2040 nt, Artificial Sequence
  derived and/or modified CDS sequence (wt) from Homo sapiens__NP_004125.3 __HsHSPA9
augauaagugccagccgagcugcagcagcccgucucgugggcgccgcagccucccggggcccuacggccgcccgccaccaggauagcuggaauggccuuagucaugaggcuuuuagacuuguuucaaggcgggauuaugcaucagaagcaaucaagggagcaguuguugguauugauuuggguacuaccaacuccugcguggcaguuauggaagguaaacaagcaaaggugcuggagaaugccgaaggugccagaaccaccccuucaguuguggccuuuacagcagauggugagcgacuuguuggaaugccggccaagcgacaggcugucaccaacccaaacaauacauuuuaugcuaccaagcgucucauuggccggcgauaugaugauccugaaguacagaaagacauuaaaaauguucccuuuaaaauuguccgugccuccaauggugaugccuggguugaggcucaugggaaauuguauucuccgagucagauuggagcauuuguguugaugaagaugaaagagacugcagaaaauuacuuggggcacacagcaaaaaaugcugugaucacagucccagcuuauuucaaugacucgcagagacaggccacuaaagaugcuggccagauaucuggacugaaugugcuucgggugauuaaugagcccacagcugcugcucuugccuauggucuagacaaaucagaagacaaagucauugcuguauaugauuuaggugguggaacuuuugauauuucuauccuggaaauucagaaaggaguauuugaggugaaauccacaaauggggauaccuucuuagguggggaagacuuugaccaggccuugcuacggcacauugugaaggaguucaagagagagacagggguugauuugacuaaagacaacauggcacuucagaggguacgggaagcugcugaaaaggcuaaaugugaacucuccucaucugugcagacugacaucaauuugcccuaucuuacaauggauucuucuggacccaagcauuugaauaugaaguugacccgugcucaauuugaagggauugucacugaucuaaucagaaggacuaucgcuccaugccaaaaagcuaugcaagaugcagaagucagcaagagugacauaggagaagugauucuuguggguggcaugacuaggaugcccaagguucagcagacuguacaggaucuuuuuggcagagccccaaguaaagcugucaauccugaugaggcuguggccauuggagcugccauucagggagguguguuggccggcgaugucacggaugugcugcuccuugaugucacuccccugucucuggguauugaaacucuaggaggugucuuuaccaaacuuauuaauaggaauaccacuauuccaaccaagaagagccagguauucucuacugccgcugauggucaaacgcaaguggaaauuaaagugugucagggugaaagagagauggcuggagacaacaaacuccuuggacaguuuacuuugauuggaauuccaccagccccucguggaguuccucagauugaaguuacauuugacauugaugccaaugggauaguacauguuucugcuaaagauaaaggcacaggacgugagcagcagauuguaauccagucuucugguggauuaagcaaagaugauauugaaaauaugguuaaaaaugcagagaaauaugcugaagaagaccggcgaaagaaggaacgaguugaagcaguuaauauggcugaaggaaucauucacgacacagaaaccaagauggaagaauucaaggaccaauuaccugcugaugagugcaacaagcugaaagaagagauuuccaaaaugagggagcuccuggcuagaaaagacagcgaaacaggagaaaauauuagacaggcagcauccucucuucagcaggcaucacugaagcuguucgaaauggcauacaaaaagauggcaucugagcgagaaggcucuggaaguucuggcacuggggaacaaaaggaagaucaaaaggaggaaaaacaguaa

SEQ ID NO: 174 - RNA, 2028 nt, Artificial Sequence
  derived and/or modified CDS sequence (wt) from Homo sapiens__NP_079291.2__HsHSPA12A
auggcggacaaggaggccggcggcagcgacgggccccgagaaacggcucccacaucugcauauucaucuccagcccggagucuuggggacacaggaauaacgccucugucccccucccauauugugaacgacacugacuccaacgucucagaacagcagucauuucucguggugguggccgucgacuuugggaccacauccaguggcuaugccuacagcuucaccaaggagccggaaugcauccaugugaugaggcgaugggagggaggugacccugguguguccaaucagaagacuccaaccaccaucuugcugacucccgagaggaaguuccacagcuucggguaugccgccagggacuuuuaccaugaccuggaucccaaugaggccaagcaguggcuguaccuggagaaguucaagaugaagcugcacaccacuggggaccucaccauggauacagaccugacggcagcaaauggcaagaaagucaaagcccuugaaaucuuugcuuaugcccugcaguacuuuaaggagcaggcgcugaaggagcugagugaccaggcggguucggaguucgagaacucugaugucagaugggucaucacggugccugccaucuggaagcagccggccaagcaguucaugagacaagcugccuaccaggcaggccuggccucccccgagaacucggagcagcucaucauugccuuggagccugaggcagccucuaucuacugccgaaagcugcggcuacaccagaugauugagcugagcagcaaggcagccgucaauggguacagcggcagugacacaguaggagcuggguuuacacaggcuaaggaacacauacggcguaaucggcagagucggaccuuuuugguggagaaugucauaggagaaaucugguccgagcuggaggaaggugauaaguaugugguuguggacaguggcgguggcaccguagaccugacaguccaucagauccgguuaccggagggacaccuuaaggaacuguauaaagcaacaggcggacccuauggaucuuuaggaguagauuaugaguucgaaaaacuucuguauaaaauauuuggagaggauuuuauugaacaauucaaaaucaaacgcccugcagccuggguugacuuaaugauugcguuugagucucgcaaaagggcggcugccccagacagaacuaacccgcugaacaucacccugcccuucuccuucauugacuacuacaagaaguuccgcgggcacaguguggagcacgccuugcggaaaagcaauguggauuuugugaagugguccucgcaggggaugcugcggaugaguccagaugccaugaacgcccuuuuuaagccgaccaucgauagcaucauugagcaucuccgggaccuguuucagaagcccgagguguccaccgucaaguuccucuuucuggugggcggcuuugccgaggcgccccugcugcagcaggcggugcaggcugcuuuuggggaccagugccggaucaucaucccccaggacgugggccucaccauccucaagggugccguccucuuuggccuggaccccgcggucaucaaggugcgccggucgccgcucaccuacgggguaggcgugcugaaccgcuacguggagggcaagcacccgccugagaagcugcuggugaaggauggcacucgguggugcaccgacgucuuugacaaguucaucucugccgaccagucuguggcucugggugagcuggucaagcguagcuacaccccggccaagcccucccagcuggucauugucaucaacaucuacagcucugagcacgacaacgucagcuucaucacugaucccggggugaagaaguguggcacgcuccgccuggaucucacagggaccaguggcacugcggugcccgcccggagggagauccagacccuuaugcaguucggggacaccgagaucaaagccacagccauugauauagccacuucgaagagugucaaaguugggaucgacuucuuaaauuacuaa

SEQ ID NO: 175 - RNA, 2061 nt, Artificial Sequence
  derived and/or modified CDS sequence (wt) from Homo sapiens__NP_443202.3 __HsHSPA12B
auguuggcugucccggagaugggccugcaggggcuguacaucggcuccagcccggagcgguccccagugccuagcccacccggcuccccgaggacccaggaaagcugcggcauugccccccucacacccucgcagucuccaaaacccgagguccgagccccccagcaggccuccuucucuguggugguggccauugacuucggcaccacgucuaguggcuaugcuuucagcuuugccagugacccugaggccauccacaugaugaggaaaugggagggcggagacccgggcguggcccaccagaagaccccgaccugccugcugcugacuccggagggcgccuuccacagcuuuggcuacaccgcccgcgauuacuaccaugaccuggaccccgaagaggcgcgggacuggcucuacuucgagaaguucaagaugaagauccacagcgccacggaucucaccuugaagacccagcuagaggcaguaaauggaaagacgaugcccgcccuggagguguucgcccaugcccugcgcuucuucagggagcacgcccuucaggagcugagggagcagagcccaucgcugccagagaaggacacugugcgcuggguguugacggugccugccaucuggaaacagccagccaagcaguucaugcgggaggcugccuaccuggcuggacuagugucccgagagaaugcagagcagcuacucaucgcccuggagcccgaggccgccucgguauacugccgcaagcugcgccugcaccagcuccuggaccugaguggccgggccccagguggugggcgccugggugagcgccgcuccaucgacuccagcuuccgucaggcucgggagcagcugcgaaggucccgccacagccgcacguuccugguggagucaggcguaggagagcugugggcagagaugcaagcaggagaccgcuacgugguggccgacugcggcggaggcaccguggaccugacggugcaccagcuggagcagccccauggcacccucaaggagcucuacaaggcaucugggggcccuuauggcgcggugggcguggaccuggccuucgagcagcugcugugccgcaucuucggcgaggacuucaucgccaccuucaaaaggcaacggccggcagccuggguagaucugaccaucgccuucgaggcucgcaagcgcacugcuggcccacaccgugcaggggcgcucaacaucucgcugcccuucuccuucauugacuucuaccgcaagcagcggggccacaacguggagaccgcucugcgcaggagcagcgugaacuucgugaagugguccucacaggggaugcuccgaaugucuugugaagccaugaacgagcucuuucagcccaccgucagcgggaucauccagcacauagaggcccugcuggcacggccggaggugcagggugugaagcugcuguuccuagugggcggcuucgccgagucagcggugcugcagcacgcggugcaggcggcgcugggcgcccgcggucugcgugucguggucccgcacgacgugggccucaccauccucaaaggcgcggugcuguucggccaggcgccgggcguggugcggguccgccgcucgccgcucaccuauggcgugggcgugcucaaccgcuuugugccugggcgccacccgcccgaaaagcugcugguucgcgacggccgccgcuggugcaccgacgucuucgagcgcuucguggccgccgagcagucgguggcccugggcgaggaggugcggcgcagcuacugcccggcgcgucccggccagcggcgcguacucaucaaccuguacugcugcgcggcagaggaugcgcgcuucaucaccgaccccggcgugcgcaaaugcggcgcgcucagccucgagcuugagcccgccgacugcggccaggacaccgccggcgcgccucccggccgccgcgagauccgcgccgccaugcaguuuggcgacaccgaaauuaaggucaccgccgucgacgucagcaccaaucgcuccgugcgcgcguccaucgacuuucuuuccaacuga

SEQ ID NO: 176 - RNA, 1416 nt, Artificial Sequence
  derived and/or modified CDS sequence (wt) from Homo sapiens__NP_008879.3__HsHSPA13
auggccagagagaugacgaucuuaggaucggcuguuuugacucuccuguuggccggcuauuuggcacaacaguauuuaccauugccuacuccuaaagugauugguauugaucuuggcaccaccuauuguucuguugggguguuuuuuccuggcacaggaaaaguaaaggugauuccagaugaaaaugggcauaucagcauacccagcauggugucuuuuacugacaaugauguauaugugggauaugaaagcguagagcuggcagauucaaauccucaaaacacaauauaugaugccaaaagauucauaggcaagauuuuuaccgcagaagaguuggaggcugaaauuggcagauacccauuuaagguuuuaaacaaaaauggaaugguugaguuuucugugacaaguaaugagaccaucacaguguccccagaauauguuggcucucgacuauuguugaaguuaaaggaaauggcagaggcauaucuuggaaugccaguugccaaugcugucauuucuguaccagcagaauuugaucuaaaacagagaaauucaacaauugaagcugcuaaccuugcaggacugaagauuuugaggguaauaaaugaacccacagcagcagcuauggccuauggucuccacaaggcugacgucuuccacgucuuggugauagacuugggcggaggaacucuagaugugucuuuacugaauaaacaaggagggauguuucuaacccgagcaaugucuggaaacaauaaacuuggaggacaggacuucaaucagagauugcuucaguacuuauauaaacagaucuaucaaacauauggcuucgugcccucuaggaaagaggaaauccacagauugagacaagcuguggaaauggucaaauuaaaucugacucuucaucaaucugcucaguugucaguauuacuaacgguggaggagcaggacaggaaggaaccucacaguagugacacugaacugccaaaagacaaacuuuccucagcagaugaccaucgcgugaacaguggguuuggacguggccuuucugauaagaaaaguggagaaagucagguuuuauuugaaacagaaauaucacggaaacucuuugauacccuuaaugaagaccucuuucagaaaauacugguacccauucagcaaguauugaaagaaggccaccuggaaaagacugagauugaugaggugguuuuaguugggggcuccacucguauuccucggauccgucaagucauucaagaguucuuuggaaaagaucccaacacaucuguagacccugaccuagcaguaguaacgggaguggcuauccaagcagggauugauggaggcucuuggccucuccaagucagugcuuuagaaauucccaauaagcauuuacaaaaaaccaacuucaacuga

SEQ ID NO: 177 - RNA, 1530 nt, Artificial Sequence
  derived and/or modified CDS sequence (wt) from Homo sapiens__NP_057383.2__HsHSPA14
auggcggccaucggaguucaccugggcugcaccucagccuguguggccgucuauaaggauggccgggcuggugugguugcaaaugaugccggugaccgaguuacuccagcuguuguugcuuacucagaaaaugaagagauuguuggauuggcagcaaaacaaaguagaauaagaaauauuucaaauacaguaaugaaaguaaagcagauccugggcagaagcuccagugauccacaagcucagaaauacaucgcggaaaguaaauguuuagucauugaaaaaaaugggaaauuacgauaugaaauagauacuggagaagaaacaaaauuuguuaacccagaagauguugccagacugauauuuaguaaaaugaaagaaacggcacauucuguauugggcucagaugcaaaugauguaguuauuacugucccguuugauuuuggagaaaagcaaaaaaaugcucuuggagaagcagcuagagcugcuggauuuaauguuuugcgauuaauucacgaaccgucugcagcucuucuugcuuauggaauuggacaagacuccccuacuggaaaaagcaauauuuugguguuuaagcuuggaggaacauccuuaucucucagcgucauggaaguuaacaguggaauauaucggguucuuucaacaaacacugaugauaacaucgguggugcacauuucacagaaaccuuagcacaguaucuagcuucugaguuccaaagauccuucaaacaugaugugagaggaaaugcgcgagccaugaugaaauuaacgaacagugcugaaguagcgaaacauucuuugucaaccuugggaagugccaacuguuuucuugacucauuauaugaaggucaagauuuugauugcaauguguccagagcaagauuugaacuucuuuguucuccacuuuuuaauaaguguauagaagcaaucagaggacucuuagaucaaaauggauuuacagcagaugauaucaacaagguuguccuuuguggagggucuucucgaaucccaaagcuacagcaacugauuaaagaucuuuucccagcuguugagcuucucaauucuaucccuccugaugaagugaucccuauuggugcagcuauagaagcaggaauucuuauugggaaagaaaaccuguugguggaagacucucuuaugauagaguguucagccagagauauuuuaguuaaggguguggacgaaucaggagccaguagauucacagugcuguuuccaucagggacuccuuugccagcucgaagacaacacacauugcaagccccuggaagcauaucuucagugugccuugaacucuaugagucugaugggaagaacucugccaaagaggaaaccaaguuugcacagguuguacuccaggauuuagauaaaaaagaaaauggauuacgugauauauuagcuguucuuacuaugaaaagggauggaucuuuacaugugacaugcacagaucaagaaacuggaaaaugugaagcaaucucuauugagauagcaucuuag

SEQ ID NO: 178 - RNA, 2577 nt, Artificial Sequence
  derived and/or modified CDS sequence (wt) from Homo sapiens__NP_006635.2 __HsHSPH1
augucgguggugggguuggacgugggcucgcagagcugcuacaucgcgguagcccgggccgggggcaucgagaccaucgccaaugaguucagcgaccggugcaccccgucagucauaucauuuggaucaaaaaauagaacaaucggaguugcagccaaaaaucagcaaaucacucaugcaaacaauacggugucuaacuucaaaagauuucauggccgagcauucaaugaccccuucauucaaaaggagaaggaaaacuugaguuacgauuugguuccauugaaaaaugguggaguuggaauaaagguaauguacaugggugaagaacaucuauuuaguguggagcagauaacagccauguuguugacuaagcugaaggaaacugcugaaaacagccucaagaaaccaguaacagauuguguuauuucaguccccuccuucuuuacagaugcugagaggcgaucuguguuagaugcugcacagauuguuggccuaaacuguuuaagacuuaugaaugacaugacagcuguugcuuugaauuacggaauuuauaagcaggaucucccaagccuggaugagaaaccucggauagugguuuuuguugauaugggacauucagcuuuucaagugucugcuugugcuuuuaacaagggaaaauugaagguacugggaacagcuuuugauccuuucuuaggaggaaaaaacuucgaugaaaaguuaguggaacauuuuugugcagaauuuaaaacuaaguacaaguuggaugcaaaauccaaaauacgagcacuccuacgucuguaucaggaaugugaaaaacugaaaaagcuaaugagcucuaacagcacagaccuuccacugaauaucgaaugcuuuaugaaugauaaagauguuuccggaaagaugaacaggucacaauuugaagaacucugugcugaacuucugcaaaagauagaaguaccccuuuauucacuguuggaacaaacucaucucaaaguagaagaugugagugcaguugagauuguuggaggcgcuacacgaauuccagcugugaaggaaagaauugccaaauucuuuggaaaagauauuagcacaacacucaaugcagaugaagcaguagccagaggaugugcauuacagugugcaauacuuuccccggcauuuaaaguuagagaauuuuccgucacagaugcaguuccuuuuccaauaucucugaucuggaaccaugauucagaagauacugaagguguucaugaagucuuuagucgaaaccaugcugcuccuuucuccaaaguucucaccuuucugagaagggggccuuuugagcuagaagcuuucuauucugauccccaaggaguuccauauccagaagcaaaaauaggccgcuuuguaguucagaauguuucugcacagaaagauggagaaaaaucuagaguaaaagucaaagugcgagucaacacccauggcauuuucaccaucucuacggcaucuaugguggagaaagucccaacugaggagaaugaaaugucuucugaagcugacauggagugucugaaucagagaccaccagaaaacccagacacugauaaaaauguccagcaagacaacagugaagcuggaacacagccccagguacaaacugaugcucaacaaaccucacagucucccccuucaccugaacuuaccucagaagaaaacaaaaucccagaugcugacaaagcaaaugaaaaaaaaguugaccagccuccagaagcuaaaaagcccaaaauaaagguggugaauguugagcugccuauugaagccaacuuggucuggcaguuagggaaagaccuucuuaacauguauauugagacagaggguaagaugauaaugcaagauaaauuggaaaaagaaaggaaugaugcuaaaaaugcaguugaggaauauguguaugaguucagagacaagcuguguggaccauaugaaaaauuuauaugugagcaggaucaucaaaauuuuuugagacuccucacagaaacugaagacuggcuguaugaagaaggagaggaccaagcuaaacaagcauauguugacaaguuggaagaauuaaugaaaauuggcacuccaguuaaaguucgguuucaggaagcugaagaacggccaaaaauguuugaagaacuaggacagaggcugcagcauuaugccaagauagcagcugacuucagaaauaaggaugagaaauacaaccauauugaugagucugaaaugaaaaaaguggagaagucuguuaaugaagugauggaauggaugaauaaugucaugaaugcucaggcuaaaaagagucuugaucaggauccaguuguacgugcucaggaaauuaaaacaaaaaucaaggaauugaacaacacaugugaacccguuguaacacaaccgaaaccaaaaauugaaucacccaaacuggaaagaacuccaaauggcccaaauauugauaaaaaggaagaagauuuagaagacaaaaacaauuuuggugcugaaccuccacaucagaauggugaauguuacccuaaugagaaaaauucuguuaauauggacuuggacuag

SEQ ID NO: 179 - RNA, 3000 nt, Artificial Sequence
  derived and/or modified CDS sequence (wt) from Homo sapiens__NP_006380.1 __HsHYOU1
auggcagacaaaguuaggaggcagaggccgaggaggcgagucuguugggccuugguggcugugcucuuggcagaccuguuggcacugagugauacacuggcagugaugucuguggaccugggcagugaguccaugaagguggccauugucaaaccuggagugcccauggaaauugucuugaauaaggaaucucggaggaaaacaccggugaucgugacccugaaagaaaaugaaagauucuuuggagacagugcagcaagcauggcgauuaagaauccaaaggcuacgcuacguuacuuccagcaccuccuggggaagcaggcagauaacccccauguagcucuuuaccaggcccgcuucccggagcacgagcugacuuucgacccacagaggcagacugugcacuuucagaucagcucgcagcugcaguucucaccugaggaaguguugggcaugguucucaauuauucucguucucuagcugaagauuuugcagagcagcccaucaaggaugcagugaucaccgugccagucuucuucaaccaggccgagcgccgagcugugcugcaggcugcucguauggcuggccucaaagugcugcagcucaucaaugacaacaccgccacugcccucagcuauggugucuuccgccggaaagauauuaacaccacugcccagaauaucauguucuaugacaugggcucaggcagcaccguaugcaccauugugaccuaccagauggugaagacuaaggaagcugggaugcagccacagcugcagauccggggaguaggauuugaccguacccuggggggccuggagauggagcuccggcuucgagaacgccuggcugggcuuuucaaugagcagcgcaagggucagagagcaaaggaugugcgggagaacccgcgugccauggccaagcugcugcgugaggcuaaucggcucaaaaccguccucagugccaacgcugaccacauggcacagauugaaggccugauggaugauguggacuucaaggcaaaagugacucguguggaauuugaggaguugugugcagacuuguuugagcgggugccugggccuguacagcaggcccuccagagugccgaaaugagucuggaugagauugagcaggugauccugguggguggggccacucggguccccagaguucaggaggugcugcugaaggccgugggcaaggaggagcuggggaagaacaucaaugcagaugaagcagccgccaugggggcaguguaccaggcagcugcgcucagcaaagccuuuaaagugaagccauuugucguccgagaugcaguggucuaccccauccugguggaguucacgagggagguggaggaggagccugggauucacagccugaagcacaauaaacggguacucuucucucggauggggcccuacccucaacgcaaagucaucaccuuuaaccgcuacagccaugauuucaacuuccacaucaacuacggcgaccugggcuuccuggggccugaagaucuucggguauuuggcucccagaaucugaccacagugaagcuaaaaggggugggugacagcuucaagaaguauccugacuacgaguccaagggcaucaaggcucacuucaaccuggaugagaguggcgugcucagucuagacaggguggagucuguauuugagacacugguagaggacagcgcagaagaggaaucuacucucaccaaacuuggcaacaccauuuccagccuguuuggaggcgguaccacaccagaugccaaggagaaugguacugauacuguccaggaggaagaggagagcccugcagaggggagcaaggacgagccuggggagcagguggagcucaaggaggaagcugaggccccaguggaggauggcucucagcccccacccccugaaccuaagggagaugcaaccccugagggagaaaaggccacagaaaaagaaaauggggacaagucugaggcccagaaaccaagugagaaggcagaggcagggccugagggcgucgcuccagccccagagggagagaagaagcagaagcccgccaggaagcggcgaaugguagaggagaucgggguggagcugguuguucuggaccugccugacuugccagaggauaagcuggcucagucggugcagaaacuucaggacuugacacuccgagaccuggagaagcaggaacgggaaaaagcugccaacagcuuggaagcauucauauuugagacccaggacaagcuguaccagcccgaguaccaggaaguguccacagaggagcagcgugaggagaucucugggaagcucagcgccgcauccaccuggcuggaggaugaggguguuggagccaccacagugauguugaaggagaagcuggcugagcugaggaagcugugccaagggcuguuuuuucggguagaggagcgcaagaaguggcccgaacggcugucugcccucgauaaucuccucaaccauuccagcauguuccucaagggggcccggcucaucccagagauggaccagaucuucacugagguggagaugacaacguuagagaaagucaucaaugagaccugggccuggaagaaugcaacucuggccgagcaggcuaagcugcccgccacagagaagccuguguugcucucaaaagacauugaagcuaagaugauggcccuggaccgagaggugcaguaucugcucaauaaggccaaguuuaccaagccccggccccggccuaaggacaagaaugggacccgggcagagccaccccucaaugccagugccagugaccagggggagaaggucaucccuccagcaggccagacugaagaugcagagcccauuucagaaccugagaaaguagagacuggauccgagccaggagacacugagccuuuggaguuaggagguccuggagcagaaccugaacagaaagaacaaucgacaggacagaagcggccuuugaagaacgacgaacuauaa

SEQ ID NO: 180 - RNA, 2199 nt, Artificial Sequence
  derived and/or modified CDS sequence (wt) from Homo sapiens__NP_005339.3 __HsHSP90AA1
augccugaggaaacccagacccaagaccaaccgauggaggaggaggagguugagacguucgccuuucaggcagaaauugcccaguugaugucauugaucaucaauacuuucuacucgaacaaagagaucuuucugagagagcucauuucaaauucaucagaugcauuggacaaaauccgguaugaaagcuugacagaucccaguaaauuagacucugggaaagagcugcauauuaaccuuauaccgaacaaacaagaucgaacucucacuauuguggauacuggaauuggaaugaccaaggcugacuugaucaauaaccuugguacuaucgccaagucugggaccaaagcguucauggaagcuuugcaggcuggugcagauaucucuaugauuggccaguucgguguugguuuuuauucugcuuauuugguugcugagaaaguaacugugaucaccaaacauaacgaugaugagcaguacgcuugggaguccucagcagggggaucauucacagugaggacagacacaggugaaccuaugggucguggaacaaaaguuauccuacaccugaaagaagaccaaacugaguacuuggaggaacgaagaauaaaggagauugugaagaaacauucucaguuuauuggauaucccauuacucuuuuuguggagaaggaacgugauaaagaaguaagcgaugaugaggcugaagaaaaggaagacaaagaagaagaaaaagaaaaagaagagaaagagucggaagacaaaccugaaauugaagauguugguucugaugaggaagaagaaaagaaggauggugacaagaagaagaagaagaagauuaaggaaaaguacaucgaucaagaagagcucaacaaaacaaagcccaucuggaccagaaaucccgacgauauuacuaaugaggaguacggagaauucuauaagagcuugaccaaugacugggaagaucacuuggcagugaagcauuuuucaguugaaggacaguuggaauucagagcccuucuauuugucccacgacgugcuccuuuugaucuguuugaaaacagaaagaaaaagaacaacaucaaauuguauguacgcagaguuuucaucauggauaacugugaggagcuaaucccugaauaucugaacuucauuagaggggugguagacucggaggaucucccucuaaacauaucccgugagauguugcaacaaagcaaaauuuugaaaguuaucaggaagaauuuggucaaaaaaugcuuagaacucuuuacugaacuggcggaagauaaagagaacuacaagaaauucuaugagcaguucucuaaaaacauaaagcuuggaauacacgaagacucucaaaaucggaagaagcuuucagagcuguuaagguacuacacaucugccucuggugaugagaugguuucucucaaggacuacugcaccagaaugaaggagaaccagaaacauaucuauuauaucacaggugagaccaaggaccagguagcuaacucagccuuuguggaacgucuucggaaacauggcuuagaagugaucuauaugauugagcccauugaugaguacuguguccaacagcugaaggaauuugaggggaagacuuuagugucagucaccaaagaaggccuggaacuuccagaggaugaagaagagaaaaagaagcaggaagagaaaaaaacaaaguuugagaaccucugcaaaaucaugaaagacauauuggagaaaaaaguugaaaaggugguugugucaaaccgauuggugacaucuccaugcuguauugucacaagcacauauggcuggacagcaaacauggagagaaucaugaaagcucaagcccuaagagacaacucaacaauggguuacauggcagcaaagaaacaccuggagauaaacccugaccauuccauuauugagaccuuaaggcaaaaggcagaggcugauaagaacgacaagucugugaaggaucuggucaucuugcuuuaugaaacugcgcuccugucuucuggcuucagucuggaagauccccagacacaugcuaacaggaucuacaggaugaucaaacuuggucuggguauugaugaagaugacccuacugcugaugauaccagugcugcuguaacugaagaaaugccaccccuugaaggagaugacgacacaucacgcauggaagaaguagacuaa

SEQ ID NO: 181 - RNA, 339 nt, Artificial Sequence
  derived and/or modified CDS sequence (wt) from Homo sapiens__NG_005218__HsHSP90AA3P
auggauuccaguaaauuagacucugggaaagggcugcauauuaaccuuguaccaaacaaacaaaaucaaacccucacuauuguggacacuagaauuggaaugaccaagacugacuugaucaauaaccucgguacugucaccaagucugggaccaaagcauucauggaagcuuugcaggcugaugcagauaucucuaugauuggccauuucgggguugguuuuuauucugcuuauuugguugccaagaaaguaacugugaucagcaaacauaacaaugaugagcaguacaccugggaguccucagcagggggaucauucacagugaggacagacgaguga

SEQ ID NO: 182 - RNA, 2175 nt, Artificial Sequence
  derived and/or modified CDS sequence (wt) from Homo sapiens__NP_031381.2__HsHSP90AB1
augccugaggaagugcaccauggagaggaggagguggagacuuuugccuuucaggcagaaauugcccaacucaugucccucaucaucaauaccuucuauuccaacaaggagauuuuccuucgggaguugaucucuaaugcuucugaugccuuggacaagauucgcuaugagagccugacagacccuucgaaguuggacagugguaaagagcugaaaauugacaucauccccaacccucaggaacguacccugacuuugguagacacaggcauuggcaugaccaaagcugaucucauaaauaauuugggaaccauugccaagucugguacuaaagcauucauggaggcucuucaggcuggugcagacaucuccaugauugggcaguuugguguuggcuuuuauucugccuacuugguggcagagaaagugguugugaucacaaagcacaacgaugaugaacaguaugcuugggagucuucugcuggagguuccuucacugugcgugcugaccauggugagcccauuggcagggguaccaaagugauccuccaucuuaaagaagaucagacagaguaccuagaagagaggcgggucaaagaaguagugaagaagcauucucaguucauaggcuaucccaucacccuuuauuuggagaaggaacgagagaaggaaauuagugaugaugaggcagaggaagagaaaggugagaaagaagaggaagauaaagaugaugaagaaaaacccaagaucgaagauguggguucagaugaggaggaugacagcgguaaggauaagaagaagaaaacuaagaagaucaaagagaaauacauugaucaggaagaacuaaacaagaccaagccuauuuggaccagaaacccugaugacaucacccaagaggaguauggagaauucuacaagagccucacuaaugacugggaagaccacuuggcagucaagcacuuuucuguagaaggucaguuggaauucagggcauugcuauuuauuccucgucgggcucccuuugaccuuuuugagaacaagaagaaaaagaacaacaucaaacucuauguccgccguguguucaucauggacagcugugaugaguugauaccagaguaucucaauuuuauccguggugugguugacucugaggaucugccccugaacaucucccgagaaaugcuccagcagagcaaaaucuugaaagucauucgcaaaaacauuguuaagaagugccuugagcucuucucugagcuggcagaagacaaggagaauuacaagaaauucuaugaggcauucucuaaaaaucucaagcuuggaauccacgaagacuccacuaaccgccgccgccugucugagcugcugcgcuaucauaccucccagucuggagaugagaugacaucucugucagaguauguuucucgcaugaaggagacacagaaguccaucuauuacaucacuggugagagcaaagagcagguggccaacucagcuuuuguggagcgagugcggaaacggggcuucgaggugguauauaugaccgagcccauugacgaguacugugugcagcagcucaaggaauuugaugggaagagccuggucucaguuaccaaggagggucuggagcugccugaggaugaggaggagaagaagaagauggaagagagcaaggcaaaguuugagaaccucugcaagcucaugaaagaaaucuuagauaagaagguugagaaggugacaaucuccaauagacuugugucuucaccuugcugcauugugaccagcaccuacggcuggacagccaauauggagcggaucaugaaagcccaggcacuucgggacaacuccaccaugggcuauaugauggccaaaaagcaccuggagaucaacccugaccaccccauuguggagacgcugcggcagaaggcugaggccgacaagaaugauaaggcaguuaaggaccugguggugcugcuguuugaaaccgcccugcuaucuucuggcuuuucccuugaggauccccagacccacuccaaccgcaucuaucgcaugaucaagcuaggucuagguauugaugaagaugaaguggcagcagaggaacccaaugcugcaguuccugaugagauccccccucucgagggcgaugaggaugcgucucgcauggaagaagucgauuag

SEQ ID NO: 183 - RNA, 2412 nt, Artificial Sequence
  derived and/or modified CDS sequence (wt) from Homo sapiens__NP_003290.1__HsHSP90B1
augagggcccugugggugcugggccucugcugcguccugcugaccuucgggucggucagagcugacgaugaaguugauguggaugguacaguagaagaggaucuggguaaaaguagagaaggaucaaggacggaugaugaaguaguacagagagaggaagaagcuauucaguuggauggauuaaaugcaucacaaauaagagaacuuagagagaagucggaaaaguuugccuuccaagccgaaguuaacagaaugaugaaacuuaucaucaauucauuguauaaaaauaaagagauuuuccugagagaacugauuucaaaugcuucugaugcuuuagauaagauaaggcuaauaucacugacugaugaaaaugcucuuucuggaaaugaggaacuaacagucaaaauuaagugugauaaggagaagaaccugcugcaugucacagacaccgguguaggaaugaccagagaagaguugguuaaaaaccuugguaccauagccaaaucugggacaagcgaguuuuuaaacaaaaugacugaagcacaggaagauggccagucaacuucugaauugauuggccaguuuggugucgguuucuauuccgccuuccuuguagcagauaagguuauugucacuucaaaacacaacaacgauacccagcacaucugggagucugacuccaaugaauuuucuguaauugcugacccaagaggaaacacucuaggacggggaacgacaauuacccuugucuuaaaagaagaagcaucugauuaccuugaauuggauacaauuaaaaaucucgucaaaaaauauucacaguucauaaacuuuccuauuuauguauggagcagcaagacugaaacuguugaggagcccauggaggaagaagaagcagccaaagaagagaaagaagaaucugaugaugaagcugcaguagaggaagaagaagaagaaaagaaaccaaagacuaaaaaaguugaaaaaacugucugggacugggaacuuaugaaugauaucaaaccaauauggcagagaccaucaaaagaaguagaagaagaugaauacaaagcuuucuacaaaucauuuucaaaggaaagugaugaccccauggcuuauauucacuuuacugcugaaggggaaguuaccuucaaaucaauuuuauuuguacccacaucugcuccacguggucuguuugacgaauauggaucuaaaaagagcgauuacauuaagcucuaugugcgccguguauucaucacagacgacuuccaugauaugaugccuaaauaccucaauuuugucaagggugugguggacucagaugaucuccccuugaauguuucccgcgagacucuucagcaacauaaacugcuuaaggugauuaggaagaagcuuguucguaaaacgcuggacaugaucaagaagauugcugaugauaaauacaaugauacuuuuuggaaagaauuugguaccaacaucaagcuuggugugauugaagaccacucgaaucgaacacgucuugcuaaacuucuuagguuccagucuucucaucauccaacugacauuacuagccuagaccaguauguggaaagaaugaaggaaaaacaagacaaaaucuacuucauggcuggguccagcagaaaagaggcugaaucuucuccauuuguugagcgacuucugaaaaagggcuaugaaguuauuuaccucacagaaccuguggaugaauacuguauucaggcccuucccgaauuugaugggaagagguuccagaauguugccaaggaaggagugaaguucgaugaaagugagaaaacuaaggagagucgugaagcaguugagaaagaauuugagccucugcugaauuggaugaaagauaaagcccuuaaggacaagauugaaaaggcuguggugucucagcgccugacagaaucuccgugugcuuugguggccagccaguacggauggucuggcaacauggagagaaucaugaaagcacaagcguaccaaacgggcaaggacaucucuacaaauuacuaugcgagucagaagaaaacauuugaaauuaaucccagacacccgcugaucagagacaugcuucgacgaauuaaggaagaugaagaugauaaaacaguuuuggaucuugcugugguuuuguuugaaacagcaacgcuucggucaggguaucuuuuaccagacacuaaagcauauggagauagaauagaaagaaugcuucgccucaguuugaacauugacccugaugcaaagguggaagaagagcccgaagaagaaccugaagagacagcagaagacacaacagaagacacagagcaagacgaagaugaagaaauggaugugggaacagaugaagaagaagaaacagcaaaggaaucuacagcugaaaaagaugaauuguaa

SEQ ID NO: 184 - RNA, 2115 nt, Artificial Sequence
  derived and/or modified CDS sequence (wt) from Homo sapiens__NP_057376.2__HsTRAP1
auggcgcgcgagcugcgggcgcugcugcuguggggccgccgccugcggccuuugcugcgggcgccggcgcuggcggccgugccgggaggaaaaccaauucuguguccucggaggaccacagcccaguugggccccaggcgaaacccagccuggagcuugcaggcaggacgacuguucagcacgcagaccgccgaggacaaggaggaaccccugcacucgauuaucagcagcacagagagcgugcaggguuccacuuccaaacaugaguuccaggccgagacaaagaagcuuuuggacauuguugcccggucccuguacucagaaaaagagguguuuauacgggagcugaucuccaaugccagcgaugccuuggaaaaacugcgucacaaacuggugucugacggccaagcacugccagaaauggagauucacuugcagaccaaugccgagaaaggcaccaucaccauccaggauacugguaucgggaugacacaggaagagcugguguccaaccuggggacgauugccagaucggggucaaaggccuuccuggaugcucugcagaaccaggcugaggccagcagcaagaucaucggccaguuuggaguggguuucuacucagcuuucaugguggcugacagaguggaggucuauucccgcucggcagccccggggagccuggguuaccaguggcuuucagaugguucuggaguguuugaaaucgccgaagcuucgggaguuagaaccgggacaaaaaucaucauccaccugaaauccgacugcaaggaguuuuccagcgaggcccgggugcgagaugugguaacgaaguacagcaacuucgucagcuuccccuuguacuugaauggaaggcggaugaacaccuugcaggccaucuggaugauggaccccaaggauguccgugaguggcaacaugaggaguucuaccgcuacgucgcgcaggcucacgacaagccccgcuacacccugcacuauaagacggacgcaccgcucaacauccgcagcaucuucuacgugcccgacaugaaaccguccauguuugaugugagccgggagcugggcuccagcguugcacuguacagccgcaaaguccucauccagaccaaggccacggacauccugcccaaguggcugcgcuucauccgaggugugguggacagugaggacauuccccugaaccucagccgggagcugcugcaggagagcgcacucaucaggaaacuccgggacguuuuacagcagaggcugaucaaauucuucauugaccagaguaaaaaagaugcugagaaguaugcaaaguuuuuugaagauuacggccuguucaugcgggagggcauugugaccgccaccgagcaggaggucaaggaggacauagcaaagcugcugcgcuacgaguccucggcgcugcccuccgggcagcuaaccagccucucagaauacgccagccgcaugcgggccggcacccgcaacaucuacuaccugugcgcccccaaccgucaccuggcagagcacucacccuacuaugaggccaugaagaagaaagacacagagguucucuucugcuuugagcaguuugaugagcucacccugcugcaccuucgugaguuugacaagaagaagcugaucucuguggagacggacauagucguggaucacuacaaggaggagaaguuugaggacagguccccagccgccgagugccuaucagagaaggagacggaggagcucauggccuggaugagaaaugugcuggggucgcgugucaccaacgugaaggugacccuccgacuggacacccacccugccauggucaccgugcuggagaugggggcugcccgccacuuccugcgcaugcagcagcuggccaagacccaggaggagcgcgcacagcuccugcagcccacgcuggagaucaaccccaggcacgcgcucaucaagaagcugaaucagcugcgcgcaagcgagccuggccuggcucagcugcugguggaucagauauacgagaacgccaugauugcugcuggacuuguugacgacccuagggccauggugggccgcuugaaugagcugcuugucaaggcccuggagcgacacuga

SEQ ID NO: 185 - RNA, 462 nt, Artificial Sequence
  derived and/or modified CDS sequence (wt) from Homo sapiens__NP_000609.1__HsIGF1
augggaaaaaucagcagucuuccaacccaauuauuuaagugcugcuuuugugauuucuugaaggugaagaugcacaccauguccuccucgcaucucuucuaccuggcgcugugccugcucaccuucaccagcucugccacggcuggaccggagacgcucugcggggcugagcugguggaugcucuucaguucguguguggagacaggggcuuuuauuucaacaagcccacaggguauggcuccagcagucggagggcgccucagacaggcaucguggaugagugcugcuuccggagcugugaucuaaggaggcuggagauguauugcgcaccccucaagccugccaagucagcucgcucuguccgugcccagcgccacaccgacaugcccaagacccagaaggaaguacauuugaagaacgcaaguagagggagugcaggaaacaagaacuacaggauguag

SEQ ID NO: 186 - RNA, 543 nt, Artificial Sequence
  derived and/or modified CDS sequence (wt) from Homo sapiens__NP_000603.1__HsIGF2
augggaaucccaauggggaagucgaugcuggugcuucucaccuucuuggccuucgccucgugcugcauugcugcuuaccgccccagugagacccugugcggcggggagcugguggacacccuccaguucgucuguggggaccgcggcuucuacuucagcaggcccgcaagccgugugagccgucgcagccguggcaucguugaggagugcuguuuccgcagcugugaccuggcccuccuggagacguacugugcuacccccgccaaguccgagagggacgugucgaccccuccgaccgugcuuccggacaacuuccccagauaccccgugggcaaguucuuccaauaugacaccuggaagcaguccacccagcgccugcgcaggggccugccugcccuccugcgugcccgccggggucacgugcucgccaaggagcucgaggcguucagggaggccaaacgucaccguccccugauugcucuacccacccaagaccccgcccacgggggcgcccccccagagauggccagcaaucggaaguga

SEQ ID NO: 187 - RNA, 639 nt, Artificial Sequence
  derived and/or modified CDS sequence (wt) from Homo sapiens__NP_000591.1__HsIL6
augaacuccuucuccacaagcgccuucgguccaguugccuucucccuggggcugcuccugguguugccugcugccuucccugccccaguacccccaggagaagauuccaaagauguagccgccccacacagacagccacucaccucuucagaacgaauugacaaacaaauucgguacauccucgacggcaucucagcccugagaaaggagacauguaacaagaguaacaugugugaaagcagcaaagaggcacuggcagaaaacaaccugaaccuuccaaagauggcugaaaaagauggaugcuuccaaucuggauucaaugaggagacuugccuggugaaaaucaucacuggucuuuuggaguuugagguauaccuagaguaccuccagaacagauuugagaguagugaggaacaagccagagcugugcagaugaguacaaaaguccugauccaguuccugcagaaaaaggcaaagaaucuagaugcaauaaccaccccugacccaaccacaaaugccagccugcugacgaagcugcaggcacagaaccaguggcugcaggacaugacaacucaucucauucugcgcagcuuuaaggaguuccugcaguccagccugagggcucuucggcaaauguag

SEQ ID NO: 188 - RNA, 1281 nt, Artificial Sequence
  derived and/or modified CDS sequence (wt) from Homo sapiens__NP_002183.1__HsINHBA
augcccuugcuuuggcugagaggauuucuguuggcaaguugcuggauuauagugaggaguucccccaccccaggauccgaggggcacagcgcggcccccgacuguccguccugugcgcuggccgcccucccaaaggauguacccaacucucagccagagaugguggaggccgucaagaagcacauuuuaaacaugcugcacuugaagaagagacccgaugucacccagccgguacccaaggcggcgcuucugaacgcgaucagaaagcuucaugugggcaaagucggggagaacggguauguggagauagaggaugacauuggaaggagggcagaaaugaaugaacuuauggagcagaccucggagaucaucacguuugccgagucaggaacagccaggaagacgcugcacuucgagauuuccaaggaaggcagugaccugucagugguggagcgugcagaagucuggcucuuccuaaaaguccccaaggccaacaggaccaggaccaaagucaccauccgccucuuccagcagcagaagcacccgcagggcagcuuggacacaggggaagaggccgaggaagugggcuuaaagggggagaggagugaacuguugcucucugaaaaaguaguagacgcucggaagagcaccuggcaugucuucccugucuccagcagcauccagcgguugcuggaccagggcaagagcucccuggacguucggauugccugugagcagugccaggagaguggcgccagcuugguucuccugggcaagaagaagaagaaagaagaggagggggaagggaaaaagaagggcggaggugaagguggggcaggagcagaugaggaaaaggagcagucgcacagaccuuuccucaugcugcaggcccggcagucugaagaccacccucaucgccggcgucggcggggcuuggagugugauggcaaggucaacaucugcuguaagaaacaguucuuugucaguuucaaggacaucggcuggaaugacuggaucauugcucccucuggcuaucaugccaacuacugcgagggugagugcccgagccauauagcaggcacguccggguccucacuguccuuccacucaacagucaucaaccacuaccgcaugcggggccauagccccuuugccaaccucaaaucgugcugugugcccaccaagcugagacccauguccauguuguacuaugaugauggucaaaacaucaucaaaaaggacauucagaacaugaucguggaggagugugggugcucauag

SEQ ID NO: 189 - RNA, 1224 nt, Artificial Sequence
  derived and/or modified CDS sequence (wt) from Homo sapiens__NP_002184.2__HsINHBB
auggacgggcugcccggucgggcgcugggggccgccugccuucugcugcuggcggccggcuggcuggggccugaggccuggggcucacccacgcccccgccgacgccugccgcgccgccgccacccccgccacccggauccccggguggcucgcaggacaccuguacgucgugcggcggcuuccggcggccagaggagcucggccgaguggacggcgacuuccuggaggcggugaagcggcacaucuugagccgccugcagaugcggggccggcccaacaucacgcacgccgugccuaaggccgccauggucacggcccugcgcaagcugcacgcgggcaaggugcgcgaggacggccgcguggagaucccgcaccucgacggccacgccagcccgggcgccgacggccaggagcgcguuuccgaaaucaucagcuucgccgagacagauggccucgccuccucccggguccgccuauacuucuucaucuccaacgaaggcaaccagaaccuguuugugguccaggccagccuguggcuuuaccugaaacuccugcccuacguccuggagaagggcagccggcggaaggugcgggucaaaguguacuuccaggagcagggccacggugacagguggaacaugguggagaagaggguggaccucaagcgcagcggcuggcauaccuucccacucacggaggccauccaggccuuguuugagcggggcgagcggcgacucaaccuagacgugcagugugacagcugccaggagcuggccguggugccgguguucguggacccaggcgaagagucgcaccggcccuuugugguggugcaggcucggcugggcgacagcaggcaccgcauucgcaagcgaggccuggagugcgauggccggaccaaccucuguugcaggcaacaguucuucauugacuuccgccucaucggcuggaacgacuggaucauagcacccaccggcuacuacgggaacuacugugagggcagcugcccagccuaccuggcagggguccccggcucugccuccuccuuccacacggcuguggugaaccaguaccgcaugcggggucugaaccccggcacggugaacuccugcugcauucccaccaagcugagcaccauguccaugcuguacuucgaugaugaguacaacaucgucaagcgggacgugcccaacaugauuguggaggagugcggcugcgccuga

SEQ ID NO: 190 - RNA, 3459 nt, Artificial Sequence
  derived and/or modified CDS sequence (wt) from Homo sapiens__NP_000623.2__HsITGAM
auggcucucagaguccuucuguuaacagccuugaccuuaugucauggguucaacuuggacacugaaaacgcaaugaccuuccaagagaacgcaaggggcuucgggcagagcgugguccagcuucagggauccaggguggugguuggagccccccaggagauaguggcugccaaccaaaggggcagccucuaccagugcgacuacagcacaggcucaugcgagcccauccgccugcagguccccguggaggccgugaacaugucccugggccugucccuggcagccaccaccagccccccucagcugcuggccuguggucccaccgugcaccagacuugcagugagaacacguaugugaaagggcucugcuuccuguuuggauccaaccuacggcagcagccccagaaguucccagaggcccuccgaggguguccucaagaggauagugacauugccuucuugauugauggcucugguagcaucaucccacaugacuuucggcggaugaaggaguuugucucaacugugauggagcaauuaaaaaaguccaaaaccuuguucucuuugaugcaguacucugaagaauuccggauucacuuuaccuucaaagaguuccagaacaacccuaacccaagaucacuggugaagccaauaacgcagcugcuugggcggacacacacggccacgggcauccgcaaagugguacgagagcuguuuaacaucaccaacggagcccgaaagaaugccuuuaagauccuaguugucaucacggauggagaaaaguuuggcgaucccuugggauaugaggaugucaucccugaggcagacagagagggagucauucgcuacgucauuggggugggagaugccuuccgcagugagaaaucccgccaagagcuuaauaccaucgcauccaagccgccucgugaucacguguuccaggugaauaacuuugaggcucugaagaccauucagaaccagcuucgggagaagaucuuugcgaucgaggguacucagacaggaaguagcagcuccuuugagcaugagaugucucaggaaggcuucagcgcugccaucaccucuaauggccccuugcugagcacuguggggagcuaugacugggcugguggagucuuucuauauacaucaaaggagaaaagcaccuucaucaacaugaccagaguggauucagacaugaaugaugcuuacuuggguuaugcugccgccaucaucuuacggaaccgggugcaaagccugguucugggggcaccucgauaucagcacaucggccugguagcgauguucaggcagaacacuggcaugugggaguccaacgcuaaugucaagggcacccagaucggcgccuacuucggggccucccucugcuccguggacguggacagcaacggcagcaccgaccugguccucaucggggccccccauuacuacgagcagacccgagggggccagguguccgugugccccuugcccagggggagggcucgguggcagugugaugcuguucucuacggggagcagggccaacccuggggccgcuuuggggcagcccuaacagugcugggggacguaaauggggacaagcugacggacguggccauuggggccccaggagaggaggacaaccggggugcuguuuaccuguuucacggaaccucaggaucuggcaucagccccucccauagccagcggauagcaggcuccaagcucucucccaggcuccaguauuuuggucagucacugagugggggccaggaccucacaauggauggacugguagaccugacuguaggagcccaggggcacgugcugcugcucaggucccagccaguacugagagucaaggcaaucauggaguucaaucccagggaaguggcaaggaauguauuugaguguaaugaucagguggugaaaggcaaggaagccggagaggucagagucugccuccauguccagaagagcacacgggaucggcuaagagaaggacagauccagaguguugugacuuaugaccuggcucuggacuccggccgcccacauucccgcgccgucuucaaugagacaaagaacagcacacgcagacagacacaggucuuggggcugacccagacuugugagacccugaaacuacaguugccgaauugcaucgaggacccagugagccccauugugcugcgccugaacuucucucuggugggaacgccauugucugcuuucgggaaccuccggccagugcuggcggaggaugcucagagacucuucacagccuuguuucccuuugagaagaauuguggcaaugacaacaucugccaggaugaccucagcaucaccuucaguuucaugagccuggacugccucguggugggugggccccgggaguucaacgugacagugacugugagaaaugauggugaggacuccuacaggacacaggucaccuucuucuucccgcuugaccuguccuaccggaagguguccacgcuccagaaccagcgcucacagcgauccuggcgccuggccugugagucugccuccuccaccgaagugucuggggccuugaagagcaccagcugcagcauaaaccaccccaucuucccggaaaacucagaggucaccuuuaauaucacguuugauguagacucuaaggcuucccuuggaaacaaacugcuccucaaggccaaugugaccagugagaacaacaugcccagaaccaacaaaaccgaauuccaacuggagcugccggugaaauaugcugucuacaugguggucaccagccauggggucuccacuaaauaucucaacuucacggccucagagaauaccagucgggucaugcagcaucaauaucaggucagcaaccuggggcagaggagccuccccaucagccugguguucuuggugcccguccggcugaaccagacugucauaugggaccgcccccaggucaccuucuccgagaaccucucgaguacgugccacaccaaggagcgcuugcccucucacuccgacuuucuggcugagcuucggaaggcccccguggugaacugcuccaucgcugucugccagagaauccagugugacaucccguucuuuggcauccaggaagaauucaaugcuacccucaaaggcaaccucucguuugacugguacaucaagaccucgcauaaccaccuccugaucgugagcacagcugagaucuuguuuaacgauuccguguucacccugcugccgggacagggggcguuugugaggucccagacggagaccaaaguggagccguucgagguccccaacccccugccgcucaucgugggcagcucugucgggggacugcugcuccuggcccucaucaccgccgcgcuguacaagcucggcuucuucaagcggcaauacaaggacaugaugagugaagggggucccccgggggccgaaccccaguag

SEQ ID NO: 191 - RNA, 1404 nt, Artificial Sequence
  derived and/or modified CDS sequence (wt) from Homo sapiens__NP_002415.1__HsMMP8
auguucucccugaagacgcuuccauuucugcucuuacuccaugugcagauuuccaaggccuuuccuguaucuucuaaagagaaaaauacaaaaacuguucaggacuaccuggaaaaguucuaccaauuaccaagcaaccaguaucagucuacaaggaagaauggcacuaaugugaucguugaaaagcuuaaagaaaugcagcgauuuuuuggguugaaugugacggggaagccaaaugaggaaacucuggacaugaugaaaaagccucgcuguggagugccugacaguggugguuuuauguuaaccccaggaaaccccaagugggaacgcacuaacuugaccuacaggauucgaaacuauaccccacagcugucagaggcugagguagaaagagcuaucaaggaugccuuugaacucuggaguguugcaucaccucucaucuucaccaggaucucacagggagaggcagauaucaacauugcuuuuuaccaaagagaucacggugacaauucuccauuugauggacccaauggaauccuugcucaugccuuucagccaggccaagguauuggaggagaugcucauuuugaugccgaagaaacauggaccaacaccuccgcaaauuacaacuuguuucuuguugcugcucaugaauuuggccauucuuuggggcucgcucacuccucugacccuggugccuugauguaucccaacuaugcuuucagggaaaccagcaacuacucacucccucaagaugacaucgauggcauucaggccaucuauggacuuucaagcaacccuauccaaccuacuggaccaagcacacccaaacccugugaccccaguuugacauuugaugcuaucaccacacuccguggagaaauacuuuucuuuaaagacagguacuucuggagaaggcauccucagcuacaaagagucgaaaugaauuuuauuucucuauucuggccaucccuuccaacugguauacaggcugcuuaugaagauuuugacagagaccucauuuuccuauuuaaaggcaaccaauacugggcucugaguggcuaugauauucugcaagguuaucccaaggauauaucaaacuauggcuuccccagcagcguccaagcaauugacgcagcuguuuucuacagaaguaaaacauacuucuuuguaaaugaccaauucuggagauaugauaaccaaagacaauucauggagccagguuaucccaaaagcauaucaggugccuuuccaggaauagagaguaaaguugaugcaguuuuccagcaagaacauuucuuccaugucuucaguggaccaagauauuacgcauuugaucuuauugcucagagaguuaccagaguugcaagaggcaauaaauggcuuaacuguagauauggcuga

SEQ ID NO: 192 - RNA, 2124 nt, Artificial Sequence
  derived and/or modified CDS sequence (wt) from Homo sapiens__NP_004985.2__HsMMP9
augagccucuggcagccccugguccuggugcuccuggugcugggcugcugcuuugcugcccccagacagcgccaguccacccuugugcucuucccuggagaccugagaaccaaucucaccgacaggcagcuggcagaggaauaccuguaccgcuaugguuacacucggguggcagagaugcguggagagucgaaaucucuggggccugcgcugcugcuucuccagaagcaacugucccugcccgagaccggugagcuggauagcgccacgcugaaggccaugcgaaccccacggugcggggucccagaccugggcagauuccaaaccuuugagggcgaccucaaguggcaccaccacaacaucaccuauuggauccaaaacuacucggaagacuugccgcgggcggugauugacgacgccuuugcccgcgccuucgcacuguggagcgcggugacgccgcucaccuucacucgcguguacagccgggacgcagacaucgucauccaguuuggugucgcggagcacggagacggguaucccuucgacgggaaggacgggcuccuggcacacgccuuuccuccuggccccggcauucagggagacgcccauuucgacgaugacgaguuguggucccugggcaagggcgucgugguuccaacucgguuuggaaacgcagauggcgcggccugccacuuccccuucaucuucgagggccgcuccuacucugccugcaccaccgacggucgcuccgacggcuugcccuggugcaguaccacggccaacuacgacaccgacgaccgguuuggcuucugccccagcgagagacucuacacccaggacggcaaugcugaugggaaacccugccaguuuccauucaucuuccaaggccaauccuacuccgccugcaccacggacggucgcuccgacggcuaccgcuggugcgccaccaccgccaacuacgaccgggacaagcucuucggcuucugcccgacccgagcugacucgacggugauggggggcaacucggcgggggagcugugcgucuuccccuucacuuuccuggguaaggaguacucgaccuguaccagcgagggccgcggagaugggcgccucuggugcgcuaccaccucgaacuuugacagcgacaagaaguggggcuucugcccggaccaaggauacaguuuguuccucguggcggcgcaugaguucggccacgcgcugggcuuagaucauuccucagugccggaggcgcucauguacccuauguaccgcuucacugaggggccccccuugcauaaggacgacgugaauggcauccggcaccucuaugguccucgcccugaaccugagccacggccuccaaccaccaccacaccgcagcccacggcucccccgacggucugccccaccggaccccccacuguccaccccucagagcgccccacagcuggccccacagguccccccucagcuggccccacagguccccccacugcuggcccuucuacggccacuacugugccuuugaguccgguggacgaugccugcaacgugaacaucuucgacgccaucgcggagauugggaaccagcuguauuuguucaaggaugggaaguacuggcgauucucugagggcagggggagccggccgcagggccccuuccuuaucgccgacaaguggcccgcgcugccccgcaagcuggacucggucuuugaggagcggcucuccaagaagcuuuucuucuucucugggcgccagguguggguguacacaggcgcgucggugcugggcccgaggcgucuggacaagcugggccugggagccgacguggcccaggugaccggggcccuccggaguggcagggggaagaugcugcuguucagcgggcggcgccucuggagguucgacgugaaggcgcagaugguggauccccggagcgccagcgagguggaccggauguuccccggggugccuuuggacacgcacgacgucuuccaguaccgagagaaagccuauuucugccaggaccgcuucuacuggcgcgugaguucccggagugaguugaaccagguggaccaagugggcuacgugaccuaugacauccugcagugcccugaggacuag

SEQ ID NO: 193 - RNA, 1416 nt, Artificial Sequence
  derived and/or modified CDS sequence (wt) from Homo sapiens__NP_002418.1__HsMMP13
augcauccagggguccuggcugccuuccucuucuugagcuggacucauugucgggcccugccccuucccagugguggugaugaagaugauuugucugaggaagaccuccaguuugcagagcgcuaccugagaucauacuaccauccuacaaaucucgcgggaauccugaaggagaaugcagcaagcuccaugacugagaggcuccgagaaaugcagucuuucuucggcuuagaggugacuggcaaacuugacgauaacaccuuagaugucaugaaaaagccaagaugcgggguuccugaugugggugaauacaauguuuucccucgaacucuuaaaugguccaaaaugaauuuaaccuacagaauugugaauuacaccccugauaugacucauucugaagucgaaaaggcauucaaaaaagccuucaaaguuugguccgauguaacuccucugaauuuuaccagacuucacgauggcauugcugacaucaugaucucuuuuggaauuaaggagcauggcgacuucuacccauuugaugggcccucuggccugcuggcucaugcuuuuccuccugggccaaauuauggaggagaugcccauuuugaugaugaugaaaccuggacaaguaguuccaaaggcuacaacuuguuucuuguugcugcgcaugaguucggccacuccuuaggucuugaccacuccaaggacccuggagcacucauguuuccuaucuacaccuacaccggcaaaagccacuuuaugcuuccugaugacgauguacaagggauccagucucucuaugguccaggagaugaagaccccaacccuaaacauccaaaaacgccagacaaaugugacccuuccuuaucccuugaugccauuaccagucuccgaggagaaacaaugaucuuuaaagacagauucuucuggcgccugcauccucagcagguugaugcggagcuguuuuuaacgaaaucauuuuggccagaacuucccaaccguauugaugcugcauaugagcacccuucucaugaccucaucuucaucuucagagguagaaaauuuugggcucuuaaugguuaugacauucuggaagguuaucccaaaaaaauaucugaacugggucuuccaaaagaaguuaagaagauaagugcagcuguucacuuugaggauacaggcaagacucuccuguucucaggaaaccaggucuggagauaugaugauacuaaccauauuauggauaaagacuauccgagacuaauagaagaagacuucccaggaauuggugauaaaguagaugcugucuaugagaaaaaugguuauaucuauuuuuucaacggacccauacaguuugaauacagcaucuggaguaaccguauuguucgcgucaugccagcaaauuccauuuugugguguuaa

SEQ ID NO: 194 - RNA, 1068 nt, Artificial Sequence
  derived and/or modified CDS sequence (wt) from Homo sapiens__NP_001286.1__HsCCR1
auggaaacuccaaacaccacagaggacuaugacacgaccacagaguuugacuauggggaugcaacuccgugccagaaggugaacgagagggccuuuggggcccaacugcugcccccucuguacuccuugguauuugucauuggccugguuggaaacauccuggugguccugguccuugugcaauacaagaggcuaaaaaacaugaccagcaucuaccuccugaaccuggccauuucugaccugcucuuccuguucacgcuucccuucuggaucgacuacaaguugaaggaugacuggguuuuuggugaugccauguguaagauccucucuggguuuuauuacacaggcuuguacagcgagaucuuuuucaucauccugcugacgauugacagguaccuggccaucguccacgccguguuugccuugcgggcacggaccgucacuuuuggugucaucaccagcaucaucauuugggcccuggccaucuuggcuuccaugccaggcuuauacuuuuccaagacccaaugggaauucacucaccacaccugcagccuucacuuuccucacgaaagccuacgagaguggaagcuguuucaggcucugaaacugaaccucuuugggcugguauugccuuuguuggucaugaucaucugcuacacagggauuauaaagauucugcuaagacgaccaaaugagaagaaauccaaagcuguccguuugauuuuugucaucaugaucaucuuuuuucucuuuuggacccccuacaauuugacuauacuuauuucuguuuuccaagacuuccuguucacccaugagugugagcagagcagacauuuggaccuggcugugcaagugacggaggugaucgccuacacgcacugcugugucaacccagugaucuacgccuucguuggugagagguuccggaaguaccugcggcaguuguuccacaggcguguggcugugcaccugguuaaauggcuccccuuccucuccguggacaggcuggagagggucagcuccacaucucccuccacaggggagcaugaacucucugcuggguucuga

SEQ ID NO: 195 - RNA, 636 nt, Artificial Sequence
  derived and/or modified CDS sequence (wt) from Homo sapiens__NP_002598.4__HsPDGFA
augaggaccuuggcuugccugcugcuccucggcugcggauaccucgcccauguucuggccgaggaagccgagaucccccgcgaggugaucgagaggcuggcccgcagucagauccacagcauccgggaccuccagcgacuccuggagauagacuccguagggagugaggauucuuuggacaccagccugagagcucacgggguccaugccacuaagcaugugcccgagaagcggccccugcccauucggaggaagagaagcaucgaggaagcuguccccgcugucugcaagaccaggacggucauuuacgagauuccucggagucaggucgaccccacguccgccaacuuccugaucuggcccccgugcguggaggugaaacgcugcaccggcugcugcaacacgagcagugucaagugccagcccucccgcguccaccaccgcagcgucaagguggccaagguggaauacgucaggaagaagccaaaauuaaaagaaguccaggugagguuagaggagcauuuggagugcgccugcgcgaccacaagccugaauccggauuaucgggaagaggacacgggaaggccuagggagucagguaaaaaacggaaaagaaaaagguuaaaacccaccuaa

SEQ ID NO: 196 - RNA, 726 nt, Artificial Sequence
  derived and/or modified CDS sequence (wt) from Homo sapiens__NP_002599.1__HsPDGFB
augaaucgcugcugggcgcucuuccugucucucugcugcuaccugcgucuggucagcgccgagggggaccccauucccgaggagcuuuaugagaugcugagugaccacucgauccgcuccuuugaugaucuccaacgccugcugcacggagaccccggagaggaagauggggccgaguuggaccugaacaugacccgcucccacucuggaggcgagcuggagagcuuggcucguggaagaaggagccuggguucccugaccauugcugagccggccaugaucgccgagugcaagacgcgcaccgagguguucgagaucucccggcgccucauagaccgcaccaacgccaacuuccugguguggccgcccuguguggaggugcagcgcugcuccggcugcugcaacaaccgcaacgugcagugccgccccacccaggugcagcugcgaccuguccaggugagaaagaucgagauugugcggaagaagccaaucuuuaagaaggccacggugacgcuggaagaccaccuggcaugcaagugugagacaguggcagcugcacggccugugacccgaagcccgggggguucccaggagcagcgagccaaaacgccccaaacucgggugaccauucggacggugcgaguccgccggccccccaagggcaagcaccggaaauucaagcacacgcaugacaagacggcacugaaggagacccuuggagccuag

SEQ ID NO: 197 - RNA, 1038 nt, Artificial Sequence
  derived and/or modified CDS sequence (wt) from Homo sapiens__NP_057289.1__HsPDGFC
augagccucuucgggcuucuccugcugacaucugcccuggccggccagagacaggggacucaggcggaauccaaccugaguaguaaauuccaguuuuccagcaacaaggaacagaacggaguacaagauccucagcaugagagaauuauuacugugucuacuaauggaaguauucacagcccaagguuuccucauacuuauccaagaaauacggucuugguauggagauuaguagcaguagaggaaaauguauggauacaacuuacguuugaugaaagauuugggcuugaagacccagaagaugacauaugcaaguaugauuuuguagaaguugaggaacccagugauggaacuauauuagggcgcuggugugguucugguacuguaccaggaaaacagauuucuaaaggaaaucaaauuaggauaagauuuguaucugaugaauauuuuccuucugaaccaggguucugcauccacuacaacauugucaugccacaauucacagaagcugugaguccuucagugcuacccccuucagcuuugccacuggaccugcuuaauaaugcuauaacugccuuuaguaccuuggaagaccuuauucgauaucuugaaccagagagauggcaguuggacuuagaagaucuauauaggccaacuuggcaacuucuuggcaaggcuuuuguuuuuggaagaaaauccagagugguggaucugaaccuucuaacagaggagguaagauuauacagcugcacaccucguaacuucucaguguccauaagggaagaacuaaagagaaccgauaccauuuucuggccagguugucuccugguuaaacgcuguggugggaacugugccuguugucuccacaauugcaaugaaugucaaugugucccaagcaaaguuacuaaaaaauaccacgagguccuucaguugagaccaaagaccggugucaggggauugcacaaaucacucaccgacguggcccuggagcaccaugaggagugugacugugugugcagagggagcacaggaggauag

SEQ ID NO: 198 - RNA, 1095 nt, Artificial Sequence
  derived and/or modified CDS sequence (wt) from Homo sapiens__NP_149126.1__HsPDGFD
augcaccggcucaucuuugucuacacucuaaucugcgcaaacuuuugcagcugucgggacacuucugcaaccccgcagagcgcauccaucaaagcuuugcgcaacgccaaccucaggcgagaugacuuguaccgaagagaugagaccauccaggugaaaggaaacggcuacgugcagaguccuagauucccgaacagcuaccccaggaaccugcuccugacauggcggcuucacucucaggagaauacacggauacagcuaguguuugacaaucaguuuggauuagaggaagcagaaaaugauaucuguagguaugauuuuguggaaguugaagauauauccgaaaccaguaccauuauuagaggacgaugguguggacacaaggaaguuccuccaaggauaaaaucaagaacgaaccaaauuaaaaucacauucaaguccgaugacuacuuuguggcuaaaccuggauucaagauuuauuauucuuugcuggaagauuuccaacccgcagcagcuucagagaccaacugggaaucugucacaagcucuauuucagggguauccuauaacucuccaucaguaacggaucccacucugauugcggaugcucuggacaaaaaaauugcagaauuugauacaguggaagaucugcucaaguacuucaauccagagucauggcaagaagaucuugagaauauguaucuggacaccccucgguaucgaggcaggucauaccaugaccggaagucaaaaguugaccuggauaggcucaaugaugaugccaagcguuacaguugcacucccaggaauuacucggucaauauaagagaagagcugaaguuggccaauguggucuucuuuccacguugccuccucgugcagcgcuguggaggaaauuguggcuguggaacugucaacuggagguccugcacaugcaauucagggaaaaccgugaaaaaguaucaugagguauuacaguuugagccuggccacaucaagaggagggguagagcuaagaccauggcucuaguugacauccaguuggaucaccaugaacgaugugauuguaucugcagcucaagaccaccucgauaa

SEQ ID NO: 199 - RNA, 678 nt, Artificial Sequence
  derived and/or modified CDS sequence (wt) from Homo sapiens__NP_003946.3__HsSOCS3
auggucacccacagcaaguuucccgccgccgggaugagccgcccccuggacaccagccugcgccucaagaccuucagcuccaagagcgaguaccagcugguggugaacgcagugcgcaagcugcaggagagcggcuucuacuggagcgcagugaccggcggcgaggcgaaccugcugcucagugccgagcccgccggcaccuuucugauccgcgacagcucggaccagcgccacuucuucacgcucagcgucaagacccagucugggaccaagaaccugcgcauccagugugaggggggcagcuucucucugcagagcgauccccggagcacgcagcccgugccccgcuucgacugcgugcucaagcuggugcaccacuacaugccgcccccuggagcccccuccuuccccucgccaccuacugaacccuccuccgaggugcccgagcagccgucugcccagccacucccugggaguccccccagaagagccuauuacaucuacuccgggggcgagaagaucccccugguguugagccggccccucuccuccaacguggccacucuucagcaucucugucggaagaccgucaacggccaccuggacuccuaugagaaagucacccagcugccggggcccauucgggaguuccuggaccaguacgaugccccgcuuuaa

SEQ ID NO: 200 - RNA, 483 nt, Artificial Sequence
  derived and/or modified CDS sequence (wt) from Homo sapiens__NP_003227.1__HsTGFA
augguccccucggcuggacagcucgcccuguucgcucuggguauuguguuggcugcgugccaggccuuggagaacagcacguccccgcugagugcagacccgcccguggcugcagcaguggugucccauuuuaaugacugcccagauucccacacucaguucugcuuccauggaaccugcagguuuuuggugcaggaggacaagccagcaugugucugccauucuggguacguuggugcacgcugugagcaugcggaccuccuggccgugguggcugccagccagaagaagcaggccaucaccgccuuggugguggucuccaucguggcccuggcuguccuuaucaucacaugugugcugauacacugcugccagguccgaaaacacugugaguggugccgggcccucaucugccggcacgagaagcccagcgcccuccugaagggaagaaccgcuugcugccacucagaaacaguggucuga

SEQ ID NO: 201 - RNA, 1173 nt, Artificial Sequence
  derived and/or modified CDS sequence (wt) from Homo sapiens__NP_000651.3__HsTGFB1
augccgcccuccgggcugcggcugcugccgcugcugcuaccgcugcuguggcuacuggugcugacgccuggccggccggccgcgggacuauccaccugcaagacuaucgacauggagcuggugaagcggaagcgcaucgaggccauccgcggccagauccuguccaagcugcggcucgccagccccccgagccagggggaggugccgcccggcccgcugcccgaggccgugcucgcccuguacaacagcacccgcgaccggguggccggggagagugcagaaccggagcccgagccugaggccgacuacuacgccaaggaggucacccgcgugcuaaugguggaaacccacaacgaaaucuaugacaaguucaagcagaguacacacagcauauauauguucuucaacacaucagagcuccgagaagcgguaccugaacccguguugcucucccgggcagagcugcgucugcugaggcucaaguuaaaaguggagcagcacguggagcuguaccagaaauacagcaacaauuccuggcgauaccucagcaaccggcugcuggcacccagcgacucgccagagugguuaucuuuugaugucaccggaguugugcggcagugguugagccguggaggggaaauugagggcuuucgccuuagcgcccacugcuccugugacagcagggauaacacacugcaaguggacaucaacggguucacuaccggccgccgaggugaccuggccaccauucauggcaugaaccggccuuuccugcuucucauggccaccccgcuggagagggcccagcaucugcaaagcucccggcaccgccgagcccuggacaccaacuauugcuucagcuccacggagaagaacugcugcgugcggcagcuguacauugacuuccgcaaggaccucggcuggaaguggauccacgagcccaagggcuaccaugccaacuucugccucgggcccugccccuacauuuggagccuggacacgcaguacagcaagguccuggcccuguacaaccagcauaacccgggcgccucggcggcgccgugcugcgugccgcaggcgcuggagccgcugcccaucguguacuacgugggccgcaagcccaagguggagcagcuguccaacaugaucgugcgcuccugcaagugcagcuga

SEQ ID NO: 202 - RNA, 1245 nt, Artificial Sequence
  derived and/or modified CDS sequence (wt) from Homo sapiens__NP_003229.1__HsTGFB2
augcacuacugugugcugagcgcuuuucugauccugcaucuggucacggucgcgcucagccugucuaccugcagcacacucgauauggaccaguucaugcgcaagaggaucgaggcgauccgcgggcagauccugagcaagcugaagcucaccagucccccagaagacuauccugagcccgaggaaguccccccggaggugauuuccaucuacaacagcaccagggacuugcuccaggagaaggcgagccggagggcggccgccugcgagcgcgagaggagcgacgaagaguacuacgccaaggagguuuacaaaauagacaugccgcccuucuuccccuccgaaaaugccaucccgcccacuuucuacagacccuacuucagaauuguucgauuugacgucucagcaauggagaagaaugcuuccaauuuggugaaagcagaguucagagucuuucguuugcagaacccaaaagccagagugccugaacaacggauugagcuauaucagauucucaaguccaaagauuuaacaucuccaacccagcgcuacaucgacagcaaaguugugaaaacaagagcagaaggcgaauggcucuccuucgauguaacugaugcuguucaugaauggcuucaccauaaagacaggaaccugggauuuaaaauaagcuuacacugucccugcugcacuuuuguaccaucuaauaauuacaucaucccaaauaaaagugaagaacuagaagcaagauuugcagguauugauggcaccuccacauauaccaguggugaucagaaaacuauaaaguccacuaggaaaaaaaacagugggaagaccccacaucuccugcuaauguuauugcccuccuacagacuugagucacaacagaccaaccggcggaagaagcgugcuuuggaugcggccuauugcuuuagaaaugugcaggauaauugcugccuacguccacuuuacauugauuucaagagggaucuaggguggaaauggauacacgaacccaaaggguacaaugccaacuucugugcuggagcaugcccguauuuauggaguucagacacucagcacagcaggguccugagcuuauauaauaccauaaauccagaagcaucugcuucuccuugcugcgugucccaagauuuagaaccucuaaccauucucuacuacauuggcaaaacacccaagauugaacagcuuucuaauaugauuguaaagucuugcaaaugcagcuaa

SEQ ID NO: 203 - RNA, 1239 nt, Artificial Sequence
  derived and/or modified CDS sequence (wt) from Homo sapiens__NP_003230.1__HsTGFB3
augaagaugcacuugcaaagggcucuggugguccuggcccugcugaacuuugccacggucagccucucucuguccacuugcaccaccuuggacuucggccacaucaagaagaagaggguggaagccauuaggggacagaucuugagcaagcucaggcucaccagccccccugagccaacggugaugacccacguccccuaucagguccuggcccuuuacaacagcacccgggagcugcuggaggagaugcauggggagagggaggaaggcugcacccaggaaaacaccgagucggaauacuaugccaaagaaauccauaaauucgacaugauccaggggcuggcggagcacaacgaacuggcugucugcccuaaaggaauuaccuccaagguuuuccgcuucaauguguccucaguggagaaaaauagaaccaaccuauuccgagcagaauuccgggucuugcgggugcccaaccccagcucuaagcggaaugagcagaggaucgagcucuuccagauccuucggccagaugagcacauugccaaacagcgcuauaucgguggcaagaaucugcccacacggggcacugccgaguggcuguccuuugaugucacugacacugugcgugaguggcuguugagaagagaguccaacuuaggucuagaaaucagcauucacuguccaugucacaccuuucagcccaauggagauauccuggaaaacauucacgaggugauggaaaucaaauucaaaggcguggacaaugaggaugaccauggccguggagaucuggggcgccucaagaagcagaaggaucaccacaacccucaucuaauccucaugaugauucccccacaccggcucgacaacccgggccaggggggucagaggaagaagcgggcuuuggacaccaauuacugcuuccgcaacuuggaggagaacugcugugugcgcccccucuacauugacuuccgacaggaucugggcuggaaguggguccaugaaccuaagggcuacuaugccaacuucugcucaggcccuugcccauaccuccgcagugcagacacaacccacagcacggugcugggacuguacaacacucugaacccugaagcaucugccucgccuugcugcgugccccaggaccuggagccccugaccauccuguacuauguugggaggacccccaaaguggagcagcucuccaacaugguggugaagucuuguaaauguagcuga

SEQ ID NO: 204 - RNA, 1386 nt, Artificial Sequence
  derived and/or modified CDS sequence (wt) from Homo sapiens__NP_001057.1__HsTNFRSF1B
auggcgcccgucgccgucugggccgcgcuggccgucggacuggagcucugggcugcggcgcacgccuugcccgcccagguggcauuuacacccuacgccccggagcccgggagcacaugccggcucagagaauacuaugaccagacagcucagaugugcugcagcaaaugcucgccgggccaacaugcaaaagucuucuguaccaagaccucggacaccgugugugacuccugugaggacagcacauacacccagcucuggaacuggguucccgagugcuugagcuguggcucccgcuguagcucugaccagguggaaacucaagccugcacucgggaacagaaccgcaucugcaccugcaggcccggcugguacugcgcgcugagcaagcaggaggggugccggcugugcgcgccgcugcgcaagugccgcccgggcuucggcguggccagaccaggaacugaaacaucagacguggugugcaagcccugugccccggggacguucuccaacacgacuucauccacggauauuugcaggccccaccagaucuguaacgugguggccaucccugggaaugcaagcauggaugcagucugcacguccacgucccccacccggaguauggccccaggggcaguacacuuaccccagccaguguccacacgaucccaacacacgcagccaacuccagaacccagcacugcuccaagcaccuccuuccugcucccaaugggccccagccccccagcugaagggagcacuggcgacuucgcucuuccaguuggacugauugugggugugacagccuugggucuacuaauaauaggaguggugaacugugucaucaugacccaggugaaaaagaagcccuugugccugcagagagaagccaaggugccucacuugccugccgauaaggcccgggguacacagggccccgagcagcagcaccugcugaucacagcgccgagcuccagcagcagcucccuggagagcucggccagugcguuggacagaagggcgcccacucggaaccagccacaggcaccaggcguggaggccaguggggccggggaggcccgggccagcaccgggagcucagauucuuccccugguggccaugggacccaggucaaugucaccugcaucgugaacgucuguagcagcucugaccacagcucacagugcuccucccaagccagcuccacaaugggagacacagauuccagccccucggaguccccgaaggacgagcagguccccuucuccaaggaggaaugugccuuucggucacagcuggagacgccagagacccugcuggggagcaccgaagagaagccccugccccuuggagugccugaugcugggaugaagcccaguuaa

SEQ ID NO: 205 - RNA, 513 nt, Artificial Sequence
  derived and/or modified CDS sequence (wt) from Homo sapiens__NP_002623.2__HsPGF
augccggucaugaggcuguucccuugcuuccugcagcuccuggccgggcuggcgcugccugcugugcccccccagcagugggccuugucugcugggaacggcucgucagagguggaagugguacccuuccaggaaguguggggccgcagcuacugccgggcgcuggagaggcugguggacgucguguccgaguaccccagcgagguggagcacauguucagcccauccugugucucccugcugcgcugcaccggcugcugcggcgaugagaaucugcacugugugccgguggagacggccaaugucaccaugcagcuccuaaagauccguucuggggaccggcccuccuacguggagcugacguucucucagcacguucgcugcgaaugccggccucugcgggagaagaugaagccggaaaggaggagacccaagggcagggggaagaggaggagagagaagcagagacccacagacugccaccugugcggcgaugcuguuccccggagguaa

SEQ ID NO: 206 - RNA, 1239 nt, Artificial Sequence
  derived and/or modified CDS sequence (wt) from Homo sapiens__NP_001020537.2__HsVEGFA
augacggacagacagacagacaccgcccccagccccagcuaccaccuccuccccggccggcggcggacaguggacgcggcggcgagccgcgggcaggggccggagcccgcgcccggaggcgggguggagggggucggggcucgcggcgucgcacugaaacuuuucguccaacuucugggcuguucucgcuucggaggagccgugguccgcgcgggggaagccgagccgagcggagccgcgagaagugcuagcucgggccgggaggagccgcagccggaggagggggaggaggaagaagagaaggaagaggagagggggccgcaguggcgacucggcgcucggaagccgggcucauggacgggugaggcggcggugugcgcagacagugcuccagccgcgcgcgcuccccaggcccuggcccgggccucgggccggggaggaagaguagcucgccgaggcgccgaggagagcgggccgccccacagcccgagccggagagggagcgcgagccgcgccggccccggucgggccuccgaaaccaugaacuuucugcugucuugggugcauuggagccuugccuugcugcucuaccuccaccaugccaaguggucccaggcugcacccauggcagaaggaggagggcagaaucaucacgaaguggugaaguucauggaugucuaucagcgcagcuacugccauccaaucgagacccugguggacaucuuccaggaguacccugaugagaucgaguacaucuucaagccauccugugugccccugaugcgaugcgggggcugcugcaaugacgagggccuggagugugugcccacugaggaguccaacaucaccaugcagauuaugcggaucaaaccucaccaaggccagcacauaggagagaugagcuuccuacagcacaacaaaugugaaugcagaccaaagaaagauagagcaagacaagaaaaaaaaucaguucgaggaaagggaaaggggcaaaaacgaaagcgcaagaaaucccgguauaaguccuggagcguguacguuggugcccgcugcugucuaaugcccuggagccucccuggcccccaucccugugggccuugcucagagcggagaaagcauuuguuuguacaagauccgcagacguguaaauguuccugcaaaaacacagacucgcguugcaaggcgaggcagcuugaguuaaacgaacguacuugcagaugugacaagccgaggcgguga

SEQ ID NO: 207 - RNA, 699 nt, Artificial Sequence
  derived and/or modified CDS sequence (wt) from Homo sapiens__NP_001165094.1__HsVEGFA
augaacuuucugcugucuugggugcauuggagccuugccuugcugcucuaccuccaccaugccaaguggucccaggcugcacccauggcagaaggaggagggcagaaucaucacgaaguggugaaguucauggaugucuaucagcgcagcuacugccauccaaucgagacccugguggacaucuuccaggaguacccugaugagaucgaguacaucuucaagccauccugugugccccugaugcgaugcgggggcugcugcaaugacgagggccuggagugugugcccacugaggaguccaacaucaccaugcagauuaugcggaucaaaccucaccaaggccagcacauaggagagaugagcuuccuacagcacaacaaaugugaaugcagaccaaagaaagauagagcaagacaagaaaaaaaaucaguucgaggaaagggaaaggggcaaaaacgaaagcgcaagaaaucccgguauaaguccuggagcguguacguuggugcccgcugcugucuaaugcccuggagccucccuggcccccaucccugugggccuugcucagagcggagaaagcauuuguuuguacaagauccgcagacguguaaauguuccugcaaaaacacagacucgcguugcaaggcgaggcagcuugaguuaaacgaacguacuugcagaugugacaagccgaggcgguga

SEQ ID NO: 208 - RNA, 624 nt, Artificial Sequence
  derived and/or modified CDS sequence (wt) from Homo sapiens__NP_003368.1__HsVEGFB
augagcccucugcuccgccgccugcugcucgccgcacuccugcagcuggcccccgcccaggccccugucucccagccugaugccccuggccaccagaggaaaguggugucauggauagauguguauacucgcgcuaccugccagccccgggaggugguggugcccuugacuguggagcucaugggcaccguggccaaacagcuggugcccagcugcgugacugugcagcgcugugguggcugcugcccugacgauggccuggagugugugcccacugggcagcaccaaguccggaugcagauccucaugauccgguacccgagcagucagcugggggagaugucccuggaagaacacagccagugugaaugcagaccuaaaaaaaaggacagugcugugaagccagacagggcugccacuccccaccaccguccccagccccguucuguuccgggcugggacucugcccccggagcacccuccccagcugacaucacccaucccacuccagccccaggccccucugcccacgcugcacccagcaccaccagcgcccugacccccggaccugccgcugccgcugccgacgccgcagcuuccuccguugccaagggcggggcuuag

SEQ ID NO: 209 - RNA, 1260 nt, Artificial Sequence
  derived and/or modified CDS sequence (wt) from Homo sapiens__NP_005420.1__HsVEGFC
augcacuugcugggcuucuucucuguggcguguucucugcucgccgcugcgcugcucccggguccucgcgaggcgcccgccgccgccgccgccuucgaguccggacucgaccucucggacgcggagcccgacgcgggcgaggccacggcuuaugcaagcaaagaucuggaggagcaguuacggucuguguccaguguagaugaacucaugacuguacucuacccagaauauuggaaaauguacaagugucagcuaaggaaaggaggcuggcaacauaacagagaacaggccaaccucaacucaaggacagaagagacuauaaaauuugcugcagcacauuauaauacagagaucuugaaaaguauugauaaugaguggagaaagacucaaugcaugccacgggagguguguauagauguggggaaggaguuuggagucgcgacaaacaccuucuuuaaaccuccauguguguccgucuacagauguggggguugcugcaauagugaggggcugcagugcaugaacaccagcacgagcuaccucagcaagacguuauuugaaauuacagugccucucucucaaggccccaaaccaguaacaaucaguuuugccaaucacacuuccugccgaugcaugucuaaacuggauguuuacagacaaguucauuccauuauuagacguucccugccagcaacacuaccacagugucaggcagcgaacaagaccugccccaccaauuacauguggaauaaucacaucugcagaugccuggcucaggaagauuuuauguuuuccucggaugcuggagaugacucaacagauggauuccaugacaucuguggaccaaacaaggagcuggaugaagagaccugucagugugucugcagagcggggcuucggccugccagcuguggaccccacaaagaacuagacagaaacucaugccagugugucuguaaaaacaaacucuuccccagccaauguggggccaaccgagaauuugaugaaaacacaugccaguguguauguaaaagaaccugccccagaaaucaaccccuaaauccuggaaaaugugccugugaauguacagaaaguccacagaaaugcuuguuaaaaggaaagaaguuccaccaccaaacaugcagcuguuacagacggccauguacgaaccgccagaaggcuugugagccaggauuuucauauagugaagaagugugucguugugucccuucauauuggaaaagaccacaaaugagcuaa

SEQ ID NO: 210 - RNA, 1065 nt, Artificial Sequence
  derived and/or modified CDS sequence (wt) from Homo sapiens__NP_004460.1__HsVEGFD
auguacagagaguggguaguggugaauguuuucaugauguuguacguccagcuggugcagggcuccaguaaugaacauggaccagugaagcgaucaucucaguccacauuggaacgaucugaacagcagaucagggcugcuucuaguuuggaggaacuacuucgaauuacucacucugaggacuggaagcuguggagaugcaggcugaggcucaaaaguuuuaccaguauggacucucgcucagcaucccaucgguccacuagguuugcggcaacuuucuaugacauugaaacacuaaaaguuauagaugaagaauggcaaagaacucagugcagcccuagagaaacgugcguggagguggccagugagcuggggaagaguaccaacacauucuucaagcccccuugugugaacguguuccgaugugguggcuguugcaaugaagagagccuuaucuguaugaacaccagcaccucguacauuuccaaacagcucuuugagauaucagugccuuugacaucaguaccugaauuagugccuguuaaaguugccaaucauacagguuguaagugcuugccaacagccccccgccauccauacucaauuaucagaagauccauccagaucccugaagaagaucgcuguucccauuccaagaaacucuguccuauugacaugcuaugggauagcaacaaauguaaauguguuuugcaggaggaaaauccacuugcuggaacagaagaccacucucaucuccaggaaccagcucucugugggccacacaugauguuugacgaagaucguugcgagugugucuguaaaacaccaugucccaaagaucuaauccagcaccccaaaaacugcaguugcuuugagugcaaagaaagucuggagaccugcugccagaagcacaagcuauuucacccagacaccugcagcugugaggacagaugccccuuucauaccagaccaugugcaaguggcaaaacagcaugugcaaagcauugccgcuuuccaaaggagaaaagggcugcccaggggccccacagccgaaagaauccuuga

SEQ ID NO: 211 - RNA, 72 nt, Artificial Sequence
  derived and/or modified CDS sequence (opt1) from Homo sapiens__AAA59606.1__signal peptide-HLA-A2-SP
auggccgugauggccccgcggacccugguccuccugcugagcggcgcgcucgcccugacccagacgugggcc

SEQ ID NO: 212 - RNA, 69 nt, Artificial Sequence
  derived and/or modified CDS sequence (opt1) from Homo sapiens__AAA61213.1__signal peptide-HsPLAT
auggacgccaugaagcgcggccugugcugcgugcuccugcugugcggggccgucuucgugagccccucc

SEQ ID NO: 213 - RNA, 81 nt, Artificial Sequence
  derived and/or modified CDS sequence (opt1) from Homo sapiens__NP_000790.2__signal peptide-HsEPO
augggcgugcacgagugccccgccuggcuguggcuccugcugagccuccugucccugccgcucgggcugcccguccugggc

SEQ ID NO: 214 - RNA, 54 nt, Artificial Sequence
  derived and/or modified CDS sequence (opt1) from Homo sapiens__NP_000468.1__signal peptide-HsALB
augaagugggugaccuucaucagccugcucuuccuguucuccagcgccuacucc

SEQ ID NO: 215 - RNA, 18 nt, Artificial Sequence
  derived and/or modified CDS sequence (opt1) from Artificial____cleavage site-Furin
cgccggcgccggaagcgc

SEQ ID NO: 216 - RNA, 630 nt, Artificial Sequence
  derived and/or modified CDS sequence (opt1) from Homo sapiens__NP_061986.1__HsFGF21
auggacagcgacgagaccggcuucgagcacuccgggcugugggugagcguccucgccggccugcugcucggggccugccaggcccaccccaucccggacuccagcccccugcugcaguucggcggccaggugcgccagcgguaccucuacaccgacgacgcccagcagacggaggcccaccuggagauccgcgaggacgggaccgugggcggggccgccgaccagucccccgagagccugcuccagcugaaggcgcugaagcccggcgucauccagauccucggggugaagaccucccgguuccugugccagcgcccggacggcgcccuguacgggagccuccacuucgaccccgaggccugcuccuuccgggagcugcugcucgaggacggcuacaacguguaccagagcgaggcccacggccugccccugcaccuccccgggaacaaguccccgcaccgcgaccccgcgccccggggccccgcccgcuuccugccgcugcccgggcucccgcccgcccugcccgagccgcccggcauccuggcgccccagccgcccgacgucggcagcuccgacccccucagcaugguggggcccucccagggccggagccccuccuacgccagcuga

SEQ ID NO: 217 - RNA, 1410 nt, Artificial Sequence
  derived and/or modified CDS sequence (opt1) from Homo sapiens__NP_002412.1__HsMMP1
augcacagcuucccgccccugcuccugcugcucuucuggggcguggucucccacagcuuccccgccacccuggagacccaggagcaggacguggaccuggugcagaaguaccucgagaaguacuacaaccugaagaacgacgggcgccaggucgagaagcggcgcaacuccggccccgugguggagaagcugaagcagaugcaggaguucuucgggcucaaggucacgggcaagcccgacgccgagacccugaaggugaugaagcagccgcggugcggggugcccgacgucgcgcaguucgugcugaccgagggcaacccccgcugggagcagacccaccucacguaccggaucgagaacuacacccccgaccugccgcgcgccgacguggaccacgccaucgagaaggccuuccagcuguggagcaacgucaccccgcucaccuucacgaagguguccgagggccaggccgacaucaugaucagcuucgugcggggcgaccaccgcgacaacucccccuucgacgggcccgggggcaaccuggcgcacgccuuccagccggggcccggcaucggcggggacgcccacuucgacgaggacgagcgguggaccaacaacuuccgcgaguacaaccugcaccgggucgccgcgcacgagcucggccacagccuggggcugucccacagcaccgacaucggcgcccucauguaccccuccuacaccuucagcggcgacgugcagcuggcccaggacgacaucgacgggauccaggccaucuacggccgcucccagaaccccgugcagccgaucgggccccagacgcccaaggccugcgacagcaagcugaccuucgacgcgaucaccaccauccggggcgaggucauguucuucaaggaccgcuucuacaugcggacgaaccccuucuacccggagguggagcucaacuucaucuccguguucuggccccagcugcccaacgggcuggaggccgccuacgaguucgccgaccgcgacgagguccgguucuucaagggcaacaaguacugggccgugcagggccagaacgugcuccacggguaccccaaggacaucuacagcuccuucggcuucccgcgcaccgucaagcacaucgacgcggcccugagcgaggagaacaccgggaagaccuacuucuucguggccaacaaguacuggcgguacgacgaguacaagcgcuccauggaccccggcuaccccaagaugaucgcccacgacuuccccgggaucggccacaaggucgacgccguguucaugaaggacggcuucuucuacuucuuccacgggacgcggcaguacaaguucgacccgaagaccaagcgcauccugacccuccagaaggcgaacagcugguucaacugccgcaagaacuga

SEQ ID NO: 218 - RNA, 1170 nt, Artificial Sequence
  derived and/or modified CDS sequence (opt1) from Homo sapiens__NP_002412.1__HsMMP1(1-19,100-469)
augcacagcuucccgccccugcuccugcugcucuucuggggcguggucucccacagcuucgugcugaccgagggcaacccccgcugggagcagacccaccucacguaccggaucgagaacuacacccccgaccugccgcgcgccgacguggaccacgccaucgagaaggccuuccagcuguggagcaacgucaccccgcucaccuucacgaagguguccgagggccaggccgacaucaugaucagcuucgugcggggcgaccaccgcgacaacucccccuucgacgggcccgggggcaaccuggcgcacgccuuccagccggggcccggcaucggcggggacgcccacuucgacgaggacgagcgguggaccaacaacuuccgcgaguacaaccugcaccgggucgccgcgcacgagcucggccacagccuggggcugucccacagcaccgacaucggcgcccucauguaccccuccuacaccuucagcggcgacgugcagcuggcccaggacgacaucgacgggauccaggccaucuacggccgcucccagaaccccgugcagccgaucgggccccagacgcccaaggccugcgacagcaagcugaccuucgacgcgaucaccaccauccggggcgaggucauguucuucaaggaccgcuucuacaugcggacgaaccccuucuacccggagguggagcucaacuucaucuccguguucuggccccagcugcccaacgggcuggaggccgccuacgaguucgccgaccgcgacgagguccgguucuucaagggcaacaaguacugggccgugcagggccagaacgugcuccacggguaccccaaggacaucuacagcuccuucggcuucccgcgcaccgucaagcacaucgacgcggcccugagcgaggagaacaccgggaagaccuacuucuucguggccaacaaguacuggcgguacgacgaguacaagcgcuccauggaccccggcuaccccaagaugaucgcccacgacuuccccgggaucggccacaaggucgacgccguguucaugaaggacggcuucuucuacuucuuccacgggacgcggcaguacaaguucgacccgaagaccaagcgcauccugacccuccagaaggcgaacagcugguucaacugccgcaagaacuga

SEQ ID NO: 219 - RNA, 3357 nt, Artificial Sequence
  derived and/or modified CDS sequence (opt1) from Clostridium histolyticum__BAA77453.1__ColG
augaagaagaacauccugaagauccucauggacagcuacuccaaggagagcaagauccagaccgugcgccgggucaccuccgugagccugcuggccguguaccucacgaugaacaccuccagccugguccuggccaagcccaucgagaacaccaacgacaccuccaucaagaacguggagaagcuccgcaacgcgcccaacgaggagaacagcaagaagguggaggacuccaagaacgacaaggucgagcacgugaagaacaucgaggaggccaagguggagcaggucgcccccgaggugaagagcaaguccacgcugcggagcgccuccaucgccaacaccaacagcgagaaguacgacuucgaguaccugaacggccucuccuacaccgagcugaccaaccugaucaagaacaucaaguggaaccagaucaacgggcucuucaacuacagcacgggcucccagaaguucuucggggacaagaaccgcgugcaggcgaucaucaacgcccugcaggagagcggccggaccuacaccgccaacgacaugaaggggaucgagaccuucacggagguccugcgcgccggcuucuaccucggcuacuacaacgacgggcuguccuaccugaacgaccggaacuuccaggacaagugcauccccgcgaugaucgccauccagaagaaccccaacuucaagcucggcaccgccgugcaggacgaggugaucaccagccuggggaagcugaucggcaacgccagcgccaacgcggaggucgugaacaacugcgugccgguccucaagcaguuccgcgagaaccugaaccaguacgcccccgacuacgugaaggggaccgccgugaacgagcugaucaagggcaucgaguucgacuucuccggcgccgccuacgagaaggacgucaagacgaugcccugguacgggaagaucgaccccuucaucaacgagcucaaggcgcugggccuguacgggaacaucaccagcgccaccgagugggccuccgacgugggcaucuacuaccucagcaaguucggccuguacuccaccaaccggaacgacaucgugcagagccuggagaaggccgucgacauguacaaguacgggaagaucgccuucguggcgauggagcgcaucacgugggacuacgacggcaucggguccaacggcaagaaggucgaccacgacaaguuccucgacgacgccgagaagcacuaccugccgaagaccuacaccuucgacaacgggaccuucaucauccgggccggcgacaaggugagcgaggagaagaucaagcgccuguacugggccucccgggaggugaagagccaguuccaccgcgucgugggcaacgacaaggcccucgagguggggaacgcggacgacguccugacgaugaagaucuucaacucccccgaggaguacaaguucaacaccaacaucaacggcgugagcaccgacaacgggggccuguacaucgagccgcgggggaccuucuacacguacgagcgcaccccgcagcaguccaucuucagccucgaggagcuguuccggcacgaguacacccacuaccugcaggcccgcuaccucguggacggccuguggggccaggggccguucuacgagaagaaccggcugaccugguucgacgagggcacggccgaguucuucgccggguccacccgcaccagcggcguccucccccggaaguccauccugggguaccuggcgaaggacaagguggaccaccgcuacagccucaagaagacccugaacuccggcuacgacgacagcgacuggauguucuacaacuacggcuucgccguggcccacuaccuguacgagaaggacaugcccacguucaucaagaugaacaaggccauccugaacaccgacgucaagagcuacgacgagaucaucaagaagcucuccgacgacgccaacaagaacaccgaguaccagaaccacauccaggagcuggcggacaaguaccagggggccggcaucccccuggugagcgacgacuaccucaaggaccacggguacaagaaggccuccgagguguacagcgagaucuccaaggccgccagccugaccaacaccuccgucacggcggagaagagccaguacuucaacaccuucacccugcgcggcaccuacacgggcgagaccuccaagggggaguucaaggacugggacgagaugagcaagaagcucgacggcacccuggagucccuggccaagaacagcugguccggguacaagacccucacggccuacuucaccaacuaccgggugaccagcgacaacaaggugcaguacgacgucguguuccacggcgugcugaccgacaacgccgacaucuccaacaacaaggccccgaucgcgaaggucacggggcccagcaccggcgccgugggccgcaacaucgaguucuccgggaaggacagcaaggacgaggacggcaagaucgugagcuacgacugggacuucggggacggcgccaccucccgggggaagaacagcguccacgccuacaagaaggcgggcaccuacaacgugacgcugaaggugaccgacgacaagggcgccaccgccaccgaguccuucacgaucgagaucaagaacgaggacaccaccacccccaucacgaaggagauggagcccaacgacgacaucaaggaggccaacgggccgaucgucgagggcgugaccgugaagggggaccucaacggcagcgacgacgccgacaccuucuacuucgacgucaaggaggacggggacgugaccaucgagcugcccuacuccggcagcuccaacuucacguggcugguguacaaggagggcgacgaccagaaccacaucgcgagcgggaucgacaagaacaacuccaaggucggcaccuucaagagcaccaaggggcgccacuacguguucaucuacaagcacgacuccgccagcaacaucuccuacagccucaacaucaagggccuggggaacgagaagcugaaggagaaggagaacaacgacuccagcgacaaggccaccgugauccccaacuucaacacgaccaugcagggcucccuccugggcgacgacagccgggacuacuacuccuucgaggucaaggaggagggggaggugaacaucgagcuggacaagaaggacgaguucggcgugaccuggacccuccaccccgagagcaacaucaacgaccgcaucacguacgggcaggucgacggcaacaaggugagcaacaaggugaagcugcggccgggcaaguacuaccugcucgucuacaaguacuccgggagcggcaacuacgagcugcgcgugaacaaguga

SEQ ID NO: 220 - RNA, 3081 nt, Artificial Sequence
  derived and/or modified CDS sequence (opt1) from Clostridium histolyticum__BAA77453.1__HsALB(1-18)_ColG(111-1118)
augaagugggugaccuucaucagccugcucuuccuguucuccagcgccuacuccaucgccaacaccaacagcgagaaguacgacuucgaguaccugaacggccucuccuacaccgagcugaccaaccugaucaagaacaucaaguggaaccagaucaacgggcucuucaacuacagcacgggcucccagaaguucuucggggacaagaaccgcgugcaggcgaucaucaacgcccugcaggagagcggccggaccuacaccgccaacgacaugaaggggaucgagaccuucacggagguccugcgcgccggcuucuaccucggcuacuacaacgacgggcuguccuaccugaacgaccggaacuuccaggacaagugcauccccgcgaugaucgccauccagaagaaccccaacuucaagcucggcaccgccgugcaggacgaggugaucaccagccuggggaagcugaucggcaacgccagcgccaacgcggaggucgugaacaacugcgugccgguccucaagcaguuccgcgagaaccugaaccaguacgcccccgacuacgugaaggggaccgccgugaacgagcugaucaagggcaucgaguucgacuucuccggcgccgccuacgagaaggacgucaagacgaugcccugguacgggaagaucgaccccuucaucaacgagcucaaggcgcugggccuguacgggaacaucaccagcgccaccgagugggccuccgacgugggcaucuacuaccucagcaaguucggccuguacuccaccaaccggaacgacaucgugcagagccuggagaaggccgucgacauguacaaguacgggaagaucgccuucguggcgauggagcgcaucacgugggacuacgacggcaucggguccaacggcaagaaggucgaccacgacaaguuccucgacgacgccgagaagcacuaccugccgaagaccuacaccuucgacaacgggaccuucaucauccgggccggcgacaaggugagcgaggagaagaucaagcgccuguacugggccucccgggaggugaagagccaguuccaccgcgucgugggcaacgacaaggcccucgagguggggaacgcggacgacguccugacgaugaagaucuucaacucccccgaggaguacaaguucaacaccaacaucaacggcgugagcaccgacaacgggggccuguacaucgagccgcgggggaccuucuacacguacgagcgcaccccgcagcaguccaucuucagccucgaggagcuguuccggcacgaguacacccacuaccugcaggcccgcuaccucguggacggccuguggggccaggggccguucuacgagaagaaccggcugaccugguucgacgagggcacggccgaguucuucgccggguccacccgcaccagcggcguccucccccggaaguccauccugggguaccuggcgaaggacaagguggaccaccgcuacagccucaagaagacccugaacuccggcuacgacgacagcgacuggauguucuacaacuacggcuucgccguggcccacuaccuguacgagaaggacaugcccacguucaucaagaugaacaaggccauccugaacaccgacgucaagagcuacgacgagaucaucaagaagcucuccgacgacgccaacaagaacaccgaguaccagaaccacauccaggagcuggcggacaaguaccagggggccggcaucccccuggugagcgacgacuaccucaaggaccacggguacaagaaggccuccgagguguacagcgagaucuccaaggccgccagccugaccaacaccuccgucacggcggagaagagccaguacuucaacaccuucacccugcgcggcaccuacacgggcgagaccuccaagggggaguucaaggacugggacgagaugagcaagaagcucgacggcacccuggagucccuggccaagaacagcugguccggguacaagacccucacggccuacuucaccaacuaccgggugaccagcgacaacaaggugcaguacgacgucguguuccacggcgugcugaccgacaacgccgacaucuccaacaacaaggccccgaucgcgaaggucacggggcccagcaccggcgccgugggccgcaacaucgaguucuccgggaaggacagcaaggacgaggacggcaagaucgugagcuacgacugggacuucggggacggcgccaccucccgggggaagaacagcguccacgccuacaagaaggcgggcaccuacaacgugacgcugaaggugaccgacgacaagggcgccaccgccaccgaguccuucacgaucgagaucaagaacgaggacaccaccacccccaucacgaaggagauggagcccaacgacgacaucaaggaggccaacgggccgaucgucgagggcgugaccgugaagggggaccucaacggcagcgacgacgccgacaccuucuacuucgacgucaaggaggacggggacgugaccaucgagcugcccuacuccggcagcuccaacuucacguggcugguguacaaggagggcgacgaccagaaccacaucgcgagcgggaucgacaagaacaacuccaaggucggcaccuucaagagcaccaaggggcgccacuacguguucaucuacaagcacgacuccgccagcaacaucuccuacagccucaacaucaagggccuggggaacgagaagcugaaggagaaggagaacaacgacuccagcgacaaggccaccgugauccccaacuucaacacgaccaugcagggcucccuccugggcgacgacagccgggacuacuacuccuucgaggucaaggaggagggggaggugaacaucgagcuggacaagaaggacgaguucggcgugaccuggacccuccaccccgagagcaacaucaacgaccgcaucacguacgggcaggucgacggcaacaaggugagcaacaaggugaagcugcggccgggcaaguacuaccugcucgucuacaaguacuccgggagcggcaacuacgagcugcgcgugaacaaguga

SEQ ID NO: 221 - RNA, 3429 nt, Artificial Sequence
  derived and/or modified CDS sequence (opt1) from Clostridium histolyticum__BAA77453.1__HsALB(1-18)_ColG(1-110)_CS-F_ColG(111-1 118)
augaagugggugaccuucaucagccugcucuuccuguucuccagcgccuacuccaugaagaagaacauccugaagauccucauggacagcuacuccaaggagagcaagauccagaccgugcgccgggucaccuccgugagccugcuggccguguaccucacgaugaacaccuccagccugguccuggccaagcccaucgagaacaccaacgacaccuccaucaagaacguggagaagcuccgcaacgcgcccaacgaggagaacagcaagaagguggaggacuccaagaacgacaaggucgagcacgugaagaacaucgaggaggccaagguggagcaggucgcccccgaggugaagagcaaguccacgcugcggagcgccucccgccggcgccggaagcgcaucgccaacaccaacagcgagaaguacgacuucgaguaccugaacggccucuccuacaccgagcugaccaaccugaucaagaacaucaaguggaaccagaucaacgggcucuucaacuacagcacgggcucccagaaguucuucggggacaagaaccgcgugcaggcgaucaucaacgcccugcaggagagcggccggaccuacaccgccaacgacaugaaggggaucgagaccuucacggagguccugcgcgccggcuucuaccucggcuacuacaacgacgggcuguccuaccugaacgaccggaacuuccaggacaagugcauccccgcgaugaucgccauccagaagaaccccaacuucaagcucggcaccgccgugcaggacgaggugaucaccagccuggggaagcugaucggcaacgccagcgccaacgcggaggucgugaacaacugcgugccgguccucaagcaguuccgcgagaaccugaaccaguacgcccccgacuacgugaaggggaccgccgugaacgagcugaucaagggcaucgaguucgacuucuccggcgccgccuacgagaaggacgucaagacgaugcccugguacgggaagaucgaccccuucaucaacgagcucaaggcgcugggccuguacgggaacaucaccagcgccaccgagugggccuccgacgugggcaucuacuaccucagcaaguucggccuguacuccaccaaccggaacgacaucgugcagagccuggagaaggccgucgacauguacaaguacgggaagaucgccuucguggcgauggagcgcaucacgugggacuacgacggcaucggguccaacggcaagaaggucgaccacgacaaguuccucgacgacgccgagaagcacuaccugccgaagaccuacaccuucgacaacgggaccuucaucauccgggccggcgacaaggugagcgaggagaagaucaagcgccuguacugggccucccgggaggugaagagccaguuccaccgcgucgugggcaacgacaaggcccucgagguggggaacgcggacgacguccugacgaugaagaucuucaacucccccgaggaguacaaguucaacaccaacaucaacggcgugagcaccgacaacgggggccuguacaucgagccgcgggggaccuucuacacguacgagcgcaccccgcagcaguccaucuucagccucgaggagcuguuccggcacgaguacacccacuaccugcaggcccgcuaccucguggacggccuguggggccaggggccguucuacgagaagaaccggcugaccugguucgacgagggcacggccgaguucuucgccggguccacccgcaccagcggcguccucccccggaaguccauccugggguaccuggcgaaggacaagguggaccaccgcuacagccucaagaagacccugaacuccggcuacgacgacagcgacuggauguucuacaacuacggcuucgccguggcccacuaccuguacgagaaggacaugcccacguucaucaagaugaacaaggccauccugaacaccgacgucaagagcuacgacgagaucaucaagaagcucuccgacgacgccaacaagaacaccgaguaccagaaccacauccaggagcuggcggacaaguaccagggggccggcaucccccuggugagcgacgacuaccucaaggaccacggguacaagaaggccuccgagguguacagcgagaucuccaaggccgccagccugaccaacaccuccgucacggcggagaagagccaguacuucaacaccuucacccugcgcggcaccuacacgggcgagaccuccaagggggaguucaaggacugggacgagaugagcaagaagcucgacggcacccuggagucccuggccaagaacagcugguccggguacaagacccucacggccuacuucaccaacuaccgggugaccagcgacaacaaggugcaguacgacgucguguuccacggcgugcugaccgacaacgccgacaucuccaacaacaaggccccgaucgcgaaggucacggggcccagcaccggcgccgugggccgcaacaucgaguucuccgggaaggacagcaaggacgaggacggcaagaucgugagcuacgacugggacuucggggacggcgccaccucccgggggaagaacagcguccacgccuacaagaaggcgggcaccuacaacgugacgcugaaggugaccgacgacaagggcgccaccgccaccgaguccuucacgaucgagaucaagaacgaggacaccaccacccccaucacgaaggagauggagcccaacgacgacaucaaggaggccaacgggccgaucgucgagggcgugaccgugaagggggaccucaacggcagcgacgacgccgacaccuucuacuucgacgucaaggaggacggggacgugaccaucgagcugcccuacuccggcagcuccaacuucacguggcugguguacaaggagggcgacgaccagaaccacaucgcgagcgggaucgacaagaacaacuccaaggucggcaccuucaagagcaccaaggggcgccacuacguguucaucuacaagcacgacuccgccagcaacaucuccuacagccucaacaucaagggccuggggaacgagaagcugaaggagaaggagaacaacgacuccagcgacaaggccaccgugauccccaacuucaacacgaccaugcagggcucccuccugggcgacgacagccgggacuacuacuccuucgaggucaaggaggagggggaggugaacaucgagcuggacaagaaggacgaguucggcgugaccuggacccuccaccccgagagcaacaucaacgaccgcaucacguacgggcaggucgacggcaacaaggugagcaacaaggugaagcugcggccgggcaaguacuaccugcucgucuacaaguacuccgggagcggcaacuacgagcugcgcgugaacaaguga

SEQ ID NO: 222 - RNA, 3105 nt, Artificial Sequence
  derived and/or modified CDS sequence (opt1) from Clostridium histolyticum__BAA34542.1__ColH
augaacuuccugaagaucauccucaaccgcggcaagaccaugaagcggaagugccugagcaagcgccugaugcucgccaucaccauggccacgaucuucaccgugaacuccacccugcccaucuacgcggccgucgacaagaacaacgccaccgccgccgugcagaacgagagcaagcgguacacgguguccuaccugaagacccucaacuacuacgaccuggucgaccugcucgugaagaccgagaucgagaaccugccggaccuguuccaguacagcuccgacgcgaaggaguucuacgggaacaagacccgcaugagcuucaucauggacgagaucggccggcgcgcgccccaguacacggagaucgaccacaaggggauccccacccucguggaggucgugcgggccggcuucuaccugggguuccacaacaaggagcugaacgagaucaacaagcgcuccuucaaggagcgggugauccccagcauccucgccauccagaagaacccgaacuucaagcugggcaccgagguccaggacaagaucguguccgccaccggccugcucgccgggaacgagacggccccgcccgagguggucaacaacuucacccccauccugcaggacugcaucaagaacaucgaccgcuacgcccuggacgaccucaagagcaaggcccuguucaacgugcuggcggccccgaccuacgacaucaccgaguaccuccgggccacgaaggagaagcccgagaacacccccugguacggcaagaucgacggguucaucaacgagcugaagaagcuggcccucuacggcaagaucaacgacaacaacuccuggaucaucgacaacgggaucuaccacaucgcgccccugggcaagcugcacagcaacaacaagaucggcaucgagacccucaccgaggugaugaaggucuacccguaccuguccaugcagcaccuccagagcgccgaccagaucaagcgccacuacgacuccaaggacgccgaggggaacaagaucccccuggacaaguucaagaaggagggcaaggagaaguacugccccaagacguacaccuucgacgacgggaaggugaucaucaaggccggcgcccggguggaggaggagaaggucaagcgccuguacugggccagcaaggaggugaacucccaguucuuccggguguacggcaucgacaagccccuggaggaggggaacccggacgacauccucaccauggucaucuacaacagccccgaggaguacaagcugaacuccgugcuguacggcuacgacaccaacaacgggggcauguacaucgagcccgaggggacguucuucaccuacgagcgcgaggcgcaggagagcaccuacacccucgaggagcuguuccggcacgaguacacgcacuaccugcagggccgcuacgccgugcccggccagugggggcggaccaagcucuacgacaacgaccgccugaccugguacgaggagggcggggccgagcuguucgccggcagcacccggacguccgggauccucccgcgcaagagcaucgucuccaacauccacaacaccacccgcaacaaccgguacaagcugagcgacaccgugcacuccaaguacggcgccagcuucgaguucuacaacuacgcgugcauguucauggacuacauguacaacaaggacaugggcauccugaacaagcucaacgaccuggccaagaacaacgacgucgacggguacgacaacuacauccgcgaccuguccagcaacuacgcccugaacgacaaguaccaggaccacaugcaggagcggaucgacaacuacgagaaccucacggugcccuucguggccgacgacuaccugguccgccacgcguacaagaaccccaacgagaucuacuccgagaucagcgagguggccaagcugaaggacgccaaguccgaggugaagaagucccaguacuucagcaccuucacccuccggggcagcuacaccgggggcgccuccaaggggaagcuggaggaccagaaggccaugaacaaguucaucgacgacagccugaagaagcucgacaccuacuccuggagcggcuacaagacgcugaccgcguacuucaccaacuacaaggucgacuccagcaaccgcgugaccuacgacguggucuuccacggcuaccugcccaacgagggggacagcaagaacucccucccguacggcaagaucaacgggacguacaagggcaccgagaaggagaagaucaaguucagcuccgagggcagcuucgaccccgacgggaagaucguguccuacgagugggacuucggcgacgggaacaagagcaacgaggagaaccccgagcacuccuacgacaaggugggcaccuacaccgucaagcugaaggugacggacgacaagggggagagcuccgugagcaccaccaccgccgagaucaaggaccuguccgagaacaagcuccccgucaucuacaugcacgugcccaagagcggcgcccugaaccagaagguggucuucuacggcaaggggacguacgaccccgacggcuccaucgccggguaccagugggacuucggcgacgggagcgacuucuccagcgagcagaaccccucccacguguacaccaagaagggcgaguacaccgugacccugcgggucauggacagcagcggccagauguccgagaagacgaugaagaucaagaucaccgacccgguguaccccaucgggaccgagaaggagcccaacaacagcaaggagaccgccuccggccccaucgugccggggauccccgucagcggcacgaucgagaacaccuccgaccaggacuacuucuacuucgacgugaucacccccggggaggugaagaucgacaucaacaagcucggcuacggcggggcgaccugggucguguacgacgagaacaacaacgccgugagcuacgccacggacgacggccagaaccuguccgggaaguucaaggccgacaagcccggccgcuacuacauccaccuguacauguucaacgggagcuacaugccguaccggaucaacaucgagggcuccgucggccgcuga

SEQ ID NO: 223 - RNA, 3066 nt, Artificial Sequence
  derived and/or modified CDS sequence (opt1) from Clostridium histolyticum__BAA34542.1__ColH
augaagcgcaagugccugagcaagcggcucaugcuggccaucaccauggccaccaucuucacggugaacuccacccugcccaucuacgcggccgucgacaagaacaacgccaccgccgccgugcagaacgagagcaagcgcuacaccguguccuaccucaagacgcugaacuacuacgaccuggucgaccuccuggugaagaccgagaucgagaaccugcccgaccucuuccaguacagcuccgacgcgaaggaguucuacggcaacaagacccggaugagcuucaucauggacgagaucgggcgccgggccccgcaguacaccgagaucgaccacaagggcauccccacgcugguggaggucgugcgcgccggguucuaccugggcuuccacaacaaggagcucaacgagaucaacaagcgguccuucaaggagcgcgugauccccagcauccuggccauccagaagaacccgaacuucaagcuggggaccgagguccaggacaagaucguguccgcgaccggccuccuggccggcaacgagaccgccccgcccgagguggucaacaacuucacgcccauccugcaggacugcaucaagaacaucgaccgguacgcccucgacgaccugaagagcaaggcccuguucaacgugcucgcggccccgaccuacgacaucaccgaguaccugcgcgccaccaaggagaagcccgagaacacgccgugguacgggaagaucgacggcuucaucaacgagcugaagaagcucgcccuguacgggaagaucaacgacaacaacuccuggaucaucgacaacggcaucuaccacaucgccccccuggggaagcuccacagcaacaacaagaucggcaucgagacccugaccgaggugaugaaggucuacccguaccuguccaugcagcaccuccagagcgcggaccagaucaagcggcacuacgacuccaaggacgccgagggcaacaagaucccccuggacaaguucaagaaggaggggaaggagaaguacugccccaagaccuacacguucgacgacggcaaggugaucaucaaggccggggcccgcguggaggaggagaaggucaagcggcuguacugggccagcaaggaggugaacucccaguucuuccgcguguacggcaucgacaagccccucgaggagggcaacccggacgacauccugaccauggucaucuacaacagccccgaggaguacaagcugaacuccgugcucuacggguacgacaccaacaacggcgggauguacaucgagcccgagggcaccuucuucacguacgagcgggaggcgcaggagagcaccuacacccuggaggagcuguuccgccacgaguacacccacuaccuccaggggcgguacgccgugcccggccaguggggccgcacgaagcuguacgacaacgaccggcugaccugguacgaggagggcggcgccgagcucuucgccgggagcacccgcaccuccgggauccugccgcggaagagcaucgucuccaacauccacaacacgacccgcaacaaccgcuacaagcugagcgacaccgugcacuccaaguacggggccagcuucgaguucuacaacuacgcgugcauguucauggacuacauguacaacaaggacaugggcauccucaacaagcugaacgaccuggccaagaacaacgacgucgacggcuacgacaacuacauccgggaccuguccagcaacuacgcccucaacgacaaguaccaggaccacaugcaggagcgcaucgacaacuacgagaaccugaccgugcccuucguggccgacgacuaccugguccggcacgcguacaagaaccccaacgagaucuacuccgagaucagcgagguggccaagcucaaggacgccaaguccgaggugaagaagagccaguacuucuccacguucacccugcgcgggagcuacaccggcggggccuccaagggcaagcuggaggaccagaaggccaugaacaaguucaucgacgacagccucaagaagcuggacaccuacuccuggagcggguacaagacccugacggcguacuucaccaacuacaaggucgacuccagcaaccgggugaccuacgacguggucuuccacggcuaccuccccaacgagggcgacagcaagaacucccugccguacgggaagaucaacggcaccuacaaggggacggagaaggagaagaucaaguucagcuccgagggcagcuucgaccccgacggcaagaucguguccuacgagugggacuucggggacggcaacaagagcaacgaggagaaccccgagcacuccuacgacaagguggggaccuacaccgucaagcugaaggugaccgacgacaagggcgagagcuccgugagcacgaccaccgccgagaucaaggaccucuccgagaacaagcugcccgucaucuacaugcacgugccgaagagcggggcccugaaccagaagguggucuucuacggcaagggcaccuacgaccccgacggguccaucgccggcuaccagugggacuucggggacggcagcgacuucuccagcgagcagaaccccucccacguguacacgaagaagggggaguacaccgugacccuccgcgucauggacagcagcggccagauguccgagaagaccaugaagaucaagaucacggacccgguguaccccaucggcaccgagaaggagcccaacaacagcaaggagaccgccuccgggcccaucgugccgggcauccccgucagcgggaccaucgagaacacguccgaccaggacuacuucuacuucgacgugaucacccccggcgaggugaagaucgacaucaacaagcugggguacggcggcgcgaccugggucguguacgacgagaacaacaacgccgugagcuacgccaccgacgacgggcagaaccuguccggcaaguucaaggccgacaagcccgggcgguacuacauccaccucuacauguucaacggcagcuacaugccguaccgcaucaacaucgagggguccgucggccgguga

SEQ ID NO: 224 - RNA, 3000 nt, Artificial Sequence
  derived and/or modified CDS sequence (opt1) from Clostridium histolyticum__BAA34542.1__HsALB(1-18)_ColH(41-1021)
augaagugggugaccuucaucagccugcucuuccuguucuccagcgccuacuccgugcagaacgagagcaagcgcuacaccguguccuaccucaagacgcugaacuacuacgaccuggucgaccuccuggugaagaccgagaucgagaaccugcccgaccucuuccaguacagcuccgacgcgaaggaguucuacggcaacaagacccggaugagcuucaucauggacgagaucgggcgccgggccccgcaguacaccgagaucgaccacaagggcauccccacgcugguggaggucgugcgcgccggguucuaccugggcuuccacaacaaggagcucaacgagaucaacaagcgguccuucaaggagcgcgugauccccagcauccuggccauccagaagaacccgaacuucaagcuggggaccgagguccaggacaagaucguguccgcgaccggccuccuggccggcaacgagaccgccccgcccgagguggucaacaacuucacgcccauccugcaggacugcaucaagaacaucgaccgguacgcccucgacgaccugaagagcaaggcccuguucaacgugcucgcggccccgaccuacgacaucaccgaguaccugcgcgccaccaaggagaagcccgagaacacgccgugguacgggaagaucgacggcuucaucaacgagcugaagaagcucgcccuguacgggaagaucaacgacaacaacuccuggaucaucgacaacggcaucuaccacaucgccccccuggggaagcuccacagcaacaacaagaucggcaucgagacccugaccgaggugaugaaggucuacccguaccuguccaugcagcaccuccagagcgcggaccagaucaagcggcacuacgacuccaaggacgccgagggcaacaagaucccccuggacaaguucaagaaggaggggaaggagaaguacugccccaagaccuacacguucgacgacggcaaggugaucaucaaggccggggcccgcguggaggaggagaaggucaagcggcuguacugggccagcaaggaggugaacucccaguucuuccgcguguacggcaucgacaagccccucgaggagggcaacccggacgacauccugaccauggucaucuacaacagccccgaggaguacaagcugaacuccgugcucuacggguacgacaccaacaacggcgggauguacaucgagcccgagggcaccuucuucacguacgagcgggaggcgcaggagagcaccuacacccuggaggagcuguuccgccacgaguacacccacuaccuccaggggcgguacgccgugcccggccaguggggccgcacgaagcuguacgacaacgaccggcugaccugguacgaggagggcggcgccgagcucuucgccgggagcacccgcaccuccgggauccugccgcggaagagcaucgucuccaacauccacaacacgacccgcaacaaccgcuacaagcugagcgacaccgugcacuccaaguacggggccagcuucgaguucuacaacuacgcgugcauguucauggacuacauguacaacaaggacaugggcauccucaacaagcugaacgaccuggccaagaacaacgacgucgacggcuacgacaacuacauccgggaccuguccagcaacuacgcccucaacgacaaguaccaggaccacaugcaggagcgcaucgacaacuacgagaaccugaccgugcccuucguggccgacgacuaccugguccggcacgcguacaagaaccccaacgagaucuacuccgagaucagcgagguggccaagcucaaggacgccaaguccgaggugaagaagagccaguacuucuccacguucacccugcgcgggagcuacaccggcggggccuccaagggcaagcuggaggaccagaaggccaugaacaaguucaucgacgacagccucaagaagcuggacaccuacuccuggagcggguacaagacccugacggcguacuucaccaacuacaaggucgacuccagcaaccgggugaccuacgacguggucuuccacggcuaccuccccaacgagggcgacagcaagaacucccugccguacgggaagaucaacggcaccuacaaggggacggagaaggagaagaucaaguucagcuccgagggcagcuucgaccccgacggcaagaucguguccuacgagugggacuucggggacggcaacaagagcaacgaggagaaccccgagcacuccuacgacaagguggggaccuacaccgucaagcugaaggugaccgacgacaagggcgagagcuccgugagcacgaccaccgccgagaucaaggaccucuccgagaacaagcugcccgucaucuacaugcacgugccgaagagcggggcccugaaccagaagguggucuucuacggcaagggcaccuacgaccccgacggguccaucgccggcuaccagugggacuucggggacggcagcgacuucuccagcgagcagaaccccucccacguguacacgaagaagggggaguacaccgugacccuccgcgucauggacagcagcggccagauguccgagaagaccaugaagaucaagaucacggacccgguguaccccaucggcaccgagaaggagcccaacaacagcaaggagaccgccuccgggcccaucgugccgggcauccccgucagcgggaccaucgagaacacguccgaccaggacuacuucuacuucgacgugaucacccccggcgaggugaagaucgacaucaacaagcugggguacggcggcgcgaccugggucguguacgacgagaacaacaacgccgugagcuacgccaccgacgacgggcagaaccuguccggcaaguucaaggccgacaagcccgggcgguacuacauccaccucuacauguucaacggcagcuacaugccguaccgcaucaacaucgagggguccgucggccgguga

SEQ ID NO: 225 - RNA, 3138 nt, Artificial Sequence
  derived and/or modified CDS sequence (opt1) from Clostridium histolyticum__BAA34542.1__HsALB(1-18)_ColH(1-40)_CS-F_ColH(41-102 1)
augaagugggugaccuucaucagccugcucuuccuguucuccagcgccuacuccaugaagcgcaagugccugagcaagcggcucaugcuggccaucaccauggccaccaucuucacggugaacuccacccugcccaucuacgcggccgucgacaagaacaacgccaccgccgcccgccggcgccggaagcgcgugcagaacgagagcaagcgcuacaccguguccuaccucaagacgcugaacuacuacgaccuggucgaccuccuggugaagaccgagaucgagaaccugcccgaccucuuccaguacagcuccgacgcgaaggaguucuacggcaacaagacccggaugagcuucaucauggacgagaucgggcgccgggccccgcaguacaccgagaucgaccacaagggcauccccacgcugguggaggucgugcgcgccggguucuaccugggcuuccacaacaaggagcucaacgagaucaacaagcgguccuucaaggagcgcgugauccccagcauccuggccauccagaagaacccgaacuucaagcuggggaccgagguccaggacaagaucguguccgcgaccggccuccuggccggcaacgagaccgccccgcccgagguggucaacaacuucacgcccauccugcaggacugcaucaagaacaucgaccgguacgcccucgacgaccugaagagcaaggcccuguucaacgugcucgcggccccgaccuacgacaucaccgaguaccugcgcgccaccaaggagaagcccgagaacacgccgugguacgggaagaucgacggcuucaucaacgagcugaagaagcucgcccuguacgggaagaucaacgacaacaacuccuggaucaucgacaacggcaucuaccacaucgccccccuggggaagcuccacagcaacaacaagaucggcaucgagacccugaccgaggugaugaaggucuacccguaccuguccaugcagcaccuccagagcgcggaccagaucaagcggcacuacgacuccaaggacgccgagggcaacaagaucccccuggacaaguucaagaaggaggggaaggagaaguacugccccaagaccuacacguucgacgacggcaaggugaucaucaaggccggggcccgcguggaggaggagaaggucaagcggcuguacugggccagcaaggaggugaacucccaguucuuccgcguguacggcaucgacaagccccucgaggagggcaacccggacgacauccugaccauggucaucuacaacagccccgaggaguacaagcugaacuccgugcucuacggguacgacaccaacaacggcgggauguacaucgagcccgagggcaccuucuucacguacgagcgggaggcgcaggagagcaccuacacccuggaggagcuguuccgccacgaguacacccacuaccuccaggggcgguacgccgugcccggccaguggggccgcacgaagcuguacgacaacgaccggcugaccugguacgaggagggcggcgccgagcucuucgccgggagcacccgcaccuccgggauccugccgcggaagagcaucgucuccaacauccacaacacgacccgcaacaaccgcuacaagcugagcgacaccgugcacuccaaguacggggccagcuucgaguucuacaacuacgcgugcauguucauggacuacauguacaacaaggacaugggcauccucaacaagcugaacgaccuggccaagaacaacgacgucgacggcuacgacaacuacauccgggaccuguccagcaacuacgcccucaacgacaaguaccaggaccacaugcaggagcgcaucgacaacuacgagaaccugaccgugcccuucguggccgacgacuaccugguccggcacgcguacaagaaccccaacgagaucuacuccgagaucagcgagguggccaagcucaaggacgccaaguccgaggugaagaagagccaguacuucuccacguucacccugcgcgggagcuacaccggcggggccuccaagggcaagcuggaggaccagaaggccaugaacaaguucaucgacgacagccucaagaagcuggacaccuacuccuggagcggguacaagacccugacggcguacuucaccaacuacaaggucgacuccagcaaccgggugaccuacgacguggucuuccacggcuaccuccccaacgagggcgacagcaagaacucccugccguacgggaagaucaacggcaccuacaaggggacggagaaggagaagaucaaguucagcuccgagggcagcuucgaccccgacggcaagaucguguccuacgagugggacuucggggacggcaacaagagcaacgaggagaaccccgagcacuccuacgacaagguggggaccuacaccgucaagcugaaggugaccgacgacaagggcgagagcuccgugagcacgaccaccgccgagaucaaggaccucuccgagaacaagcugcccgucaucuacaugcacgugccgaagagcggggcccugaaccagaagguggucuucuacggcaagggcaccuacgaccccgacggguccaucgccggcuaccagugggacuucggggacggcagcgacuucuccagcgagcagaaccccucccacguguacacgaagaagggggaguacaccgugacccuccgcgucauggacagcagcggccagauguccgagaagaccaugaagaucaagaucacggacccgguguaccccaucggcaccgagaaggagcccaacaacagcaaggagaccgccuccgggcccaucgugccgggcauccccgucagcgggaccaucgagaacacguccgaccaggacuacuucuacuucgacgugaucacccccggcgaggugaagaucgacaucaacaagcugggguacggcggcgcgaccugggucguguacgacgagaacaacaacgccgugagcuacgccaccgacgacgggcagaaccuguccggcaaguucaaggccgacaagcccgggcgguacuacauccaccucuacauguucaacggcagcuacaugccguaccgcaucaacaucgagggguccgucggccgguga

SEQ ID NO: 226 - RNA, 576 nt, Artificial Sequence
  derived and/or modified CDS sequence (opt1) from Homo sapiens__NP_001133.1__HsAMELX
augggcaccuggauccuguucgccugccuccugggggccgcguucgccaugccccugccgccccaccccggccaccccggguacaucaacuucagcuacgaggugcucaccccgcugaagugguaccaguccauccgcccgcccuaccccagcuacggcuacgagcccaugggcggguggcugcaccaccagaucauccccguccucucccagcagcacccgcccacgcacacccugcagccgcaccaccacauccccguggugcccgcccagcagcccgucaucccccagcagcccaugaugcccgugcccggccagcacagcaugaccccgauccagcaccaccagcccaaccugcccccgccggcccagcagcccuaccagccccagcccgugcagccccagccccaccagcccaugcagccgcagccgcccguccaccccaugcagccgcucccgccccagcccccgcugccgcccauguuccccaugcagccccugccgcccaugcuccccgaccugacccuggaggccuggcccuccacggacaagaccaagcgggaggagguggacuga

SEQ ID NO: 227 - RNA, 135 nt, Artificial Sequence
  derived and/or modified CDS sequence (opt1) from Homo sapiens__NP_001133.1__HsAMELX-TRAP
augccccugccgccccaccccggccaccccggguacaucaacuucagcuacgaggugcucaccccgcugaagugguaccaguccauccgcccgcccuaccccagcuacggcuacgagcccaugggcgggugguga

SEQ ID NO: 228 - RNA, 168 nt, Artificial Sequence
  derived and/or modified CDS sequence (opt1) from Homo sapiens__NP_001133.1__HsAMELX-LRAP
augccccugccgccccaccccggccaccccggguacaucaacuucagcuacgaggugcucaccccgcugaagugguaccaguccauccgcccgccgcccaugcuccccgaccugacccuggaggccuggcccuccacggacaagaccaagcgggaggagguggacuga

SEQ ID NO: 229 - RNA, 207 nt, Artificial Sequence
  derived and/or modified CDS sequence (opt1) from Homo sapiens__NP_001133.1__HLA-A2-SP_HsAMELX(17-60)
auggccgugauggccccgcggacccugguccuccugcugagcggcgcgcucgcccugacccagacgugggccaugccccugccgccccaccccggccaccccggguacaucaacuucagcuacgaggugcucaccccgcugaagugguaccaguccauccgcccgcccuaccccagcuacggcuacgagcccaugggcgggugguga

SEQ ID NO: 230 - RNA, 240 nt, Artificial Sequence
  derived and/or modified CDS sequence (opt1) from Homo sapiens__NP_001133.1__HLA-A2-SP_HsAMELX(17-47,168-191)
auggccgugauggccccgcggacccugguccuccugcugagcggcgcgcucgcccugacccagacgugggccaugccccugccgccccaccccggccaccccggguacaucaacuucagcuacgaggugcucaccccgcugaagugguaccaguccauccgcccgccgcccaugcuccccgaccugacccuggaggccuggcccuccacggacaagaccaagcgggaggagguggacuga

SEQ ID NO: 231 - RNA, 579 nt, Artificial Sequence
  derived and/or modified CDS sequence (opt1) from Homo sapiens__NP_001134.1__HsAMELY
augggcaccuggauccuguucgccugccucgugggggccgcguucgccaugccccugccgccccaccccggccaccccggguacaucaacuucagcuacgagguccugaccccgcucaagugguaccaguccaugauccgcccgcccuacagcuccuacggcuacgagcccaugggcggguggcugcaccaccagaucauccccguggugagccagcagcacccccugacgcacacccuccagucccaccaccacauccccgucgugcccgcccagcagccgcgggugcgccagcaggcccugaugcccguccccggccagcagagcaugacccccacccagcaccaccagccgaaccugccccuccccgcccagcagcccuuccagccgcagcccgugcagccccagccccaccagccgaugcagccccagccgcccgugcagcccaugcagccccugcugccccagccgccccucccgcccauguucccccugcggccccugccgcccauccuccccgaccugcaccuggaggcguggcccgccacggacaagaccaagcaggaggaggucgacuga

SEQ ID NO: 232 - RNA, 138 nt, Artificial Sequence
  derived and/or modified CDS sequence (opt1) from Homo sapiens__NP_001134.1__HsAMELY-TRAP
augccccugccgccccaccccggccaccccggguacaucaacuucagcuacgagguccugaccccgcucaagugguaccaguccaugauccgcccgcccuacagcuccuacggcuacgagcccaugggcgggugguga

SEQ ID NO: 233 - RNA, 171 nt, Artificial Sequence
  derived and/or modified CDS sequence (opt1) from Homo sapiens__NP_001134.1__HsAMELY-LRAP
augccccugccgccccaccccggccaccccggguacaucaacuucagcuacgagguccugaccccgcucaagugguaccaguccaugauccgcccgccgcccauccuccccgaccugcaccuggaggcguggcccgccacggacaagaccaagcaggaggaggucgacuga

SEQ ID NO: 234 - RNA, 210 nt, Artificial Sequence
  derived and/or modified CDS sequence (opt1) from Homo sapiens__NP_001134.1__HLA-A2-SP_HsAMELY(17-61)
auggccgugauggccccgcggacccugguccuccugcugagcggcgcgcucgcccugacccagacgugggccaugccccugccgccccaccccggccaccccggguacaucaacuucagcuacgagguccugaccccgcucaagugguaccaguccaugauccgcccgcccuacagcuccuacggcuacgagcccaugggcgggugguga

SEQ ID NO: 235 - RNA, 243 nt, Artificial Sequence
  derived and/or modified CDS sequence (opt1) from Homo sapiens__NP_001134.1__HLA-A2-SP_HsAMELY(17-48,169-192)
auggccgugauggccccgcggacccugguccuccugcugagcggcgcgcucgcccugacccagacgugggccaugccccugccgccccaccccggccaccccggguacaucaacuucagcuacgagguccugaccccgcucaagugguaccaguccaugauccgcccgccgcccauccuccccgaccugcaccuggaggcguggcccgccacggacaagaccaagcaggaggaggucgacuga

SEQ ID NO: 236 - RNA, 570 nt, Artificial Sequence
  derived and/or modified CDS sequence (opt1) from Sus scrofa__NP_999071.1__SsAMELX-001-1
augggcaccuggauccuguucgccugccuccugggggccgcguucagcaugccccugccgccccaccccggccaccccggguacaucaacuucuccuacgaggugcucaccccgcugaagugguaccagaacaugauccgccaccccuacacgagcuacggcuacgagcccaugggcggguggcugcaccaccagaucauccccgucgugucccagcagaccccgcagagccacgcccuccagccccaccaccacauccccauggugcccgcccagcagccgggcaucccccagcagcccaugaugccccugccggggcagcacuccaugacccccacccagcaccaccagcccaaccugccccucccggcccagcagcccuuccagccccagcccguccagccgcagccccaccagccccugcagccccagagcccgaugcaccccauccagccccugcucccgcagccgccccugcccccgauguucuccaugcagagccugcuccccgaccugccccuggaggccuggcccgcgacggacaagaccaagcgggaggagguggacuga

SEQ ID NO: 237 - RNA, 138 nt, Artificial Sequence
  derived and/or modified CDS sequence (opt1) from Sus scrofa__NP_999071.1__SsAMELX-TRAP
augccccugccgccccaccccggccaccccggguacaucaacuucuccuacgaggugcucaccccgcugaagugguaccagaacaugauccgccaccccuacacgagcuacggcuacgagcccaugggcgggugguga

SEQ ID NO: 238 - RNA, 171 nt, Artificial Sequence
  derived and/or modified CDS sequence (opt1) from Sus scrofa__NP_999071.1__SsAMELX-LRAP
augccccugccgccccaccccggccaccccggguacaucaacuucuccuacgaggugcucaccccgcugaagugguaccagaacaugauccgccaccccagccugcuccccgaccugccccuggaggccuggcccgcgacggacaagaccaagcgggaggagguggacuga

SEQ ID NO: 239 - RNA, 210 nt, Artificial Sequence
  derived and/or modified CDS sequence (opt1) from Sus scrofa__NP_999071.1__HLA-A2-SP_SsAMEL(17-61)
auggccgugauggccccgcggacccugguccuccugcugagcggcgcgcucgcccugacccagacgugggccaugccccugccgccccaccccggccaccccggguacaucaacuucuccuacgaggugcucaccccgcugaagugguaccagaacaugauccgccaccccuacacgagcuacggcuacgagcccaugggcgggugguga

SEQ ID NO: 240 - RNA, 243 nt, Artificial Sequence
  derived and/or modified CDS sequence (opt1) from Sus scrofa__NP_999071.1__HLA-A2-SP_SsAMEL(17-49,167-189)
auggccgugauggccccgcggacccugguccuccugcugagcggcgcgcucgcccugacccagacgugggccaugccccugccgccccaccccggccaccccggguacaucaacuucuccuacgaggugcucaccccgcugaagugguaccagaacaugauccgccaccccagccugcuccccgaccugccccuggaggccuggcccgcgacggacaagaccaagcgggaggagguggacuga

SEQ ID NO: 241 - RNA, 534 nt, Artificial Sequence
  derived and/or modified CDS sequence (opt1) from Sus scrofa__P45561-2__SsAMELX-001-2
augggcaccuggauccuguucgccugccuccugggggccgcguucagcaugccccugccgccccaccccggccaccccggguacaucaacuucuccuacauccgccacccguacaccagcuacggcuacgagcccaugggcggguggcuccaccaccagaucauccccguggucucccagcagacgccccagagccacgcccugcagccgcaccaccacauccccauggugcccgcccagcagcccggcaucccgcagcagcccaugaugccccugcccgggcagcacuccaugaccccgacccagcaccaccagcccaaccucccccugcccgcccagcagccguuccagccccagcccgugcagccccagccgcaccagccccugcagccccagagccccaugcacccgauccagccccuccugccccagccgccccugccgcccauguucuccaugcagagccuccugcccgaccugccccucgaggccuggcccgcgaccgacaagacgaagcgggaggaggucgacuga

SEQ ID NO: 242 - RNA, 570 nt, Artificial Sequence
  derived and/or modified CDS sequence (opt1) from Sus scrofa__NP_998965.1__SsAMELX-001-3
augggcaccuggaucuucuucgccugccugcucggggccagccuggcgaugccccugccgccccaccccggccaccccggguacaucaacuucuccuacgaggugcucacgccccugaagugguaccagaacaugauccgccaccccuacaccagcuacggcuacgagcccaugggcggguggcugcaccaccagaucauccccgucgugucccagcagaccccgcagagccacgcccuccagccccaccaccacauccccauggugcccgcccagcagccgggcaucccccagcagcccaugaugccccugccggggcagcacuccaugacccccacccagcaccaccagcccaaccugccccucccggcccagcagcccuuccagccccagcccguccagccgcagccccaccagccccugcagccccagagcccgaugcaccccauccagccccugcucccgcagccgccccugccgcccauguucuccaugcagagccugcuccccgaccugccccuggaggccuggcccgcgacggacaagaccaagcgggaggagguggacuga

SEQ ID NO: 243 - RNA, 219 nt, Artificial Sequence
  derived and/or modified CDS sequence (opt1) from Sus scrofa__K7GPB2__SsAMELX-002
augggcaccuggauccuguucgccugccuccugggggccgcguucagcaugccccugccgccccaccccggccaccccggguacaucaacuucuccuacgaggugcucaccccgcugaagugguaccagaacaugauccgccaccccagccugcuccccgaccugccccuggaggccuggccggccacggacaagaccaagcgggaggaggucgacuga

SEQ ID NO: 244 - RNA, 612 nt, Artificial Sequence
  derived and/or modified CDS sequence (opt1) from Sus scrofa__K7GLD0__SsAMELX-003
augggcaccuggauccuguucgccugccuccugggggccgcguucagcaugccccugccgccccaccccggccaccccggguacaucaacuucuccuacgaggaccucuaccuggaggccauccgcaucgaccggaccgccuucgugcugacgccccucaagugguaccagaacaugauccgccaccccuacaccagcuacggcuacgagcccaugggcggguggcugcaccaccagaucauccccgucgugucccagcagaccccgcagagccacgcccugcagccccaccaccacauccccauggugcccgcccagcagccgggcaucccccagcagcccaugaugccccucccggggcagcacuccaugacccccacgcagcaccaccagcccaaccugccccugccggcgcagcagcccuuccagccccagcccguccagccgcagccccaccagccccuccagccccagagcccgaugcaccccauccagccccugcugccgcagccgccccugccgcccauguucuccaugcagagccuccugcccgaccucccccuggaggccuggcccgccaccgacaagaccaagcgggaggagguggacuga

SEQ ID NO: 245 - RNA, 498 nt, Artificial Sequence
  derived and/or modified CDS sequence (opt1) from Sus scrofa__K7GPE9__SsAMELX-004
augggcaccuggauccuguucgccugccuccugggggccgcguucagcaugccccugccgccccaccccggccaccccggguacaucaacuucuccuacgaggugcucaccccgcugaagugguaccagaacaugauccgccaccccacgccccagagccacgcccugcagccccaccaccacaucccgaugguccccgcccagcagcccggcaucccccagcagccgaugaugccccuccccgggcagcacuccaugacccccacccagcaccaccagccgaaccugccccugcccgcccagcagcccuuccagccgcagcccgugcagccccagccccaccagccgcuccagccccagagccccaugcaccccauccagccgcugcugccccagcccccgcucccgcccauguucuccaugcagagccugcugcccgaccucccccuggaggccuggcccgcgaccgacaagacgaagcgggaggagguggacuga

SEQ ID NO: 246 - RNA, 522 nt, Artificial Sequence
  derived and/or modified CDS sequence (opt1) from Sus scrofa__J9JIM4__SsAMELX-201
augccccugccgccccaccccggccaccccggguacaucaacuucagcuacgaggugcucaccccgcugaagugguaccagaacaugauccgccaccccuacaccuccuacggcuacgagcccaugggcggguggcugcaccaccagaucauccccgucgugagccagcagacgccgcagucccacgcccuccagccccaccaccacauccccauggugcccgcccagcagcccgggaucccccagcagcccaugaugccccugccgggccagcacagcaugacccccacccagcaccaccagcccaaccugccccucccggcgcagcagcccuuccagccccagcccguccagccgcagccccaccagccccugcagccccaguccccgaugcaccccauccagccccugcucccgcagccgccccugccgcccauguucagcaugcagucccugcuccccgaccugccccuggaggccuggcccgccaccgacaagacgaagcgggaggagguggacuga

SEQ ID NO: 247 - RNA, 2961 nt, Artificial Sequence
  derived and/or modified CDS sequence (opt1) from Homo sapiens__NP_006120.1__HsBMP1
augcccggcguggcccgccugccgcuccugcuggggcuccugcugcucccccggcccggccgcccccuggaccuggccgacuacaccuacgaccucgccgaggaggacgacagcgagccgcugaacuacaaggaccccugcaaggccgccgccuuccugggggacaucgcccucgacgaggaggaccugcgggcguuccagguccagcaggccguggaccugcgccggcacaccgcccgcaaguccagcaucaaggccgcggugcccggcaacacguccacccccagcugccaguccaccaacgggcagccgcagcggggcgccugcggccgcuggcgggggcgcagccggucccgccgggccgccaccagccgccccgagcgggucuggcccgacggcgugauccccuucgugaucgggggcaacuucacggggucccagcgcgccgucuuccggcaggcgaugcgccacugggagaagcacacgugcgugaccuuccucgagcggaccgacgaggacagcuacaucguguucaccuaccgcccgugcggcugcugcuccuacgucggccggcgcgggggcgggccccaggccaucagcaucggcaagaacugcgacaaguucggcaucguggugcacgagcuggggcacgucgugggcuucuggcacgagcacacccgccccgaccgggaccgccacguguccaucguccgggagaacauccagcccgggcaggaguacaacuuccugaagauggagccgcaggagguggagagccucggcgagaccuacgacuucgacuccaucaugcacuacgcccgcaacaccuucagccgggggaucuuccuggacacgaucgugcccaaguacgaggucaacggcgugaagccgcccaucggccagcgcacccggcuguccaagggggacaucgcccaggcccgcaagcucuacaagugccccgcgugcggcgagacccugcaggacagcaccgggaacuucuccagccccgaguaccccaacggcuacagcgcccacaugcacugcguguggcggaucuccgucacgcccggggagaagaucauccugaacuucaccagccucgaccuguaccgcucccggcugugcugguacgacuacguggaggugcgcgacggcuucuggcggaaggccccgcuccgcggccgguucugcgggagcaagcugcccgagcccaucgucuccaccgacagccgccuguggguggaguuccgguccagcuccaacugggucggcaagggguucuucgccguguacgaggccaucugcggcggggacgugaagaaggacuacggccacauccagagccccaacuacccggacgacuaccgccccuccaaggucugcaucuggcggauccaggugagcgagggcuuccacguggggcucaccuuccaguccuucgagaucgagcgccacgacagcugcgcguacgacuaccuggagguccgcgacggccacuccgagagcuccacgcugaucgggcgguacugcggcuacgagaagcccgacgacaucaagagcaccuccagccgccucuggcugaaguucgugagcgacggcuccaucaacaaggccggguucgccgugaacuucuucaaggaggucgacgagugcagccggccgaaccgcggcgggugcgagcagcggugccugaacacccucggcuccuacaagugcagcugcgaccccggguacgagcuggcccccgacaagcgccggugcgaggccgcgugcggcggcuuccugaccaagcucaacggguccaucacgagccccggcuggccgaaggaguacccgcccaacaagaacugcaucuggcagcugguggcccccacccaguaccgcaucucccugcaguucgacuucuucgagaccgaggggaacgacgugugcaaguacgacuucgucgaggugcggagcggccucaccgccgacuccaagcugcacgggaaguucugcggcagcgagaagcccgaggugaucacgucccaguacaacaacaugcgcgucgaguucaagagcgacaacaccguguccaagaagggcuucaaggcccacuucuucagcgacaaggacgagugcuccaaggacaacgggggcugccagcaggacugcgugaacaccuucgggagcuacgagugccagugccgguccggcuucguccugcacgacaacaagcacgacugcaaggaggcggggugcgaccacaaggugaccagcacgagcggcaccaucaccucccccaacuggcccgacaaguaccccagcaagaaggagugcaccugggccaucuccagcacgccgggccaccgcgugaagcucaccuucauggagauggacaucgagucccagcccgagugcgccuacgaccaccuggaggucuucgacgggcgggacgccaaggcccccgugcugggccgcuucugcgggagcaagaagcccgagccggugcucgcgaccggcucccggauguuccugcgcuucuacagcgacaacuccguccagcggaagggguuccaggccagccacgccaccgagugcggcggccaggugcgcgccgacgugaagaccaaggaccuguacucccacgcccaguucggggacaacaacuaccccggcggggucgacugcgagugggugaucguggcggaggagggcuacggcgucgagcugguguuccagacguucgagguggaggaggagaccgacugcggguacgacuacauggagcuguucgacggcuacgacagcaccgcgccccggcucgggcgcuacugcggcuccgggcccccggaggaggucuacagcgccggcgacuccgugcuggugaaguuccacagcgacgacaccaucacgaagaagggcuuccaccuccgguacaccuccaccaaguuccaggacacccugcacagccgcaaguga

SEQ ID NO: 248 - RNA, 1191 nt, Artificial Sequence
  derived and/or modified CDS sequence (opt1) from Homo sapiens__NP_001191.1__HsBMP2
augguggccggcacccgcugccugcucgcccugcugcucccccagguccugcucgggggcgcggccgggcuggugccggagcugggccggcgcaaguucgccgccgccagcuccgggcggcccagcucccagcccagcgacgaggugcuguccgaguucgagcuccgccugcugagcauguucggccucaagcagcggcccaccccgucccgcgacgcggucgugccgcccuacaugcuggaccuguaccggcgccacagcggccagcccgggucccccgcccccgaccaccggcucgagcgcgccgccagccgggcgaacacggugcgcuccuuccaccacgaggagagccuggaggagcugcccgagaccuccggcaagaccacccggcgcuucuucuucaaccucagcuccauccccacggaggaguucaucaccagcgccgagcugcaggucuuccgggagcagaugcaggacgcccuggggaacaacuccagcuuccaccaccgcaucaacaucuacgagaucaucaagccggccaccgccaacuccaaguuccccgugacccggcuccuggacacgcgccuggugaaccagaacgcgagccggugggagagcuucgacgucacccccgccgugaugcgcuggaccgcccagggccacgccaaccacggguucguggucgagguggcccaccucgaggagaagcagggcguguccaagcggcacguccgcaucagccgcucccugcaccaggacgagcacagcuggucccagauccggccccugcucgugaccuucggccacgacgggaagggccacccgcugcacaagcgcgagaagcggcaggcgaagcacaagcagcgcaagcggcucaagagcuccugcaagcgccacccccuguacguggacuucagcgacgucggguggaacgacuggaucguggccccgcccggcuaccacgccuucuacugccacggcgagugccccuucccccuggccgaccaccugaacuccacgaaccacgccaucgugcagacccucgucaacagcgugaacuccaagauccccaaggcgugcugcgugcccaccgagcugagcgccaucuccaugcuguaccucgacgagaacgagaaggucgugcugaagaacuaccaggacauggucguggaggggugcggcugccgguga

SEQ ID NO: 249 - RNA, 1227 nt, Artificial Sequence
  derived and/or modified CDS sequence (opt1) from Homo sapiens__NP_001193.2__HsBMP4
augauccccggcaaccgcaugcugauggugguccuccugugccaggugcugcucgggggcgccagccacgccucccugaucccggagaccgggaagaagaagguggcggagauccagggccacgccgggggccggcgcagcggccagucccacgagcugcuccgggacuucgaggccacccugcugcagauguucgggcuccgccggcgcccccagcccagcaaguccgccgucauccccgacuacaugcgggaccuguaccgccugcagagcggcgaggaggaggaggagcagauccacuccacggggcucgaguacccggagcggcccgccagccgcgcgaacaccgugcgguccuuccaccacgaggagcaccuggagaacauccccggcaccagcgagaacuccgccuuccgcuuccuguucaaccucagcuccauccccgagaacgaggugaucagcuccgccgagcugcggcuguuccgcgagcaggucgaccaggggccggacugggagcggggcuuccaccgcaucaacaucuacgaggugaugaagccgcccgccgaggugguccccggccaccucaucacccggcugcuggacacgcgccucgugcaccacaacgugacccggugggagaccuucgacgucagccccgcggugcugcgcuggacccgggagaagcagcccaacuacgggcuggccaucgaggugacgcaccuccaccagacccgcacccaccagggccagcacguccgcaucucccggagccugccccagggguccggcaacugggcccagcugcgcccccuccuggugaccuucggccacgacgggcggggccacgcccugacgcgccggcgccgggccaagcgcagcccgaagcaccacagccagcgggcgcgcaagaagaacaagaacugccggcgccacucccucuacguggacuucagcgacgucggguggaacgacuggaucguggccccgcccggcuaccaggccuucuacugccacggggacugccccuucccccuggccgaccaccugaacuccaccaaccacgccaucgugcagacccucgucaacagcgugaacuccagcauccccaaggcgugcugcgugcccaccgagcuguccgccaucagcaugcuguaccucgacgaguacgacaaggucgugcugaagaacuaccaggagauggucguggagggcugcggcugccgguga

SEQ ID NO: 250 - RNA, 1542 nt, Artificial Sequence
  derived and/or modified CDS sequence (opt1) from Homo sapiens__NP_001709.1__HsBMP6
augcccggccuggggcgccgggcccaguggcucugcuggugguggggccugcugugcagcugcugcgggccgccgccccuccggccgccccugcccgccgcggccgccgccgccgcgggcgggcagcugcucggcgacggcgggucccccggccggaccgagcagcccccgcccagcccccaguccagcuccggguuccuguaccgccggcugaagacccaggagaagcgcgagaugcagaaggagauccucagcgugcugggccugccccaccggccccgcccccuccacgggcugcagcagccccagcccccggcccugcggcagcaggaggagcagcagcagcagcagcagcucccccgcggcgagcccccgcccggccggcugaaguccgcgccccuguucaugcucgaccuguacaacgcccugagcgccgacaacgacgaggacggggccuccgagggcgagcgccagcagagcuggccccacgaggccgccuccagcucccagcggcgccagcccccgcccggggccgcgcacccccucaaccgcaagagccugcuggcccccggcuccggcagcgggggcgccuccccgcucacgagcgcccaggacuccgccuuccugaacgacgcggacauggucaugagcuucgugaaccugguggaguacgacaaggaguucagcccccgccagcggcaccacaaggaguucaaguucaaccucucccagauccccgagggggaggucgugaccgccgccgaguuccgcaucuacaaggacugcgugaugggcagcuucaagaaccagaccuuccugaucuccaucuaccagguccugcaggagcaccagcaccgggacagcgaccucuuccugcuggacacccgcguggugugggccuccgaggagggguggcucgaguucgacaucacggccaccagcaaccugugggucgugaccccgcagcacaacaugggccugcagcucuccguggucacccgggacggcgugcacgugcacccccgcgcggccgggcuggucggccgcgacgggcccuacgacaagcagcccuucaugguggccuucuucaaggugagcgagguccacgugcggacgacccgcuccgccagcucccggcgccggcagcagagccgcaaccgguccacccagagccaggacguggcccgcgucuccagcgcguccgacuacaacagcuccgagcugaagaccgccugccggaagcacgagcucuacgugagcuuccaggaccugggcuggcaggacuggaucaucgccccgaagggguacgccgcgaacuacugcgacggcgagugcagcuucccccugaacgcccacaugaacgccacgaaccacgccaucgugcagacccucguccaccugaugaaccccgaguacgugcccaagccgugcugcgcccccaccaagcugaacgcgaucuccguccucuacuucgacgacaacagcaacgugauccugaagaaguaccgcaacauggugguccgggccugcggcugccacuga

SEQ ID NO: 251 - RNA, 1296 nt, Artificial Sequence
  derived and/or modified CDS sequence (opt1) from Homo sapiens__NP_001710.1__HsBMP7
augcacgugcgcagccugcgggccgccgcgccccacuccuucgucgcccucugggccccgcuguuccugcuccgcagcgcccuggccgacuucucccuggacaacgaggugcacagcuccuucauccaccggcgccuccggagccaggagcgccgggagaugcagcgcgagauccuguccauccugggccucccccaccggccccgcccccaccuccaggggaagcacaacagcgcgccgauguucaugcuggaccuguacaacgccauggccguggaggagggcgggggccccgggggccagggcuucuccuaccccuacaaggccgucuucagcacccaggggcccccgcuggcgucccugcaggacagccacuuccucaccgacgccgacauggugauguccuucgugaaccuggucgagcacgacaaggaguucuuccacccccgguaccaccaccgcgaguuccgguucgaccugagcaagauccccgagggcgaggccgugacggccgccgaguuccgcaucuacaaggacuacauccgggagcgcuucgacaacgagaccuuccggaucuccguguaccagguccuccaggagcaccuggggcgcgagagcgaccuguuccuccuggacucccggacccugugggcgagcgaggagggcuggcucguguucgacaucaccgccacguccaaccacuggguggucaacccccgccacaaccuggggcugcagcucagcguggagacccuggacggccagagcaucaacccgaagcuggccggccucaucgggcggcacggcccccagaacaagcagcccuucaugguggccuucuucaaggccaccgagguccacuuccgcuccauccgcagcaccggguccaagcagcggagccagaaccgcuccaagacgcccaagaaccaggaggcgcugcggauggccaacguggccgagaacagcuccagcgaccagcgccaggccugcaagaagcacgagcuguacguguccuuccgggaccucggcuggcaggacuggaucaucgccccggagggcuacgcggccuacuacugcgagggggagugcgccuucccccugaacagcuacaugaacgccaccaaccacgccaucguccagacccuggugcacuucaucaaccccgagaccgugcccaagccgugcugcgcgcccacgcagcucaacgccaucuccguccuguacuucgacgacagcuccaacgugauccugaagaaguaccgcaacauggugguccgggccugcggcugccacuga

SEQ ID NO: 252 - RNA, 300 nt, Artificial Sequence
  derived and/or modified CDS sequence (opt1) from Homo sapiens__NP_006264.2__HsCCL7
augaaggccagcgccgcgcugcucugccugcugcucaccgccgccgccuucagcccccagggccuggcccagccgguggggaucaacaccuccacgaccugcugcuaccgcuucaucaacaagaagauccccaagcagcggcuggaguccuaccgccggaccaccagcucccacugcccccgcgaggcggucaucuucaagacgaagcucgacaaggagaucugcgccgaccccacccagaagugggugcaggacuucaugaagcaccuggacaagaagacccagaccccgaagcuguga

SEQ ID NO: 253 - RNA, 3624 nt, Artificial Sequence
  derived and/or modified CDS sequence (opt1) from Homo sapiens__NP_001954.2__HsEGF
augcugcucacccugaucauccugcuccccguggucagcaaguucuccuucgugagccuguccgcgccccagcacuggagcugccccgagggcacccuggccgggaacggcaacuccacgugcguggggcccgcccccuuccucaucuucagccacggcaacuccaucuuccgcaucgacaccgaggggaccaacuacgagcagcuggucguggacgccggcgugagcgucaucauggacuuccacuacaacgagaagcggaucuacuggguggaccuggagcgccagcuccugcagcggguguuccugaacggcucccgccaggagcgggucugcaacaucgagaagaacgugagcgggauggccaucaacuggaucaacgaggaggugaucugguccaaccagcaggagggcaucaucaccgucacggacaugaaggggaacaacagccacauccuccuguccgcccugaaguacccggccaacguggcgguggaccccgucgagcgcuucaucuucuggagcuccgagguggccggcagccucuaccgggccgaccuggacggggugggcgucaaggcccugcucgagaccuccgagaagaucaccgcggugagccuggacgugcuggacaagcgccucuucuggauccaguacaaccgggagggcuccaacagccugaucugcagcugcgacuacgacgggggcuccguccacaucagcaagcaccccacccagcacaaccuguucgccaugucccucuucggggaccgcaucuucuacagcacguggaagaugaagaccaucuggaucgccaacaagcacaccggcaaggacauggugcggaucaaccugcacuccagcuucgugccccugggcgagcucaaggucgugcacccgcuggcccagcccaaggccgaggacgacaccugggagcccgagcagaagcugugcaagcuccgcaaggggaacugcuccagcacggucugcggccaggaccugcagucccaccugugcaugugcgcggagggguacgcccucagccgggaccgcaaguacugcgaggacgugaacgagugcgccuucuggaaccacggcugcacccuggggugcaagaacacccccggcuccuacuacugcacgugcccggugggcuucguccugcuccccgacgggaagcggugccaccagcuggugagcugcccccgcaacguguccgagugcagccacgacugcguccugaccuccgagggcccccucugcuucugcccggaggggagcgugcuggagcgggacggcaagaccugcuccgggugcagcucccccgacaacggcggcugcagccagcugugcgugccccucagccccgucuccugggagugcgacugcuucccgggguacgaccugcagcuggacgagaaguccugcgccgccagcggcccccagcccuuccuccuguucgcgaacagccaggacauccgccacaugcacuucgacgggaccgacuacggcacccugcucucccagcagauggggaugguguacgcccuggaccacgaccccguggagaacaagaucuacuucgcccacacggcccugaaguggaucgagcgggccaacauggacggcagccagcgcgagcggcugaucgaggagggcgucgacgugccggaggggcucgcgguggacuggaucggccgccgcuucuacuggaccgaccgggggaagucccugaucggccgcagcgaccugaacggcaagcgguccaagaucaucaccaaggagaacaucagccagccccgcgggaucgccguccaccccauggccaagcgccucuucuggaccgacacgggcaucaacccccggaucgaguccagcucccugcaggggcugggccggcucgugaucgccagcuccgaccugaucuggccgagcgggaucaccaucgacuuccugaccgacaagcucuacuggugcgacgccaagcaguccgugaucgagauggcgaaccuggacggcagcaagcgccggcgccugacccagaacgacgucggccaccccuucgccguggccguguucgaggacuacgucugguucagcgacugggccaugcccuccgugaugcgggugaacaagcgcacggggaaggaccggguccgccuccagggcagcaugcugaagccguccagccugguggugguccacccccucgcgaagcccggggccgaccccugccuguaccagaacggcgggugcgagcacaucugcaagaagcggcugggcaccgccuggugcuccugccgcgagggcuucaugaaggccagcgacgggaagaccugccucgcccuggacggccaccagcugcucgccgggggcgagguggaccugaagaaccaggugaccccgcuggacauccucuccaagacgcgggucagcgaggacaacaucaccgagucccagcacaugcugguggccgagaucauggugagcgaccaggacgacugcgcccccgucgggugcuccauguacgcccgcugcaucagcgagggcgaggacgcgaccugccagugccugaagggcuucgcgggggacggcaagcucugcuccgacaucgacgagugcgagaugggggugcccgugugcccgccggccagcuccaagugcaucaacaccgagggcggguacgucugccggugcagcgagggcuaccagggcgacgggauccacugccuggacaucgacgagugccagcugggcgagcacuccugcggggagaacgccagcugcacgaacaccgagggcggcuacacgugcaugugcgccgggcgccucuccgagcccggccugaucugccccgacagcacgcccccgccccaccuccgcgaggacgaccaccacuacagcgugcggaacuccgacagcgagugcccccugucccacgacggguacugccugcacgacggcgugugcauguacaucgaggcccuggacaaguacgcgugcaacugcgucgugggguacaucggcgagcgcugccaguaccgggaccucaaguggugggagcugcgccacgccggccacgggcagcagcagaaggugaucgucguggccgugugcgucguggugcuggucaugcuccugcugcucagccuguggggcgcccacuacuaccggacccagaagcugcucuccaagaaccccaagaacccguacgaggagagcucccgcgacgugcggagccgccggcccgcggacaccgaggacgggauguccagcugcccccagcccugguucguggucaucaaggagcaccaggaccugaagaacggcgggcagccgguggccggcgaggacggccaggccgccgacggguccaugcagcccaccagcuggcgccaggagccccagcugugcggcauggggaccgagcagggcugcuggauccccgucuccagcgacaagggguccugcccccaggugauggagcggagcuuccacaugcccuccuacggcacccagacccucgagggcgggguggagaagccccacagccugcuguccgccaacccgcucuggcagcagcgcgcgcuggacccgccccaccagauggagcugacccaguga

SEQ ID NO: 254 - RNA, 510 nt, Artificial Sequence
  derived and/or modified CDS sequence (opt1) from Homo sapiens__NP_001423.1__HsEREG
augaccgccggccgccggauggagaugcugugcgccgggcgcgugcccgcgcuccugcugugccucggcuuccaccuccugcaggccguccugagcaccacggugaucccguccugcauccccggggagagcuccgacaacugcaccgcccuggugcagaccgaggacaacccccgggucgcccaggugagcaucaccaagugcuccagcgacaugaacggcuacugccugcacgggcagugcaucuaccucguggacaugucccagaacuacugccgcugcgaggucggcuacacgggcgugcggugcgagcacuucuuccugaccgugcaccagccccugagcaaggaguacgucgcccucaccgugauccugaucauccuguuccucaucaccguggucggguccacguacuacuucugccgcugguaccggaaccgcaagagcaaggagccgaagaaggaguacgagcgggugaccuccggcgaccccgagcugccccagguguga

SEQ ID NO: 255 - RNA, 468 nt, Artificial Sequence
  derived and/or modified CDS sequence (opt1) from Homo sapiens__NP_000791.1__HsFGF1
auggccgagggcgagaucaccaccuucacggcccugaccgagaaguucaaccugcccccggggaacuacaagaagcccaagcuccuguacugcagcaacggcgggcacuuccuccgcauccugcccgacggcaccguggacgggacccgggaccgcuccgaccagcacauccagcugcagcucagcgcggaguccgucggcgagguguacaucaagagcacggagaccggccaguaccuggccauggacaccgacgggcugcucuacggcucccagacccccaacgaggagugccuguuccuggagcggcucgaggagaaccacuacaacacguacaucagcaagaagcacgccgagaagaacugguucguggggcugaagaagaacggcuccugcaagcgcgggccgcggacccacuacggccagaaggccauccuguuccucccccugcccgucagcuccgacuga

SEQ ID NO: 256 - RNA, 867 nt, Artificial Sequence
  derived and/or modified CDS sequence (opt1) from Homo sapiens__NP_001997.5__HsFGF2
auggugggcgucgggggcggggacguggaggacgugaccccgcgcccgggcgggugccagaucagcggccggggcgcccgcgggugcaacggcauccccggggccgcggccugggaggccgcccugccccggcgccggccccgccggcacccguccgucaacccccgcagccgggccgcgggcagcccccgcacccgggggcgccggacggaggagcgccccuccggcucccggcucggcgaccgcgggcggggccgcgcccugcccgggggccggcugggcgggcgcggccgggggcgcgcccccgagcgcgugggcgggcggggccgcggccgggggaccgccgcgccccgcgccgcccccgccgcccggggcagccgcccggggcccgcgggcaccauggccgccggguccaucaccacgcuccccgcccugcccgaggacggcggcagcggggccuucccgcccggccacuucaaggaccccaagcggcuguacugcaagaacgggggcuucuuccuccgcauccaccccgacgggcggguggacggcguccgcgagaaguccgacccgcacaucaagcugcagcugcaggcggaggagcggggcguggugagcaucaagggggucugcgccaaccgcuaccucgccaugaaggaggacggccggcugcuggccuccaagugcgugaccgacgagugcuucuucuucgagcgccucgagagcaacaacuacaacaccuaccggucccgcaaguacaccagcugguacguggcccugaagcggacggggcaguacaagcugggcuccaagaccggccccgggcagaaggcgauccucuuccugcccaugagcgccaaguccuga

SEQ ID NO: 257 - RNA, 585 nt, Artificial Sequence
  derived and/or modified CDS sequence (opt1) from Homo sapiens__NP_002000.1__HsFGF7
augcacaaguggauccugaccuggauccuccccacccugcuguaccgcagcugcuuccacaucaucugccucgugggcacgaucucccuggccugcaacgacaugaccccggagcagauggccaccaacgucaacugcagcucccccgagcggcacacccgcagcuacgacuacauggagggcggggacauccgggugcgccggcuguucugccgcacgcagugguaccuccggaucgacaagcgcgggaaggugaagggcacccaggagaugaagaacaacuacaacaucauggagauccggaccgucgcgguggggaucguggccaucaagggcgucgaguccgaguucuaccuggccaugaacaaggagggcaagcuguacgccaagaaggagugcaacgaggacugcaacuucaaggagcucauccuggagaaccacuacaacaccuacgccagcgcgaaguggacgcacaacgggggcgagauguucguggcccugaaccagaaggggauccccgugcgcggcaagaagaccaagaaggagcagaagaccgcccacuuccuccccauggccaucaccuga

SEQ ID NO: 258 - RNA, 627 nt, Artificial Sequence
  derived and/or modified CDS sequence (opt1) from Homo sapiens__NP_001936.1__HsHBEGF
augaagcugcuccccagcgugguccugaagcuguuccucgccgccgugcuguccgcgcuggugaccggcgagagccucgagcggcugcggcgcgggcuggccgccggcaccuccaacccggacccgcccacggucagcaccgaccagcuccugccccucgggggcgggcgggaccgcaaggugcgggaccugcaggaggccgaccuggaccugcuccgcgugacccuguccagcaagccccaggcccuggcgacccccaacaaggaggagcacggcaagcggaagaagaagggcaaggggcucggcaagaagcgcgaccccugccugcggaaguacaaggacuucugcauccacggggagugcaaguacgucaaggagcugcgcgcccccuccugcaucugccacccgggcuaccacggggagcggugccacggccucagccugcccguggagaaccgccuguacacguacgaccacaccaccauccucgccguggucgccguggugcuguccagcgucugccugcucgugaucgugggccugcugauguuccgguaccaccgccgcgggggcuacgacgucgagaacgaggagaaggugaagcucgggaugaccaacucccacuga

SEQ ID NO: 259 - RNA, 2187 nt, Artificial Sequence
  derived and/or modified CDS sequence (opt1) from Homo sapiens__NP_000592.3__HsHGF
augugggugaccaagcugcuccccgcccugcugcuccagcacguccugcugcaccuccugcugcucccgaucgccauccccuacgcggagggccagcgcaagcggcgcaacaccauccacgaguucaagaaguccgccaagacgacccugaucaagaucgaccccgcccugaagaucaagaccaagaaggugaacaccgccgaccagugcgccaaccggugcacgcgcaacaaggggcuccccuucacgugcaaggcguucguguucgacaaggcccggaagcagugccugugguucccguucaacagcaugagcuccggcgucaagaaggaguucgggcacgaguucgaccuguacgagaacaaggacuacauccgcaacugcaucaucggcaaggggcggagcuacaagggcaccguguccaucaccaagagcggcaucaagugccagcccugguccagcaugaucccccacgagcacuccuuccuccccagcuccuaccgcgggaaggaccugcaggagaacuacugccggaacccgcgcggcgaggagggcgggcccuggugcuucaccagcaaccccgaggugcgguacgaggucugcgacaucccccagugcuccgagguggagugcaugaccugcaacggggagagcuaccgcggccugauggaccacaccgaguccggcaagaucugccagcggugggaccaccagaccccgcaccgccacaaguuccuccccgagcgguaccccgacaagggguucgacgacaacuacugccgcaaccccgacggccagccgcggcccuggugcuacacgcuggacccccacacccgcugggaguacugcgccaucaagaccugcgccgacaacaccaugaacgacacggacgugccccuggagaccaccgagugcauccaggggcagggcgagggcuaccgggggaccgucaacacgaucuggaacggcaucccgugccagcgcugggacagccaguacccccacgagcacgacaugacccccgagaacuucaagugcaaggaccuccgggagaacuacugccgcaaccccgacggguccgagagcccguggugcuucaccaccgaccccaacauccgcgugggcuacugcucccagauccccaacugcgacaugagccacgggcaggacugcuaccggggcaacggcaagaacuacauggggaaccugagccagacgcgcuccggccugaccugcagcaugugggacaagaacauggaggaccuccaccggcacaucuucugggagcccgacgcguccaagcugaacgagaacuacugccgcaacccggacgacgacgcccacgggcccuggugcuacaccggcaacccccugaucccgugggacuacugccccaucagccggugcgagggggacaccacgcccaccaucgugaaccucgaccaccccgucaucuccugcgccaagaccaagcagcugcgcguggugaacggcaucccgacccggacgaacaucggcuggauggucagccugcgcuaccggaacaagcacaucugcgggggcucccucaucaaggagagcugggugcugaccgcccgccagugcuuccccucccgggaccugaaggacuacgaggccuggcucgggauccacgacgugcacggccgcggggacgagaagugcaagcagguccugaacgugagccagcugguguacggccccgagggcuccgaccucguccugaugaagcuggcgcggcccgccgugcucgacgacuucgugagcaccaucgaccugccgaacuacgggugcaccauccccgagaagacguccugcagcgucuacggcuggggguacaccggccugaucaacuacgacggccuccugcgcguggcccaccuguacaucauggggaacgagaagugcucccagcaccaccggggcaaggucacccucaacgagagcgagaucugcgccggggccgagaagaucggcuccgggcccugcgagggcgacuacggcgggccccuggugugcgagcagcacaagaugcgcauggugcugggcgucaucgugccggggcggggcugcgcgauccccaaccgccccgggaucuucgugcgggucgccuacuacgccaaguggauccacaagaucauccucaccuacaaggugccccagagcuga

SEQ ID NO: 260 - RNA, 1926 nt, Artificial Sequence
  derived and/or modified CDS sequence (opt1) from Homo sapiens__NP_005336.3 __HsHSPA1A
auggccaaggccgcggccaucggcaucgaccuggggaccaccuacagcugcgugggcguguuccagcacgggaagguggagaucaucgccaacgaccagggcaaccgcacgacccccuccuacguggccuucaccgacaccgagcggcucaucggggacgccgcgaagaaccaggucgcccugaacccgcagaacacgguguucgacgccaagcgccugaucggccggaaguucggcgaccccgugguccagagcgacaugaagcacuggcccuuccaggugaucaacgacggggacaagcccaaggugcaggucuccuacaagggcgagaccaaggccuucuacccggaggagaucagcuccauggugcucaccaagaugaaggagaucgcggaggccuaccugggguaccccgugaccaacgccgucaucacggugcccgccuacuucaacgacagccagcgccaggccaccaaggacgcgggcgugaucgccgggcugaacguccuccggaucaucaacgagcccaccgccgccgccaucgcguacggccuggaccgcaccggcaagggggagcggaacgugcugaucuucgaccucggcgggggcacguucgacguguccauccugaccaucgacgacggcaucuucgaggucaaggccaccgccggggacacccaccugggcggggaggacuucgacaaccgccucgugaaccacuucguggaggaguucaagcggaagcacaagaaggacaucagccagaacaagcgcgccguccggcgccugcggacggccugcgagcgcgcgaagcggacccuguccagcuccacccaggccagccucgagaucgacucccuguucgagggcaucgacuucuacaccagcaucacgcgcgcccgguucgaggagcugugcuccgaccucuuccgcagcacccuggagccgguggagaaggcccugcgggacgccaagcucgacaaggcgcagauccacgaccuggugcuggucgggggcuccacccgcauccccaaggugcagaagcuccugcaggacuucuucaacggccgggaccugaacaagagcaucaaccccgacgaggccgucgccuacggggccgcggugcaggccgccauccucaugggcgacaaguccgagaacgugcaggaccugcugcuccuggacgucgcgccccugagccucgggcuggagaccgccggcggggugaugacggcccugaucaagcgcaacagcaccaucccgaccaagcagacccagaucuucacgaccuacuccgacaaccagcccggcgugcucauccaggucuacgagggcgagcgcgccaugaccaaggacaacaaccugcuggggcgguucgagcucagcggcaucccgcccgcgccccgcggggugccccagaucgaggugaccuucgacaucgacgccaacggcauccugaacgucacggccaccgacaaguccaccgggaaggccaacaagaucaccaucacgaacgacaagggccggcugagcaaggaggagaucgagcgcauggugcaggaggccgagaaguacaaggccgaggacgaggugcagcgggagcgcgucuccgccaagaacgcccucgagagcuacgcguucaacaugaaguccgccguggaggacgagggccugaaggggaagaucagcgaggccgacaagaagaaggugcuggacaagugccaggaggucaucuccuggcucgacgccaacacccuggcggagaaggacgaguucgagcacaagcggaaggagcuggagcaggucugcaaccccaucaucagcggccucuaccagggggccggcggccccgggccgggcggguucggcgcccaggggcccaagggcggcuccgggagcggccccaccaucgaggagguggacuga

SEQ ID NO: 261 - RNA, 1926 nt, Artificial Sequence; identical to SEQ ID NO: 260
  derived and/or modified CDS sequence (opt1) from Homo sapiens__NP_005337.2 __HsHSPA1B

SEQ ID NO: 262 - RNA, 1926 nt, Artificial Sequence
  derived and/or modified CDS sequence (opt1) from Homo sapiens__NP_005518.3 __HsHSPA1L
auggccaccgccaagggcaucgcgaucgggaucgaccugggcaccacguacagcugcgugggggucuuccagcacggcaagguggagaucaucgccaacgaccaggggaaccgcaccacccccuccuacguggccuucaccgacacggagcggcucaucggcgacgccgccaagaaccaggucgcgaugaacccgcagaacaccguguucgacgccaagcgccugaucggccggaaguucaacgaccccgugguccaggccgacaugaagcuguggcccuuccaggugaucaacgagggcgggaagcccaaggugcucgucagcuacaagggggagaacaaggccuucuacccggaggagaucuccagcauggugcugaccaagcugaaggagaccgcggaggccuuccucggccaccccgugacgaacgccgucaucaccgugcccgccuacuucaacgacucccagcgccaggccaccaaggacgcgggggugaucgccggccugaacguccugcggaucaucaacgagcccaccgccgccgccaucgcguacggccucgacaagggcgggcagggggagcgccacgugcugaucuucgaccugggcggcgggacguucgacgugagcauccucaccaucgacgacggcaucuucgaggucaaggccaccgccggggacacccaccugggcggggaggacuucgacaaccggcuggugucccacuucguggaggaguucaagcgcaagcacaagaaggacaucagccagaacaagcgggccguccgccggcuccgcacggccugcgagcgggcgaagcgcacccuguccagcuccacccaggccaaccuggagaucgacagccucuacgagggcaucgacuucuacaccuccaucacgcgggcccgcuucgaggagcugugcgccgaccuguuccggggcacccucgagccgguggagaaggcccugcgcgacgcgaagauggacaaggccaagauccacgacaucgugcuggucgggggcagcacccggauccccaaggugcagcgccuccugcaggacuacuucaacgggcgggaccugaacaaguccaucaaccccgacgaggccgucgccuacggcgcggccgugcaggccgccauccucaugggggacaagagcgagaaggugcaggaccugcugcuccuggacgucgcgccccugucccucggccuggagaccgccggcggggugaugacggcccugaucaagcgcaacagcaccaucccgaccaagcagacccagaucuucacgaccuacuccgacaaccagcccggcgugcucauccaggucuacgagggggagcgcgccaugaccaaggacaacaaccugcugggccgguucgaccucaccgggaucccgcccgcgccccgcggcgugccccagaucgaggugacguucgacaucgacgccaacggcauccugaacgucaccgccaccgacaagagcaccgggaaggugaacaagaucacgaucaccaacgacaagggccggcugagcaaggaggagaucgagcgcauggugcucgacgccgagaaguacaaggccgaggacgagguccagcgggagaagaucgccgccaagaacgcgcuggaguccuacgccuucaacaugaaguccguggugagcgacgaggggcugaagggcaagaucagcgaguccgacaagaacaagauccucgacaagugcaacgagcugcugagcuggcucgaggucaaccagcuggccgagaaggacgaguucgaccacaagcgcaaggagcuggagcagaugugcaaccccaucaucaccaagcuguaccagggcgggugcaccggccccgccugcgggaccggcuacgugccggggcggcccgcgacgggccccaccaucgaggagguggacuga

SEQ ID NO: 263 - RNA, 1920 nt, Artificial Sequence
  derived and/or modified CDS sequence (opt1) from Homo sapiens__NP_068814.2 __HsHSPA2
augagcgcccgcggccccgccaucgggaucgaccugggcaccaccuacuccugcgugggggucuuccagcacggcaagguggagaucaucgcgaacgaccaggggaaccggacgaccccgagcuacguggccuucaccgacaccgagcgccucaucggcgacgccgccaagaaccaggucgccaugaaccccacgaacaccaucuucgacgcgaagcggcugaucggccgcaaguucgaggacgccaccgugcaguccgacaugaagcacuggcccuuccggguggucagcgagggcgggaagcccaagguccagguggaguacaagggggagaccaagacguucuucccggaggagaucuccagcauggugcugaccaagaugaaggagaucgccgaggccuaccucggcgggaaggugcacuccgcggugaucaccguccccgccuacuucaacgacagccagcgccaggccaccaaggacgccggcacgaucaccggccugaacgugcugcggaucaucaacgagcccaccgccgcggccaucgccuacgggcucgacaagaagggcugcgccgggggcgagaagaacgugcugaucuucgaccugggcgggggcaccuucgacgucuccauccucacgaucgaggacgggaucuucgaggucaagagcaccgccggcgacacccaccucgggggcgaggacuucgacaaccgcauggugucccaccuggcggaggaguucaagcggaagcacaagaaggacaucggccccaacaagcgcgccgugcggcgccugcggaccgccugcgagcgcgccaagcggacgcugagcuccagcacccaggccuccaucgagaucgacagccuguacgaggggguggacuucuacaccuccaucacccgcgcgcgguucgaggagcucaacgccgaccuguuccgcggcacgcuggagccgguggagaaggcccuccgggacgccaagcuggacaaggggcagauccaggagaucguccuggugggcgggagcacccgcauccccaagauccagaagcuccugcaggacuucuucaacggcaaggagcugaacaaguccaucaaccccgacgaggccguggcguacggcgccgccguccaggccgcgauccucaucggggacaagagcgagaacgugcaggaccugcugcuccuggacgucacgccccugagccucggcaucgagaccgccgggggcgugaugaccccgcugaucaagcggaacaccaccauccccaccaagcagacgcagaccuucaccaccuacuccgacaaccagagcuccgugcugguccagguguacgagggggagcgcgccaugacgaaggacaacaaccuccugggcaaguucgaccugaccggcaucccgcccgcgccccgcggggugccccagaucgaggucaccuucgacaucgacgccaacggcauccucaacgugaccgccgccgacaagagcaccgggaaggagaacaagaucacgaucaccaacgacaagggccggcuguccaaggacgacaucgaccgcauggugcaggaggccgagcgguacaagagcgaggacgaggccaaccgcgaccgggucgccgcgaagaacgcccuggaguccuacaccuacaacaucaagcagaccguggaggacgagaagcuccgcggcaagaucagcgagcaggacaagaacaagauccuggacaagugccaggaggugaucaacuggcuggaccggaaccagauggccgagaaggacgaguacgagcacaagcagaaggagcucgagcgcgucugcaaccccaucaucuccaagcuguaccagggcgggcccgggggcgggagcggcggcgggggcuccggggccagcggcgggccgacgaucgaggagguggacuga

SEQ ID NO: 264 - RNA, 2523 nt, Artificial Sequence
  derived and/or modified CDS sequence (opt1) from Homo sapiens__NP_002145.3 __HsHSPA4
augagcguggucggcaucgaccugggguuccaguccugcuacguggccguggcccgcgcgggcgggaucgagaccaucgccaacgaguacagcgaccggugcacccccgccugcaucuccuucggcccgaagaaccgcagcaucggggccgccgcgaagucccaggucaucagcaacgccaagaacacggugcagggcuucaagcgguuccacggccgcgccuucuccgaccccuucguggaggccgagaaguccaaccucgcguacgacaucguccagcugcccaccgggcugaccggcaucaaggugaccuacauggaggaggagcggaacuucacgaccgagcaggucaccgccaugcuccugagcaagcugaaggagaccgccgagagcgugcucaagaagcccgugguggacugcgucguguccgugccgugcuucuacacggacgccgagcgccggagcgucauggacgccacccagaucgcggggcugaacugccugcgccucaugaacgagaccaccgccguggcccuggccuacggcaucuacaagcaggaccugcccgcccucgaggagaagccccggaacguggucuucguggacauggggcacuccgcguaccaggugagcgucugcgccuucaaccgcggcaagcugaaggugcuggccacggccuucgacaccacccucggcgggcggaaguucgacgaggugcuggucaaccacuucugcgaggaguucggcaagaaguacaagcuggacaucaaguccaagauccgcgcccuccugcggcugagccaggagugcgagaagcucaagaagcugauguccgcgaacgccagcgaccugccccucuccaucgagugcuucaugaacgacguggacgucagcgggaccaugaaccgcggcaaguuccuggagaugugcaacgaccugcucgcccggguggagccgccccugcgcagcgugcuggagcagacgaagcucaagaaggaggacaucuacgccgucgagaucgugggcggggccacccggauccccgcggugaaggagaagaucuccaaguucuucggcaaggagcugagcaccacccugaacgccgacgaggccgucacgcgcgggugcgcccuccagugcgcgauccugucccccgccuucaaggugcgggaguucagcaucaccgacguggucccguaccccaucucccugcgcuggaacagccccgccgaggagggcuccagcgacugcgagguguucuccaagaaccacgccgcccccuucagcaaggugcucaccuucuaccggaaggagccguucacccuggaggcguacuacuccagcccccaggaccugcccuaccccgacccggccaucgcccaguucuccguccagaaggugacgccccagagcgacggguccagcuccaaggugaaggucaaggugcgcgugaacguccacggcaucuucagcguguccagcgccagccucguggagguccacaaguccgaggagaacgaggagcccauggagaccgaccagaacgccaaggaggaggagaagaugcaggucgaccaggaggagccccacguggaggagcagcagcagcagaccccggcggagaacaaggccgagagcgaggagauggagaccucccaggccggcagcaaggacaagaagauggaccagccgccccaggccaagaaggccaaggugaagacguccaccguggaccugcccaucgagaaccagcugcucuggcagaucgaccgcgagaugcugaaccuguacaucgagaacgaggggaagaugaucaugcaggacaagcucgagaaggagcggaacgacgcgaagaacgccguggaggaguacgucuacgagaugcgcgacaagcugagcggcgaguacgagaaguucguguccgaggacgaccggaacagcuucacccugaagcucgaggacaccgagaacuggcuguacgaggacggggaggaccagcccaagcaggucuacguggacaagcuggccgagcugaagaaccucggccagcccaucaagauccgcuuccaggaguccgaggagcggcccaagcuguucgaggagcuggggaagcagauccagcaguacaugaagaucaucagcuccuucaagaacaaggaggaccaguacgaccaccucgacgccgcggacaugacgaagguggagaaguccaccaacgaggccauggaguggaugaacaacaagcugaaccugcagaacaagcagagccucaccauggacccgguggucaagagcaaggagaucgaggccaagaucaaggagcugaccuccacgugcagccccaucaucuccaagcccaagcccaagguggagccgcccaaggaggagcagaagaacgccgagcagaacggccccguggacggccagggggacaaccccggcccgcaggccgcggagcaggggaccgacaccgccguccccagcgacagcgacaagaagcugcccgagauggacaucgacuga

SEQ ID NO: 265 - RNA, 2520 nt, Artificial Sequence
  derived and/or modified CDS sequence (opt1) from Homo sapiens__NP_055093.2 __HsHSPA4L
augagcguggucggcaucgaccugggguuccucaacugcuacaucgccguggcccgcuccggcgggaucgagaccaucgcgaacgaguacagcgaccggugcacccccgccugcaucucccugggcagccgcacgcgggccaucgggaacgccgccaagucccagaucgugaccaacguccgcaacaccauccacggcuucaagaagcugcacggccggagcuucgacgacccgaucgugcagaccgagcgcauccggcuccccuacgagcugcagaagaugcccaacggguccgcgggcgugaagguccgcuaccuggaggaggagcggcccuucgccaucgagcaggucacggggaugcuccuggccaagcugaaggagaccagcgagaacgcccucaagaagccgguggcggacugcgugaucuccauccccagcuucuucaccgacgccgagcgccgguccgugauggccgccgcccagguggcgggccugaacugccugcgccucaugaacgagaccacggccgucgcccuggccuacgggaucuacaagcaggaccugccgccccucgacgagaagccccggaacgugguguucaucgacaugggccacagcgccuaccagguccuggugugcgcguucaacaagggcaagcugaaggugcucgccaccaccuucgaccccuaccucgggggccgcaacuucgacgaggcccuggucgacuacuucugcgacgaguucaagaccaaguacaagaucaacgugaaggagaacucccgggcccugcugcgccuguaccaggagugcgagaagcucaagaagcugaugagcgccaacgcguccgaccugccccucaacaucgagugcuucaugaacgaccuggacgugagcuccaagaugaaccgggcccaguucgagcagcugugcgccagccuccuggcccgcgucgagcccccgcugaaggccgugauggagcaggcgaaccuccagcgggaggacaucuccagcaucgagaucgucgggggcgccacgcgcauccccgccgugaaggagcagaucaccaaguucuuccugaaggacaucagcaccacccugaacgccgacgaggcgguggcccggggcugcgcccuccagugcgccauccugucccccgccuucaagguccgcgaguucagcaucacggaccuggugcccuacuccaucacccuccgcuggaagaccagcuucgaggacggguccggcgagugcgagguguucugcaagaaccacccggcgcccuucagcaaggucaucaccuuccacaagaaggagcccuucgagcuggaggccuucuacacgaaccugcacgaggugcccuacccggacgcccggaucggguccuucaccauccagaacguguucccccagagcgacggcgacuccagcaaggucaaggugaaggugcgcgucaacauccacgggaucuucuccguggccagcgccuccgugaucgagaagcagaaccucgagggcgaccacagcgacgcgcccauggagaccgagaccuccuucaagaacgagaacaaggacaacauggacaagaugcaggucgaccaggaggagggccaccagaagugccacgccgagcacacgcccgaggaggagaucgaccacaccggggccaagaccaagagcgccguguccgacaagcaggaccggcugaaccagacccugaagaagggcaaggucaagagcaucgaccucccgauccaguccagccugugccgccagcuggggcaggaccuccugaacagcuacaucgagaacgagggcaagaugaucaugcaggacaagcuggagaaggagcggaacgacgccaagaacgcgguggaggaguacguguacgacuuccgcgaccggcuggggacgguguacgagaaguucaucacccccgaggaccucuccaagcugagcgccguccuggaggacaccgagaacuggcucuacgaggacggcgaggaccagcccaagcaggucuacguggacaagcugcaggagcugaagaaguacggccagcccauccagaugaaguacauggagcacgaggagcgcccgaaggcccucaacgaccuggggaagaagauccagcuggugaugaaggugaucgaggccuaccggaacaaggacgagcgcuacgaccaccucgaccccaccgagauggagaagguggagaagugcaucuccgacgcgaugagcuggcugaacuccaagaugaacgcccagaacaagcugagccucacgcaggaccccgucgugaagguguccgagaucgucgccaagagcaaggagcuggacaacuucugcaacccgaucaucuacaagcccaagcccaaggccgaggugcccgaggacaagccgaaggccaacuccgagcacaacggccccauggacgggcagagcggcaccgagaccaaguccgacagcaccaaggacuccagccagcacacgaaguccagcggggagauggagguggacuga

SEQ ID NO: 266 - RNA, 1965 nt, Artificial Sequence
  derived and/or modified CDS sequence (opt1) from Homo sapiens__NP_005338.1__HsHSPA5
augaagcugagccucguggccgccaugcugcugcuccuguccgcggcccgcgccgaggaggaggacaagaaggaggacgucggcaccgugguggggaucgaccugggcaccacguacagcugcgucgggguguucaagaacggccggguggagaucaucgccaacgaccaggggaaccgcaucacccccuccuacgucgccuucaccccggagggcgagcggcucaucggcgacgcggccaagaaccagcugaccagcaaccccgagaacacgguguucgacgccaagcgccugaucgggcggaccuggaacgaccccuccgugcagcaggacaucaaguuccuccccuucaaggucguggagaagaagaccaagccguacauccagguggacaucggcgggggccagaccaagacguucgcccccgaggagaucagcgcgaugguccugaccaagaugaaggagaccgccgaggccuaccuggggaagaaggugacccacgccguggucacggugcccgccuacuucaacgacgcgcagcgccaggccaccaaggacgccggcaccaucgccggccucaacgugaugcggaucaucaacgagcccaccgccgcggccaucgccuacgggcuggacaagcgcgagggcgagaagaacauccuggucuucgaccucgggggcggcacguucgacgugucccugcugaccaucgacaacgggguguucgaggucguggccaccaacggcgacacccaccucgggggcgaggacuucgaccagcgggugauggagcacuucaucaagcuguacaagaagaagacggggaaggacguccgcaaggacaaccgggccgugcagaagcugcgccgggaggucgagaaggcgaagcgcgcccucagcucccagcaccaggcccggaucgagaucgagagcuucuacgagggcgaggacuucuccgagacccugacccgcgccaaguucgaggagcugaacauggaccucuuccggagcaccaugaagccggugcagaaggugcuggaggacuccgaccugaagaaguccgacaucgacgagaucguccucgugggcgggagcacgcgcauccccaagauccagcagcuggugaaggaguucuucaacggcaaggagcccagccgggggaucaaccccgacgaggccgucgcguacggcgccgccgugcaggccggggugcuguccggcgaccaggacaccggcgaccucguccugcuggacgugugcccgcucacccuggggaucgagaccgugggcggggucaugacgaagcugaucccccgcaacaccguggugcccaccaagaagucccagaucuucagcaccgcgagcgacaaccagcccacggucaccaucaagguguacgagggcgagcggccgcucaccaaggacaaccaccuccuggggaccuucgaccugacgggcaucccgcccgcgccccgcggcgugccccagaucgaggucaccuucgagaucgacgugaacgggauccugcgcgugaccgccgaggacaagggcaccgggaacaagaacaagaucaccaucacgaacgaccagaaccggcugacccccgaggagaucgagcgcauggucaacgacgccgagaaguucgccgaggaggacaagaagcucaaggagcggaucgacacccgcaacgagcuggagagcuacgccuacucccugaagaaccagaucggcgacaaggagaagcucggcgggaagcugagcuccgaggacaaggagaccauggagaaggccguggaggagaagaucgaguggcuggagagccaccaggacgccgacaucgaggacuucaaggccaagaagaaggagcucgaggagaucgugcagcccaucaucuccaagcuguacggcagcgccgggcccccgcccacgggcgaggaggacaccgcggagaaggacgagcuguga

SEQ ID NO: 267 - RNA, 1932 nt, Artificial Sequence
  derived and/or modified CDS sequence (opt1) from Homo sapiens__NP_002146.2__HsHSPA6
augcaggcgccccgcgagcuggccgugggcaucgaccucgggaccaccuacagcugcgucggcguguuccagcaggggcggguggagauccuggccaacgaccagggcaaccgcacgaccccguccuacgucgccuucaccgacaccgagcggcuggugggggacgccgccaagagccaggccgcgcucaacccccacaacacgguguucgacgccaagcgccugaucggccggaaguucgccgacaccaccguccaguccgacaugaagcacuggcccuuccgcguggugagcgagggcgggaagcccaagguccgggugugcuaccgcggcgaggacaagaccuucuacccggaggagaucuccagcauggugcuguccaagaugaaggagacggccgaggcguaccucgggcagcccgucaagcacgccgugaucaccgugcccgccuacuucaacgacagccagcggcaggccaccaaggacgccggcgcgaucgccgggcugaacguccugcgcaucaucaacgagcccaccgccgccgccaucgcguacggccucgaccggcgcggcgccggggagcggaacgugcugaucuucgaccugggcgggggcacguucgacguguccguccucagcaucgacgccggcguguucgaggugaaggccaccgccggggacacccaccugggcggggaggacuucgacaaccgccuggucaaccacuucauggaggaguuccggcgcaagcacggcaaggaccucuccgggaacaagcgggcgcugcgccggcugcgcaccgccugcgagcgggccaagcgcacgcucagcuccagcacccaggccacccuggagaucgacucccuguucgagggcguggacuucuacaccagcaucacgcgcgcccgguucgaggagcucugcuccgaccuguuccgcagcacccuggagccgguggagaaggcgcuccgggacgccaagcuggacaaggcccagauccacgacgucgugcuggucggcggguccacccgcauccccaaggugcagaagcuccugcaggacuucuucaacggcaaggagcugaacaagagcaucaaccccgacgaggccguggcguacggggccgccguccaggccgccgugcucaugggcgacaagugcgagaaggugcaggaccugcugcuccuggacgucgcgccccugagccucgggcuggagaccgccggcggcgugaugacgacccugauccagcggaacgccaccaucccgaccaagcagacgcagaccuucaccaccuacuccgacaaccagcccgggguguucauccaggucuacgagggcgagcgcgccaugacgaaggacaacaaccuccuggggcgguucgagcugagcggcaucccgcccgcgccccgcggggugccccagaucgaggugaccuucgacaucgacgccaacggcauccucuccgucaccgccaccgaccggagcacgggcaaggccaacaagaucaccaucaccaacgacaaggggcgccuguccaaggaggagguggagcggauggugcacgaggccgagcaguacaaggccgaggacgaggcgcagcgcgaccgggucgccgccaagaacagccuggaggcccacguguuccacgugaagggcucccuccaggaggagagccugcgcgacaagauccccgaggaggaccggcgcaagaugcaggacaagugccgggagguccuggcguggcucgagcacaaccagcuggccgagaaggaggaguacgagcaccagaagcgcgagcuggagcagaucugccggcccaucuucucccgccuguacgggggcccgggcgugcccgggggcagcuccugcgggacccaggcccgccagggcgaccccagcaccgggcccaucaucgaggagguggacuga

SEQ ID NO: 268 - RNA, 1104 nt, Artificial Sequence
  derived and/or modified CDS sequence (opt1) from Homo sapiens__P48741__HsHSPA7
augcaggcgccccgcgagcuggccgugggcaucgaccucgggaccaccuacagcugcgucggcguguuccagcaggggcggguggagauccuggccaacgaccagggcaaccgcacgaccccguccuacgucgccuucaccgacaccgagcggcuggugggggacgccgccaagagccaggccgcgcucaacccccacaacacgguguucgacgccaagcgccugaucggccggaaguucgccgacaccaccguccaguccgacaugaagcacuggcccuuccagguggugagcgagggcgggaagcccaagguccgcgugugcuaccggggcgaggacaagaccuucuacccggaggagaucuccagcauggugcuguccaagaugaaggagacggccgaggcguaccucgggcagcccgucaagcacgccgugaucaccgugcccaccuacuucagcaacucccagcgccaggccaccaaggacgccggcgccaucgcggggcugaagguccugcccaucaucaacgaggccacggccgccgccaucgcguacggccucgaccggcgcggcgccgggaagcggaacgugcugaucuucgaccugggcgggggcaccuucgacgugagcguccucuccaucgacgccggcguguucgaggugaaggccaccgccggggacacccaccugggcggggaggacuucgacaaccgccuggucaaccacuucauggaggaguuccggcgcaagcacggcaaggaccucagcgggaacaagcgggcgcugcgccggcugcgcacggccugcgagcgggccaagcgcaccccguccagcuccacccaggccacccucgagaucgacagccuguucgagggcguggacuucuacaaguccaucacgcgggcccgcuucgaggagcugugcagcgaccucuuccgcuccacccuggagcccguggagaaggcgcugcgggacgccaagcucgacaaggcccagauccacgacuucguccugggcgggggccugcacagccacccccagggggccgagguggcggccggccuccugcagcgccagggggccgagcaggagcaccagcccuga

SEQ ID NO: 269 - RNA, 1941 nt, Artificial Sequence
  derived and/or modified CDS sequence (opt1) from Homo sapiens__NP_006588.1 __HsHSPA8
augagcaagggccccgccguggggaucgaccugggcaccaccuacuccugcgucgggguguuccagcacggcaagguggagaucaucgccaacgaccaggggaaccgcacgacccccagcuacgucgcguucaccgacaccgagcggcucaucggcgacgccgccaagaaccagguggccaugaaccccacgaacaccguguucgacgccaagcgccugaucggccggcgcuucgacgacgcggucgugcaguccgacaugaagcacuggcccuucaugguggucaacgacgccgggcggcccaagguccagguggaguacaagggcgagaccaagagcuucuacccggaggagguguccagcauggugcugaccaagaugaaggagaucgccgaggccuaccucgggaagacggugaccaacgcggucgugaccgugcccgccuacuucaacgacucccagcgccaggccaccaaggacgccggcacgaucgccgggcugaacguccugcggaucaucaacgagcccaccgcggccgccaucgccuacggccucgacaagaaggugggcgccgagcgcaacgugcugaucuucgaccucgggggcgggaccuucgacgucagcauccugaccaucgaggacggcaucuucgaggugaaguccacggcgggcgacacccaccucgggggcgaggacuucgacaaccggauggugaaccacuucaucgccgaguucaagcgcaagcacaagaaggacaucagcgagaacaagcgggccguccgccggcugcgcaccgccugcgagcgggccaagcgcacccuguccagcuccacgcaggcgagcaucgagaucgacucccuguacgaggggaucgacuucuacaccagcaucacccgggcccgcuucgaggagcugaacgccgaccucuuccggggcacccuggaccccguggagaaggcccugcgcgacgccaagcucgacaagucccagauccacgacaucguccuggucgggggcagcacgcggaucccgaagauccagaagcugcuccaggacuucuucaacggcaaggagcugaacaaguccaucaaccccgacgaggcgguggccuacggggccgccgugcaggcggccauccugagcggcgacaagagcgagaacgugcaggaccuccugcugcucgacgugacgccccugucccuggggaucgagaccgccggcggggucaugaccgugcucaucaagcgcaacaccaccauccccaccaagcagacccagacguucaccaccuacagcgacaaccagccgggcgugcugauccaggucuacgagggcgagcgcgccaugaccaaggacaacaaccugcucgggaaguucgagcugacgggcaucccgcccgcgccccgcggggugccccagaucgaggugaccuucgacaucgacgccaacggcauccugaacgucuccgccguggacaagagcaccgggaaggagaacaagaucaccaucaccaacgacaagggccggcucuccaaggaggacaucgagcggauggugcaggaggccgagaaguacaaggccgaggacgagaagcagcgcgacaaggucagcuccaagaacagccuggaguccuacgccuucaacaugaaggcgacgguggaggacgagaagcugcagggcaagaucaacgacgaggacaagcagaagauccucgacaagugcaacgagaucaucaacuggcuggacaagaaccagaccgccgagaaggaggaguucgagcaccagcagaaggagcuggagaaggugugcaaccccaucaucaccaagcucuaccagagcgccgggggcaugcccgggggcaugcccggcggguucccgggcgggggcgccccgcccuccgggggcgccagcuccggccccaccaucgaggaggucgacuga

SEQ ID NO: 270 - RNA, 2040 nt, Artificial Sequence
  derived and/or modified CDS sequence (opt1) from Homo sapiens__NP_004125.3 __HsHSPA9
augaucagcgccucccgcgccgcggccgcccggcuggugggcgccgccgcgagccgcgggcccaccgccgcccggcaccaggacuccuggaacggccucagccacgaggccuuccgccuggucucccggcgcgacuacgcgagcgaggccaucaagggggccguggugggcaucgaccuggggaccacgaacuccugcgucgccgugauggagggcaagcaggccaaggugcucgagaacgcggagggcgcccggaccaccccgagcgucguggccuucaccgccgacggggagcgccuggugggcaugcccgccaagcggcaggcggucacgaaccccaacaacaccuucuacgccaccaagcgccugaucgggcggcgcuacgacgaccccgaggugcagaaggacaucaagaacgugccguucaagaucguccgggccuccaacggcgacgccuggguggaggcccacgggaagcucuacagccccucccagaucggcgcguucgugcugaugaagaugaaggagaccgccgagaacuaccugggccacacggccaagaacgccgucaucaccgugcccgccuacuucaacgacagccagcgccaggcgaccaaggacgccgggcagaucuccggccucaacgugcugcgggucaucaacgagcccaccgccgccgcgcuggccuacgggcucgacaagagcgaggacaaggugaucgccguguacgaccugggcggcgggacguucgacaucuccauccuggagauccagaagggcgucuucgaggucaagagcaccaacggggacaccuuccucggcggggaggacuucgaccaggcccugcugcgccacaucgugaaggaguucaagcgggagaccggcguggaccucacgaaggacaacauggcccugcagcgcgugcgggaggcggccgagaaggccaagugcgagcuguccagcuccguccagaccgacaucaaccucccguaccugaccauggacagcagcggccccaagcaccugaacaugaagcucacccgcgcccaguucgaggggaucgugacggaccugauccggcgcaccaucgcccccugccagaaggcgaugcaggacgccgagguguccaagagcgacaucggcgaggucauccuggucgggggcaugacccgcaugcccaaggugcagcagaccgugcaggaccucuucgggcgggccccguccaaggccgugaaccccgacgaggccguggcgaucggcgccgccauccagggcgggguccuggccggcgacgugacggacgugcugcuccuggacgucacgccccugagccucgggaucgagacccugggcgggguguucaccaagcugaucaaccgcaacaccaccauccccaccaagaagucccagguguucagcaccgcggccgacggccagacgcaggucgagaucaaggugugccagggcgagcgggagauggccggggacaacaagcuccugggccaguucacccugaucgggaucccgcccgcgccccgcggcgugccccagaucgaggucaccuucgacaucgacgccaacggcaucgugcacguguccgccaaggacaaggggaccggccgggagcagcagaucgucauccagagcuccgggggccucagcaaggacgacaucgagaacauggugaagaacgccgagaaguacgccgaggaggaccgccggaagaaggagcgcguggaggccgucaacauggccgaggggaucauccacgacacggagaccaagauggaggaguucaaggaccagcugccggcggacgagugcaacaagcugaaggaggagaucuccaagaugcgggagcuccuggcccgcaaggacagcgagaccggcgagaacauccggcaggccgccuccagccugcagcaggccucccucaagcuguucgagauggcguacaagaagauggccagcgagcgcgagggcuccgggagcuccggcaccggggagcagaaggaggaccagaaggaggagaagcaguga

SEQ ID NO: 271 - RNA, 2028 nt, Artificial Sequence
  derived and/or modified CDS sequence (opt1) from Homo sapiens__NP_079291.2__HsHSPA12A
auggccgacaaggaggccggcgggagcgacggcccccgcgagaccgcgccgaccuccgccuacagcucccccgcccggagccugggggacacgggcaucacgccccucucccccagccacaucgugaacgacaccgacuccaacgucagcgagcagcaguccuuccuggugguggucgccguggacuucgggaccaccagcuccggcuacgccuacagcuucaccaaggagccggagugcauccacgugaugcgccggugggagggcggggaccccggcgucuccaaccagaagacccccaccacgauccugcucacccccgagcgcaaguuccacagcuucggguacgcggcccgggacuucuaccacgaccuggacccgaacgaggccaagcaguggcuguaccucgagaaguucaagaugaagcugcacaccaccggcgaccugacgauggacaccgaccucaccgccgcgaacgggaagaaggugaaggcccuggagaucuucgccuacgcccugcaguacuucaaggagcaggcccucaaggagcuguccgaccaggcgggcagcgaguucgagaacuccgacgugcgcugggucaucaccgugcccgccaucuggaagcagcccgccaagcaguucaugcggcaggccgccuaccaggcgggccuggccagccccgagaacuccgagcagcucaucaucgcccuggagccggaggccgccagcaucuacugccgcaagcugcggcuccaccagaugaucgagcugagcuccaaggcggccgugaacggguacagcggcuccgacacggucggggccggcuucacccaggccaaggagcacauccgccggaaccgccagagccggaccuuccugguggagaacgugaucggcgagaucugguccgagcucgaggagggggacaaguacgucgugguggacagcggcgggggcaccgucgaccugacggugcaccagauccgccugcccgaggggcaccucaaggagcuguacaaggccaccggcggccccuacgggucccugggcguggacuacgaguucgagaagcuccuguacaagaucuucggggaggacuucaucgagcaguucaagaucaagcggcccgcggccugggucgaccugaugaucgccuucgagagccgcaagcgggccgcggccccggaccgcaccaacccccucaacaucacccugcccuucuccuucaucgacuacuacaagaaguuccggggccacagcguggagcacgcccugcgcaaguccaacguggacuucgucaaguggagcucccaggggaugcuccggaugagccccgacgccaugaacgcccuguucaagccgacgaucgacuccaucaucgagcaccuccgcgaccuguuccagaagcccgaggugagcaccgucaaguuccuguuccuggugggcggcuucgcggaggcgccccuccugcagcaggccgugcaggccgccuucggggaccagugccgcaucaucaucccccaggacgucggccugaccauccucaagggggccgugcuguucggccuggacccggccgugaucaagguccggcgcagcccccucaccuacggggugggcgugcugaaccgguacgucgagggcaagcacccgcccgagaagcugcucgugaaggacgggacgcgcuggugcaccgacguguucgacaaguucaucuccgccgaccaguccgucgcccugggcgagcuggugaagcggagcuacacccccgccaagcccagccagcuggugaucgucaucaacaucuacuccagcgagcacgacaacguguccuucaucaccgaccccggggugaagaagugcggcacgcuccgccuggaccugaccggcaccagcgggaccgcggucccggcccggcgcgagauccagacgcucaugcaguucggcgacaccgagaucaaggccaccgccaucgacaucgcgaccuccaagagcgugaagguggggaucgacuuccugaacuacuga

SEQ ID NO: 272 - RNA, 2061 nt, Artificial Sequence
  derived and/or modified CDS sequence (opt1) from Homo sapiens__NP_443202.3 __HsHSPA12B
augcuggccgugcccgagaugggccuccaggggcuguacaucggcagcucccccgagcgcagccccguccccuccccgcccgggagcccccggacccaggaguccugcggcaucgccccgcugacccccagccagucccccaagcccgaggugcgcgcgccccagcaggccagcuucuccguggucguggccaucgacuucgggacgaccagcuccggcuacgccuucagcuucgccuccgaccccgaggcgauccacaugaugcggaagugggagggcggggacccgggcguggcccaccagaagaccccgaccugccuccugcugacgcccgagggggccuuccacagcuucggcuacaccgcccgcgacuacuaccacgaccucgaccccgaggaggcgcgggacuggcuguacuucgagaaguucaagaugaagauccacuccgccaccgaccugacccucaagacgcagcuggaggccgucaacgggaagaccaugcccgcccuggagguguucgcccacgcgcuccgcuucuuccgggagcacgcccugcaggagcugcgcgagcagagccccucccuccccgagaaggacaccgugcgguggguccugaccgugcccgccaucuggaagcagccggccaagcaguucaugcgcgaggccgcguaccuggccggccucgugagccgggagaacgccgagcagcugcugaucgcccucgagcccgaggccgcguccgucuacugccgcaagcugcggcugcaccagcuccuggaccugagcggccgcgcccccgggggcgggcggcucggcgagcgccggagcaucgacuccagcuuccgccaggcccgggagcagcugcgccggucccgccacagccgcacguuccugguggaguccggcgugggggagcucugggccgagaugcaggccggcgaccgguacgucguggcggacugcgggggcgggaccguggaccugaccguccaccagcuggagcagccccacggcacccucaaggagcuguacaaggccagcggcgggccguacggcgccguggggguggaccuggccuucgagcagcuccugugccgcaucuucggcgaggacuucaucgcgacguucaagcggcagcgccccgccgccugggucgaccugaccaucgccuucgaggcccggaagcgcaccgcggggccccaccgggccggcgcccucaacaucucccugcccuucagcuucaucgacuucuaccgcaagcagcggggccacaacguggagaccgcccugcgccgguccagcgugaacuucgucaagugguccagccaggggaugcuccgcauguccugcgaggccaugaacgagcuguuccagccgacggugagcggcaucauccagcacaucgaggcgcugcucgcccggcccgagguccagggggugaagcugcuguuccucgugggcggguucgccgaguccgccguccugcagcacgccgugcaggcggcccugggcgcccgcggccugcggguggucgugccccacgacguggggcucaccauccugaagggcgccguccuguucgggcaggcgccgggcguggugcgcguccggcgcagcccccucaccuacggcgugggggugcugaaccgguucguccccggccgccacccgcccgagaagcugcucgugcgcgacgggcggcgcuggugcaccgacguguucgagcgguucgucgccgccgagcaguccguggcccugggcgaggaggugcgccggagcuacugccccgcccgccccgggcagcggcgcguccugaucaaccucuacugcugcgcggccgaggacgcccgguucaucacggaccccggcgugcgcaagugcggcgcccugucccuggagcucgagccggccgacugcgggcaggacaccgcgggcgccccgcccgggcggcgcgagauccgggccgccaugcaguucggcgacaccgagaucaaggugaccgccgucgacgugagcacgaaccgcagcgugcgggcguccaucgacuuccugagcaacuga

SEQ ID NO: 273 - RNA, 1416 nt, Artificial Sequence
  derived and/or modified CDS sequence (opt1) from Homo sapiens__NP_008879.3__HsHSPA13
auggcccgggagaugaccauccugggcagcgccgugcucacccugcugcucgcgggguaccuggcccagcaguaccugccccucccgacgcccaaggucaucggcaucgaccuggggaccaccuacugcuccgugggcguguucuuccccgggaccggcaaggucaaggugauccccgacgagaacggccacaucagcaucccguccauggugagcuucacggacaacgacgucuacgugggguacgaguccguggagcuggccgacagcaacccccagaacaccaucuacgacgccaagcgguucaucggcaagaucuucaccgccgaggagcucgaggcggagaucgggcgcuaccccuucaagguccugaacaagaacggcaugguggaguucuccgugaccagcaacgagacgaucaccgucucccccgaguacguggggagccggcugcuccugaagcugaaggagauggccgaggccuaccucggcaugccgguggccaacgcggucaucuccgugcccgccgaguucgaccugaagcagcgcaacagcaccaucgaggccgccaaccuggccggccucaagauccugcgggugaucaacgagcccaccgcggccgccauggccuacgggcugcacaaggccgacgucuuccacgugcucgugaucgaccugggcgggggcacgcuggacgucucccuccugaacaagcagggcgggauguuccugacccgcgcgaugagcggcaacaacaagcucgggggccaggacuucaaccagcggcugcugcaguaccucuacaagcagaucuaccagaccuacggguucgugcccucccgcaaggaggagauccaccggcugcgccaggccguggagauggucaagcugaaccucacccugcaccagagcgcccagcuguccgugcuccugacggucgaggagcaggaccggaaggagccgcacagcuccgacaccgagcugcccaaggacaagcucagcagcgccgacgaccaccgcgugaacuccggcuucggccgggggcugagcgacaagaaguccggcgagagccaggugcuguucgagaccgagaucucccgcaagcuguucgacacccugaacgaggaccuguuccagaagauccucguccccauccagcagguccugaaggaggggcaccuggagaagacggagaucgacgagguggugcucgugggcgggagcacccggaucccccgcauccgccaggugauccaggaguucuucggcaaggacccgaacaccuccgucgaccccgaccuggccguggugaccggcgucgcgauccaggccgggaucgacggcgggagcuggccccuccagguguccgcccuggagauccccaacaagcaccuccagaagacgaacuucaacuga

SEQ ID NO: 274 - RNA, 1530 nt, Artificial Sequence
  derived and/or modified CDS sequence (opt1) from Homo sapiens__NP_057383.2__HsHSPA14
auggccgccaucggcgugcaccuggggugcaccagcgcgugcgucgccguguacaaggacggccgcgccgggguggucgccaacgacgccggcgaccgggugacccccgcgguggucgccuacuccgagaacgaggagaucguggggcucgccgccaagcagagccgcauccggaacaucuccaacacggugaugaaggucaagcagauccugggccgcagcuccagcgacccgcaggcgcagaaguacaucgccgaguccaagugccuggugaucgagaagaacggcaagcuccgguacgagaucgacaccggggaggagaccaaguucgugaaccccgaggacgucgcccgccugaucuucagcaagaugaaggagaccgcccacuccgugcugggcagcgacgccaacgacguggucaucacggugcccuucgacuucggggagaagcagaagaacgcgcucggcgaggccgcccgggccgccggguucaacgugcugcgccugauccacgagcccuccgcggcccuccuggccuacggcaucggccaggacagcccgaccgggaaguccaacauccuggucuucaagcucggcgggaccagccugucccugagcgugauggaggugaacuccggcaucuaccggguccucagcaccaacacggacgacaacaucggcggggcccacuucaccgagacccuggcccaguaccuggcguccgaguuccagcgcagcuucaagcacgacgugcggggcaacgcccgcgccaugaugaagcucaccaacagcgccgagguggccaagcacucccugagcacgcugggguccgcgaacugcuuccucgacagccuguacgagggccaggacuucgacugcaacgucucccgggcccgcuucgagcugcucugcagcccccuguucaacaagugcaucgaggccauccgggggcugcucgaccagaacggcuucaccgccgacgacaucaacaaggugguccugugcggcggguccagccgcauccccaagcugcagcagcucaucaaggaccuguuccccgcgguggagcugcucaacuccaucccgcccgacgaggugauccccaucggcgccgccaucgaggccgggauccugaucggcaaggagaaccugcucgucgaggacagccugaugaucgagugcuccgcccgggacauccuggugaaggggguggacgagagcggcgcgucccgcuucaccguccucuuccccagcggcaccccgcugcccgcccggcgccagcacacgcugcaggcccccggguccaucagcuccgugugccucgagcuguacgagagcgacggcaagaacuccgccaaggaggagaccaaguucgcccaggugguccugcaggaccucgacaagaaggagaacgggcugcgggacauccuggcggugcucaccaugaagcgcgacggcagccugcacgugaccugcacggaccaggagaccgggaagugcgaggccaucagcaucgagaucgccuccuga

SEQ ID NO: 275 - RNA, 2577 nt, Artificial Sequence
  derived and/or modified CDS sequence (opt1) from Homo sapiens__NP_006635.2 __HsHSPH1
augagcguggucggccuggacguggggucccagagcugcuacaucgccguggcccgcgcgggcgggaucgagaccaucgccaacgaguucuccgaccggugcacccccagcgucaucuccuucggcagcaagaaccgcaccaucgggguggccgccaagaaccagcagaucacccacgccaacaacaccguguccaacuucaagcgguuccacggccgcgcguucaacgacccguucauccagaaggagaaggagaaccucagcuacgaccuggucccccugaagaacggcggggugggcaucaaggugauguacaugggggaggagcaccucuucuccgucgagcagaucaccgccaugcugcugacgaagcucaaggagaccgccgagaacagccugaagaagcccgugaccgacugcgugaucuccguccccagcuucuucaccgacgccgagcggcgcuccgugcuggacgcggcccagaucgugggccucaacugccugcggcugaugaacgacaugacggccgucgcccucaacuacgggaucuacaagcaggaccugccgagccuggacgagaagccccgcaucgugguguucgucgacaugggccacuccgccuuccaggugagcgcgugcgccuucaacaagggcaagcucaaggugcuggggaccgccuucgaccccuuccugggcgggaagaacuucgacgagaagcucgucgagcacuucugcgccgaguucaagaccaaguacaagcuggacgccaaguccaagauccgggcgcugcuccgccuguaccaggagugcgagaagcugaagaagcucaugagcuccaacagcaccgaccugccccugaacaucgagugcuucaugaacgacaaggacgugagcggcaagaugaaccggucccaguucgaggagcucugcgccgagcugcugcagaagaucgaggugccgcucuacagccugcuggagcagacgcaccucaaggucgaggacguguccgccgucgagaucgugggcggggccacccgcauccccgccgugaaggagcggaucgcgaaguucuucggcaaggacaucagcaccacccugaacgccgacgaggccgucgcccgcgggugcgcccugcagugcgcgauccucucccccgccuucaaggugcgggaguucagcgugacggacgccguccccuucccgaucucccugaucuggaaccacgacagcgaggacaccgagggcgugcacgagguguucucccgcaaccacgccgcgcccuucagcaagguccugaccuuccuccggcgcgggcccuucgagcuggaggccuucuacuccgacccccagggcgugccguaccccgaggccaagaucggccgguucgugguccagaacgugagcgcccagaaggacggggagaagucccgcgugaaggucaaggugcgggugaacacccacggcaucuucacgaucagcaccgccuccauggucgagaaggugcccaccgaggagaacgagaugagcuccgaggcggacauggagugccugaaccagcggcccccggagaaccccgacaccgacaagaacgugcagcaggacaacagcgaggccgggacgcagccccagguccagaccgacgcccagcagaccucccagagcccgcccagccccgagcucaccuccgaggagaacaagauccccgacgccgacaaggccaacgagaagaagguggaccagcccccggaggcgaagaagcccaagaucaagguggucaacguggagcugcccaucgaggccaaccugguguggcagcucggcaaggaccugcugaacauguacaucgagacggaggggaagaugaucaugcaggacaagcucgagaaggagcgcaacgacgccaagaacgccgucgaggaguacguguacgaguuccgcgacaagcugugcggcccguacgagaaguucaucugcgagcaggaccaccagaacuuccugcgccugcucaccgagaccgaggacuggcuguacgaggagggcgaggaccaggccaagcaggcguacguggacaagcuggaggagcucaugaagaucgggacccccgucaaggugcgguuccaggaggccgaggagcgccccaagauguucgaggagcugggccagcggcugcagcacuacgccaagaucgccgcggacuuccgcaacaaggacgagaaguacaaccacaucgacgagagcgagaugaagaagguggagaaguccgucaacgaggugauggaguggaugaacaacgugaugaacgcccaggccaagaagucccucgaccaggaccccgucgugcgggcccaggagaucaagacgaagaucaaggagcugaacaacacgugcgagccgguggucacccagcccaagcccaagaucgagagccccaagcuggagcgcaccccgaacgggcccaacaucgacaagaaggaggaggaccucgaggacaagaacaacuucggcgccgagccgccccaccagaacggggagugcuaccccaacgagaagaacagcgugaacauggaccuggacuga

SEQ ID NO: 276 - RNA, 3000 nt, Artificial Sequence
  derived and/or modified CDS sequence (opt1) from Homo sapiens__NP_006380.1 __HsHYOU1
auggccgacaaggugcgccggcagcgcccccggcgccgggucugcugggcccugguggcggugcuccuggccgaccugcucgcccugagcgacacccuggccgucauguccguggaccucggcagcgaguccaugaagguggccaucgucaagccgggggugcccauggagaucgugcugaacaaggagagccgccggaagacccccgucaucgugacgcugaaggagaacgagcgcuucuucggcgacuccgcggccagcauggccaucaagaaccccaaggccacccuccgguacuuccagcaccuccuggggaagcaggcggacaacccgcacguggcccuguaccaggcccgcuuccccgagcacgagcugaccuucgacccccagcggcagaccguccacuuccagaucuccagccagcugcaguucucccccgaggaggugcucggcauggugcugaacuacagccgcucccuggccgaggacuucgccgagcagccgaucaaggacgcggucaucacggugcccguguucuucaaccaggccgagcggcgcgccguccuccaggccgcccggauggcggggcugaaggugcugcagcucaucaacgacaacaccgccaccgcccugagcuacggcguguuccgccggaaggacaucaacaccacggcccagaacaucauguucuacgacaugggcuccgggagcaccgucugcaccaucgugaccuaccagauggugaagacgaaggaggccggcaugcagccccagcugcagauccgcggggucggcuucgaccggacccucgggggccuggagauggagcugcgccuccgggagcgccuggcgggccuguucaacgagcagcgcaaggggcagcgggccaaggacgugcgcgagaacccccgggccauggccaagcuccugcgcgaggccaaccggcugaagaccguccucuccgcgaacgccgaccacauggcccagaucgagggccugauggacgacguggacuucaaggccaaggugacccgcgucgaguucgaggagcugugcgcggaccucuucgagcgggugccggggcccgugcagcaggcccugcagagcgccgagaugucccuggacgagaucgagcaggucauccucgugggcggcgccacgcgcgugccccggguccaggaggugcugcugaaggccguggggaaggaggagcucggcaagaacaucaacgcggacgaggccgccgccaugggggccgucuaccaggcggccgcccugagcaaggccuucaaggugaagcccuucgugguccgcgacgccgugguguacccgauccuggucgaguucacccgggagguggaggaggagcccggcauccacucccucaagcacaacaagcgcgugcuguucagccggauggggcccuacccccagcgcaaggucaucaccuucaaccgguacagccacgacuucaacuuccacaucaacuacggcgaccugggcuuccucgggccggaggaccugcgcguguucggcucccagaaccugaccacggugaagcugaagggggucggcgacagcuucaagaaguaccccgacuacgaguccaaggggaucaaggcgcacuucaaccucgacgagagcggcgugcugucccuggaccggguggagagcgucuucgagacccucguggaggacuccgccgaggaggagagcacccugaccaagcugggcaacacgaucuccagccucuucgggggcgggaccacccccgacgccaaggagaacggcaccgacacggugcaggaggaggaggagucccccgccgaggggagcaaggacgagccgggcgagcaggucgagcugaaggaggaggcggaggcccccguggaggacggcucccagccgccgccgcccgagcccaagggggacgccacccccgagggcgagaaggccaccgagaaggagaacggggacaagagcgaggcccagaagcccuccgagaaggcggaggccggccccgagggcguggcccccgcccccgagggggagaagaagcagaagcccgcccgcaagcggcgcauggucgaggagaucggcguggagcuggugguccucgaccugcccgaccugcccgaggacaagcucgcgcagagcgugcagaagcugcaggaccugacccuccgcgaccuggagaagcaggagcgggagaaggccgccaacucccuggaggccuucaucuucgagacgcaggacaagcucuaccagccggaguaccaggaggugagcaccgaggagcagcgcgaggagaucuccgggaagcugagcgccgcgagcaccuggcuggaggacgagggcgucggggccaccacggugaugcucaaggagaagcuggccgagcugcggaagcucugccagggccuguucuuccgcguggaggagcggaagaaguggcccgagcgccuguccgcccucgacaaccugcugaaccacagcuccauguuccucaagggcgcgcggcugauccccgagauggaccagaucuucaccgaggucgagaugaccacccuggagaaggugaucaacgagaccugggccuggaagaacgccacgcucgccgagcaggccaagcugcccgcgaccgagaagccggugcugcucagcaaggacaucgaggccaagaugauggcccuggaccgcgagguccaguaccugcucaacaaggccaaguucaccaagccccggccccgccccaaggacaagaacgggacccgggccgagccgccccugaacgcguccgccagcgaccagggcgagaaggugaucccgcccgccgggcagacggaggacgccgagcccaucuccgagcccgagaagguggagaccggcagcgagcccggggacaccgagccccuggagcucggcggcccgggggccgagcccgagcagaaggagcaguccaccggccagaagcgcccccugaagaacgacgagcuguga

SEQ ID NO: 277 - RNA, 2199 nt, Artificial Sequence
  derived and/or modified CDS sequence (opt1) from Homo sapiens__NP_005339.3 __HsHSP90AA1
augcccgaggagacccagacccaggaccagcccauggaggaggaggagguggagacguucgccuuccaggccgagaucgcgcagcugaugagccucaucaucaacaccuucuacuccaacaaggagaucuuccugcgcgagcugaucagcaacuccagcgacgcccucgacaagauccgguacgagucccugaccgaccccagcaagcuggacuccggcaaggagcuccacaucaaccugauccccaacaagcaggaccgcacccugacgaucgucgacaccgggaucggcaugaccaaggccgaccucaucaacaaccuggggaccaucgccaagagcggcacgaaggccuucauggaggcgcugcaggccggggccgacaucuccaugaucggccaguucggcgugggguucuacagcgccuaccucguggcggagaaggucaccgugaucaccaagcacaacgacgacgagcaguacgccugggaguccagcgccggcggguccuucaccgugcggacggacaccggcgagcccauggggcgcggcaccaaggucauccugcaccugaaggaggaccagaccgaguaccucgaggagcggcgcaucaaggagaucgugaagaagcacagccaguucaucggcuacccgaucacgcuguucguggagaaggagcgggacaaggaggucuccgacgacgaggccgaggagaaggaggacaaggaggaggagaaggagaaggaggagaaggagagcgaggacaagcccgagaucgaggacgugggguccgacgaggaggaggagaagaaggacggcgacaagaagaagaagaagaagaucaaggagaaguacaucgaccaggaggagcugaacaagaccaagcccaucuggacccgcaaccccgacgacaucaccaacgaggaguacggggaguucuacaagagccucacgaacgacugggaggaccaccuggccgugaagcacuucuccgucgagggccagcuggaguuccgggcgcuccuguucgugccgcgccgggcccccuucgaccuguucgagaaccgcaagaagaagaacaacaucaagcucuacgugcggcgcgucuucaucauggacaacugcgaggagcugauccccgaguaccugaacuucauccggggcgugguggacagcgaggaccucccccugaacaucagccgcgagaugcugcagcaguccaagauccucaaggucauccggaagaaccuggugaagaagugccuggagcuguucaccgagcucgccgaggacaaggagaacuacaagaaguucuacgagcaguucagcaagaacaucaagcuggggauccacgaggacucccagaaccgcaagaagcucagcgagcugcugcgguacuacaccuccgccagcggcgacgagauggugucccucaaggacuacugcacccgcaugaaggagaaccagaagcacaucuacuacaucacgggggagaccaaggaccaggucgccaacagcgcguucguggagcggcugcgcaagcacggccuggaggugaucuacaugaucgagccgaucgacgaguacugcguccagcagcucaaggaguucgaggggaagacccugguguccgucaccaaggagggccuggagcuccccgaggacgaggaggagaagaagaagcaggaggagaagaagacgaaguucgagaaccugugcaagaucaugaaggacauccuggagaagaagguggagaagguggucgugagcaaccgccucgugaccucccccugcugcaucgucaccagcaccuacggcuggacggccaacauggagcggaucaugaaggcccaggcccugcgcgacaacuccaccaugggguacauggccgcgaagaagcaccuggagaucaaccccgaccacagcaucaucgagacccugcggcagaaggccgaggccgacaagaacgacaaguccgugaaggaccucgugauccugcuguacgagaccgcccuccugagcuccggcuucagccuggaggacccgcagacgcacgccaaccgcaucuaccggaugaucaagcucgggcugggcaucgacgaggacgaccccaccgcggacgacaccuccgccgccgucaccgaggagaugccgccccuggagggggacgacgacaccagccgcauggaggagguggacuga

SEQ ID NO: 278 - RNA, 339 nt, Artificial Sequence
  derived and/or modified CDS sequence (opt1) from Homo sapiens__NG_005218__HsHSP90AA3P
auggacagcuccaagcuggacagcggcaaggggcuccacaucaaccuggugcccaacaagcagaaccagacccugaccaucgucgacacgcgcaucggcaugaccaagaccgaccucaucaacaaccuggggaccgugacgaaguccggcaccaaggccuucauggaggcccugcaggcggacgccgacaucagcaugaucgggcacuucggcgugggcuucuacuccgccuaccucgucgccaagaaggugaccgugaucagcaagcacaacaacgacgagcaguacaccugggaguccagcgccgggggcuccuucacgguccggaccgacgaguga

SEQ ID NO: 279 - RNA, 2175 nt, Artificial Sequence
  derived and/or modified CDS sequence (opt1) from Homo sapiens__NP_031381.2__HsHSP90AB1
augcccgaggaggugcaccacggcgaggaggaggucgagaccuucgccuuccaggccgagaucgcgcagcugaugagccucaucaucaacaccuucuacuccaacaaggagaucuuccugcgcgagcugaucagcaacgccuccgacgcccucgacaagauccgguacgagagccugacggacccguccaagcuggacagcgggaaggagcucaagaucgacaucauccccaacccccaggagcgcacccugacccugguggacaccggcaucgggaugacgaaggccgaccucaucaacaaccugggcaccaucgccaaguccgggaccaaggcguucauggaggcccugcaggccggcgccgacaucagcaugaucggccaguucggggugggcuucuacuccgcguaccucgucgccgagaaggugguggucaucaccaagcacaacgacgacgagcaguacgccugggagagcuccgccgggggcagcuucacggugcgggccgaccacggggagcccaucggccgcggcaccaaggugauccugcaccugaaggaggaccagaccgaguaccucgaggagcggcgcgucaaggagguggugaagaagcacucccaguucaucggguacccgaucacccuguaccuggagaaggagcgggagaaggagaucagcgacgacgaggcggaggaggagaagggcgagaaggaggaggaggacaaggacgacgaggagaagcccaagaucgaggacgucggguccgacgaggaggacgacagcggcaaggacaagaagaagaagacgaagaagaucaaggagaaguacaucgaccaggaggagcucaacaagaccaagcccaucuggacccgcaaccccgacgacaucacccaggaggaguacggcgaguucuacaagucccugacgaacgacugggaggaccaccuggccgugaagcacuucagcguggaggggcagcucgaguuccgggcccugcuguucaucccgcgccgggcccccuucgaccucuucgagaacaagaagaagaagaacaacaucaagcuguacguccgccggguguucaucauggacuccugcgacgagcugauccccgaguaccucaacuucauccgcggcguggucgacagcgaggaccugccccugaacaucagccgggagaugcuccagcaguccaagauccugaaggugauccgcaagaacaucgugaagaagugccuggagcuguucagcgagcucgccgaggacaaggagaacuacaagaaguucuacgaggcguucuccaagaaccugaagcucgggauccacgaggacagcaccaaccggcgccggcuguccgagcugcuccgcuaccacaccagccaguccggcgacgagaugaccagccuguccgaguacgucagccggaugaaggagacgcagaaguccaucuacuacaucaccggggagagcaaggagcaggucgccaacuccgccuucguggagcgcgugcgcaagcggggcuucgagguggucuacaugaccgagccgaucgacgaguacugcgugcagcagcugaaggaguucgacggcaagagccucguguccgucaccaaggaggggcuggagcugcccgaggacgaggaggagaagaagaagauggaggagagcaaggccaaguucgagaaccucugcaagcugaugaaggagauccuggacaagaagguggagaaggugacgaucuccaaccgccucgucagcucccccugcugcaucgugaccagcaccuacggcuggaccgccaacauggagcggaucaugaaggcgcaggcccugcgcgacaacagcacgaugggguacaugauggccaagaagcaccuggagaucaaccccgaccacccgaucguggagacccugcggcagaaggccgaggccgacaagaacgacaaggcggucaaggaccucguggugcugcuguucgagaccgcccuccuguccagcggcuucucccuggaggacccccagacccacagcaaccgcaucuaccggaugaucaagcucgggcugggcaucgacgaggacgaggucgccgccgaggagcccaacgcggccgugcccgacgagaucccgccccuggagggcgacgaggacgccucccgcauggaggagguggacuga

SEQ ID NO: 280 - RNA, 2412 nt, Artificial Sequence
  derived and/or modified CDS sequence (opt1) from Homo sapiens__NP_003290.1__HsHSP90B1
augcgcgcccugugggugcucggccugugcugcguccugcucaccuucgggagcgugcgggccgacgacgagguggacgucgacggcaccguggaggaggaccuggggaagucccgcgagggcagccggacggacgacgaggugguccagcgcgaggaggaggcgauccagcuggacgggcucaacgccucccagauccgggagcugcgcgagaaguccgagaaguucgccuuccaggccgaggugaaccggaugaugaagcugaucaucaacagccucuacaagaacaaggagaucuuccugcgcgagcugaucagcaacgccuccgacgcgcucgacaagauccggcugaucagccugaccgacgagaacgcccucuccggcaacgaggagcugaccgugaagaucaagugcgacaaggagaagaaccugcuccacgucaccgacacgggcguggggaugacccgcgaggagcuggugaagaaccugggcaccaucgccaagagcgggaccuccgaguuccucaacaagaugacggaggcccaggaggacggccagagcaccuccgagcugaucgggcaguucggcgucggcuucuacagcgcguuccugguggccgacaaggugaucgucaccuccaagcacaacaacgacacccagcacaucugggagagcgacuccaacgaguucagcgugaucgccgacccccgggggaacacgcucggccgcgggaccaccaucacccuggugcugaaggaggaggccuccgacuaccucgagcuggacacgaucaagaaccuggucaagaaguacagccaguucaucaacuucccgaucuacguguggagcuccaagaccgagaccguggaggagcccauggaggaggaggaggccgcgaaggaggagaaggaggagagcgacgacgaggccgccgucgaggaggaggaggaggagaagaagcccaagaccaagaagguggagaagacggugugggacugggagcucaugaacgacaucaagcccaucuggcagcggccguccaaggaggucgaggaggacgaguacaaggccuucuacaagagcuucuccaaggagagcgacgaccccauggccuacauccacuucaccgcggagggcgaggugaccuucaaguccauccuguucguccccaccagcgcgccccgcggccuguucgacgaguacggguccaagaaguccgacuacaucaagcucuacgugcggcgcguguucaucacggacgacuuccacgacaugaugccgaaguaccugaacuucgucaagggcgugguggacagcgacgaccugccccucaacgucagccgggagacccugcagcagcacaagcugcucaaggugauccgcaagaagcuggugcggaagacccuggacaugaucaagaagaucgccgacgacaaguacaacgacaccuucuggaaggaguucgggacgaacaucaagcucggcgucaucgaggaccacuccaaccgcacccggcuggccaagcugcuccgcuuccagagcucccaccaccccaccgacaucaccagccuggaccaguacguggagcgcaugaaggagaagcaggacaagaucuacuucauggccggguccagccggaaggaggccgaguccagccccuucguggagcgccugcucaagaagggcuacgaggucaucuaccugacggagccgguggacgaguacugcauccaggcccugcccgaguucgacggcaagcgguuccagaacguggccaaggagggggucaaguucgacgagagcgagaagaccaaggagucccgcgaggccguggagaaggaguucgagccccugcucaacuggaugaaggacaaggcccugaaggacaagaucgagaaggcgguggucagccagcggcugaccgagucccccugcgcccucguggccagccaguacggcugguccgggaacauggagcgcaucaugaaggcccaggcguaccagaccggcaaggacaucagcacgaacuacuacgccucccagaagaagaccuucgagaucaacccgcggcacccccugauccgcgacaugcugcggcgcaucaaggaggacgaggacgacaagaccgugcucgaccuggccgucgugcuguucgagaccgccacccuccggagcggguaccugcugcccgacacgaaggccuacggcgaccgcaucgagcggaugcuccgccugucccugaacaucgaccccgacgcgaagguggaggaggagccggaggaggagcccgaggagaccgccgaggacaccaccgaggacacggagcaggacgaggacgaggagauggacgucggcaccgacgaggaggaggagaccgccaaggagagcaccgccgagaaggacgagcucuga

SEQ ID NO: 281 - RNA, 2115 nt, Artificial Sequence
  derived and/or modified CDS sequence (opt1) from Homo sapiens__NP_057376.2__HsTRAP1
auggcccgcgagcugcgggcccuccugcuguggggccgccggcuccgcccccugcugcgggcgccggcccucgccgccgugcccgggggcaagcccauccugugcccccgccggaccaccgcccagcuggggccgcgccggaaccccgcguggagccuccaggccggccgccuguucuccacgcagaccgccgaggacaaggaggagccccugcacagcaucaucuccagcaccgaguccguccaggggagcaccuccaagcacgaguuccaggccgagacgaagaagcuccuggacaucguggcgcggagccuguacuccgagaaggagguguucauccgcgagcucaucagcaacgccuccgacgcccuggagaagcugcggcacaagcucgucagcgacggccaggcccugcccgagauggagauccaccuccagaccaacgccgagaagggcaccaucaccauccaggacacggggaucggcaugacccaggaggagcugguguccaaccuggggaccaucgcgcgcagcggcuccaaggccuuccuggacgcccuccagaaccaggccgaggccagcuccaagaucaucgggcaguucggcgugggcuucuacagcgcguucauggucgccgaccggguggagguguacucccgcagcgccgccccggggagccugggcuaccaguggcuguccgacgggagcggcgucuucgagaucgccgaggcguccggcgugcggaccgggacgaagaucaucauccaccucaagagcgacugcaaggaguucuccagcgaggcccgcgugcgggacgucgugaccaaguacuccaacuucgugagcuucccccuguaccugaacggccgccggaugaacacccuccaggccaucuggaugauggaccccaaggacguccgcgaguggcagcacgaggaguucuaccgcuacguggcccaggcccacgacaagccccgguacacccugcacuacaagacggacgcgccgcugaacauccgcuccaucuucuacgugcccgacaugaagcccagcauguucgacgucucccgggagcucgggagcuccguggcccuguacagccgcaaggugcugauccagaccaaggccaccgacauccuccccaaguggcugcgguucauccgcggcgucguggacuccgaggacaucccgcugaaccucagccgggagcugcugcaggaguccgcccucauccgcaagcugcgggacgugcugcagcagcgccucaucaaguucuucaucgaccagagcaagaaggacgcggagaaguacgccaaguucuucgaggacuacgggcuguucaugcgggagggcaucgucaccgccacggagcaggaggugaaggaggacaucgccaagcugcuccgcuacgaguccagcgcccugcccagcggccagcugaccucccugagcgaguacgcgucccggaugcgcgccgggacccggaacaucuacuaccucugcgcccccaaccgccaccuggccgagcacagccccuacuacgaggccaugaagaagaaggacaccgagguccuguucugcuucgagcaguucgacgagcucacgcugcugcaccuccgggaguucgacaagaagaagcugaucuccguggagaccgacaucguggucgaccacuacaaggaggagaaguucgaggaccgcagcccggcggccgagugccuguccgagaaggagaccgaggagcucauggccuggaugcggaacgugcugggcagccgcgugaccaacgucaaggugacgcugcgccucgacacccaccccgccauggugaccguccuggagaugggggccgcgcggcacuuccugcgcaugcagcagcucgccaagacccaggaggagcgggcccagcugcugcagcccacgcucgagaucaacccccgccacgcccugaucaagaagcugaaccagcuccgggcguccgagccgggccuggcccagcugcucguggaccagaucuacgagaacgccaugaucgccgccgggcugguggacgacccccgcgcgauggucggccggcugaacgagcuccuggugaaggcccuggagcgccacuga

SEQ ID NO: 282 - RNA, 462 nt, Artificial Sequence
  derived and/or modified CDS sequence (opt1) from Homo sapiens__NP_000609.1__HsIGF1
augggcaagaucagcucccugcccacccagcuguucaagugcugcuucugcgacuuccucaaggugaagaugcacaccaugagcuccagccaccuguucuaccucgcccugugccugcucacguucaccuccagcgccaccgcggggccggagacccugugcggcgccgagcuggucgacgcccuccaguucgugugcggggaccgcggcuucuacuucaacaagcccacgggguacggcuccagcucccggcgcgcgccccagaccggcaucguggacgagugcugcuuccggagcugcgaccugcgccggcuggagauguacugcgcgccccucaagccggccaaguccgcccgcagcguccgggcccagcgccacaccgacaugcccaagacccagaaggaggugcaccugaagaacgccucccgggggagcgccggcaacaagaacuaccgcauguga

SEQ ID NO: 283 - RNA, 543 nt, Artificial Sequence
  derived and/or modified CDS sequence (opt1) from Homo sapiens__NP_000603.1__HsIGF2
augggcauccccauggggaaguccaugcuggugcuccugaccuuccuggccuucgccagcugcugcaucgcggccuaccgcccgagcgagacccucugcggcggggagcuggucgacacgcugcaguucgugugcggcgaccggggguucuacuucucccgccccgccagccgggugucccgccggagccgcggcaucgucgaggagugcugcuuccgguccugcgaccucgcccugcuggagaccuacugcgccacccccgccaagagcgagcgcgacguguccacgcccccgaccgugcuccccgacaacuucccccgguaccccgucggcaaguucuuccaguacgacaccuggaagcagagcacccagcgccugcggcgcgggcugccggcgcuccugcgggcccgccggggccacgugcuggccaaggagcucgaggcguuccgcgaggccaagcggcaccgcccccugaucgcccugcccacccaggaccccgcccacgggggcgccccgcccgagauggcguccaaccggaaguga

SEQ ID NO: 284 - RNA, 639 nt, Artificial Sequence
  derived and/or modified CDS sequence (opt1) from Homo sapiens__NP_000591.1__HsIL6
augaacagcuucuccaccagcgccuucggccccguggccuucucccuggggcuccugcugguccucccggcggccuuccccgcccccgugcccccgggcgaggacagcaaggacguggccgcgccccaccgccagccccugaccuccagcgagcggaucgacaagcagauccgcuacauccuggacgggaucuccgcccuccggaaggagacgugcaacaagagcaacaugugcgaguccagcaaggaggcccuggccgagaacaaccugaaccuccccaagauggccgagaaggacggcugcuuccaguccggguucaacgaggagaccugccuggucaagaucaucaccggccugcucgaguucgagguguaccuggaguaccugcagaaccgcuucgagagcuccgaggagcaggcgcgggccgugcagaugagcaccaagguccucauccaguuccugcagaagaaggccaagaaccuggacgccaucacgaccccggaccccaccaccaacgccucccuccugacgaagcugcaggcgcagaaccaguggcuccaggacaugaccacccaccugauccugcgcagcuucaaggaguuccuccaguccagccugcgggcccugcgccagauguga

SEQ ID NO: 285 - RNA, 1281 nt, Artificial Sequence
  derived and/or modified CDS sequence (opt1) from Homo sapiens__NP_002183.1__HsINHBA
augccccugcucuggcugcgcggcuuccugcucgccagcugcuggaucaucgugcgguccagcccgacccccggguccgagggccacagcgccgcgcccgacugccccuccugcgcccuggccgcccugccgaaggacguccccaacagccagcccgagaugguggaggccgugaagaagcacauccucaacaugcugcaccugaagaagcgccccgacgucacccagccggugcccaaggcggcccuccugaacgccauccggaagcugcacguggggaaggucggcgagaacggguacguggagaucgaggacgacaucggccgccgggccgagaugaacgagcucauggagcagacguccgagaucaucaccuucgcggagagcggcaccgcccgcaagacccugcacuucgagaucuccaaggaggggagcgaccuguccguggucgagcgggccgagguguggcuguuccucaaggugcccaaggccaaccgcacgcggaccaaggucaccauccgccuguuccagcagcagaagcacccccagggcagccucgacaccggggaggaggccgaggaggugggccugaagggggagcgguccgagcugcuccugagcgagaagguggucgacgcgcgcaaguccacguggcacguguucccggugagcuccagcauccagcggcugcucgaccagggcaaguccagccuggacguccgcaucgccugcgagcagugccaggagagcggcgccucccuggugcuccuggggaagaagaagaagaaggaggaggagggcgaggggaagaagaagggcggcggggagggcggggccggcgccgacgaggagaaggagcagagccaccggcccuuccugaugcuccaggcgcgccaguccgaggaccacccccaccggcgccggcgccgggggcuggagugcgacggcaaggugaacaucugcugcaagaagcaguucuucgucagcuucaaggacaucggcuggaacgacuggaucaucgcccccuccggguaccacgccaacuacugcgagggcgagugcccgagccacaucgccgggaccuccggcagcucccugagcuuccacuccaccgugaucaaccacuaccgcaugcgcgggcacagccccuucgccaaccucaaguccugcugcgugcccaccaagcugcggcccaugagcaugcuguacuacgacgacggccagaacaucaucaagaaggacauccagaacaugaucgucgaggagugcggcugcuccuga

SEQ ID NO: 286 - RNA, 1224 nt, Artificial Sequence
  derived and/or modified CDS sequence (opt1) from Homo sapiens__NP_002184.2__HsINHBB
auggacggccugcccgggcgcgcccucggcgccgcgugccugcugcuccuggccgccggguggcugggcccggaggccugggggagccccaccccgcccccgacccccgccgcgcccccgcccccgcccccgcccggcucccccggcgggagccaggacacgugcaccuccugcggcggguuccggcgccccgaggagcucggccggguggacggggacuuccuggaggccgucaagcgccacauccugagccggcuccagaugcgcggccggcccaacaucacccacgccgugcccaaggccgcgauggugaccgcccugcgcaagcugcacgccggcaagguccgggaggacgggcgcguggagaucccccaccucgacggccacgccucccccggggccgacggccaggagcgggugagcgagaucaucuccuucgcggagacggacggccuggccagcucccgcguccggcuguacuucuucaucagcaacgaggggaaccagaaccucuucguggugcaggccucccuguggcuguaccucaagcugcugcccuacguccucgagaagggcagccgccggaaggugcgcgugaaggucuacuuccaggagcaggggcacggcgaccgguggaacaugguggagaagcgcguggaccugaagcgguccggguggcacaccuucccccugaccgaggccauccaggcccucuucgagcgcggcgagcggcgccugaaccuggacguccagugcgacagcugccaggagcucgcgguggugcccgucuucguggaccccggcgaggagucccaccgccccuucguggucgugcaggcccggcugggggacagccgccaccggauccgcaagcggggccuggagugcgacgggcgcaccaaccucugcugccggcagcaguucuucaucgacuuccgccugaucggcuggaacgacuggaucaucgccccgacgggguacuacggcaacuacugcgagggcuccugccccgccuaccuggccggggugcccggcagcgcguccagcuuccacaccgccgucgugaaccaguaccggaugcgcgggcucaaccccggcaccgucaacagcugcugcaucccgaccaagcuguccacgaugagcaugcuguacuucgacgacgaguacaacaucgugaagcgggacgugcccaacaugaucgucgaggagugcgggugcgccuga

SEQ ID NO: 287 - RNA, 3459 nt, Artificial Sequence
  derived and/or modified CDS sequence (opt1) from Homo sapiens__NP_000623.2__HsITGAM
auggcccugcgcgugcuccugcugaccgcccucacccugugccacggcuucaaccuggacacggagaacgcgaugaccuuccaggagaacgcccggggguucggccagagcgucgugcagcuccaggggucccgcguggucgugggcgccccccaggagaucguggccgccaaccagcgggggagccuguaccagugcgacuacuccaccggcagcugcgagccgauccgccugcagguccccguggaggcggugaacaugucccucggccugagccuggccgccaccacgucccccccccagcuccuggccugcgggccgaccguccaccagaccugcagcgagaacaccuacgugaagggccugugcuuccucuucggguccaaccugcggcagcagccccagaaguuccccgaggcgcugcgcggcugcccccaggaggacagcgacaucgccuuccucaucgacggguccggcagcaucaucccgcacgacuuccggcgcaugaaggaguucguguccacggucauggagcagcugaagaaguccaagacccuguucucccucaugcaguacagcgaggaguuccggauccacuucaccuucaaggaguuccagaacaaccccaacccccgcucccuggugaagcccaucacccagcugcucggccggacgcacaccgccaccgggauccgcaaggugguccgggagcuguucaacaucaccaacggcgcccgcaagaacgccuucaagauccugguggugaucacggacggggagaaguucggcgacccgcucggcuacgaggacgucauccccgaggcggaccgggagggggugauccgcuacgugaucggcgucggggacgccuuccggagcgagaagucccgccaggagcugaacaccaucgccagcaagcccccccgggaccacguguuccaggugaacaacuucgaggcccugaagaccauccagaaccagcuccgcgagaagaucuucgccaucgagggcacccagacggggagcuccagcuccuucgagcacgagaugagccaggagggcuucuccgcggccaucaccagcaacggcccgcugcuguccaccgucgggagcuacgacugggccggcgggguguuccucuacaccuccaaggagaaguccacguucaucaacaugacccgggucgacuccgacaugaacgacgccuaccugggcuacgccgcggccaucauccugcgcaaccgcgugcagagccucgugcugggggccccccgguaccagcacaucggccuggucgccauguuccgccagaacaccggcaugugggaguccaacgccaacgugaaggggacccagaucggcgcguacuucggggccagccucugcuccguggacgucgacagcaacggcuccacggaccuggugcugaucggggccccccacuacuacgagcagacccggggcggccaggugagcgucugcccccucccgcgcgggcgggcccgcuggcagugcgacgcggugcuguacggcgagcaggggcagcccuggggccgguucggcgccgcccugaccgugcucggggacgucaacggcgacaagcugaccgacguggccaucggggcccccggcgaggaggacaaccgcggggcgguguaccuguuccacggcacguccggcagcgggaucagccccucccacagccagcggaucgccggcuccaagcucagcccgcgccugcaguacuucgggcagucccugagcggcgggcaggaccugaccauggacggccucgucgaccugaccgugggcgcccaggggcacgugcugcuccugcggucccagcccguccugcgcgugaaggccaucauggaguucaacccccgggagguggcccgcaacgucuucgagugcaacgaccagguggugaagggcaaggaggcgggggagguccgggugugccuccacgugcagaaguccacccgcgaccggcugcgcgagggccagauccaguccgucgugacguacgaccuggcccucgacagcgggcggccccacucccgcgccguguucaacgagaccaagaacagcacccgccggcagacccagguccugggccugacccagacgugcgagacccucaagcugcagcugccgaacugcaucgaggaccccgugucccccaucgugcuccgccugaacuucagccuggucggcaccccgcucuccgccuucgggaaccugcggcccgugcuggccgaggacgcgcagcgccucuucaccgcccuguuccccuucgagaagaacugcggcaacgacaacaucugccaggacgaccugagcaucacguucuccuucaugagccucgacugccugguggucgggggcccccgggaguucaacgugaccgugaccguccgcaacgacggggaggacagcuaccggacccaggugacguucuucuucccgcuggaccucuccuaccgcaaggugagcacccugcagaaccagcggucccagcgcagcuggcggcuggccugcgaguccgccagcuccaccgaggucagcggcgcgcucaaguccaccagcugcuccaucaaccaccccaucuuccccgagaacagcgaggugacguucaacaucaccuucgacguggacuccaaggccagccugggcaacaagcugcuccugaaggccaacgucaccuccgagaacaacaugccccgcaccaacaagacggaguuccagcuggagcucccggugaaguacgccguguacauggucgugaccagccacgggguguccaccaaguaccugaacuucaccgccagcgagaacacgucccgggucaugcagcaccaguaccaggugagcaaccugggccagcgcagccuccccaucucccuggucuuccuggugcccgugcggcucaaccagaccgucaucugggaccgcccccaggugaccuucagcgagaaccuguccagcacaugccacacgaaggagcggcugccgucccacagcgacuuccucgcggagcugcgcaaggcccccguggucaacugcuccaucgccgugugccagcggauccagugcgacauccccuucuucgggauccaggaggaguucaacgccacccugaagggcaaccucagcuucgacugguacaucaagaccucccacaaccaccuccugaucgugagcaccgccgagauccucuucaacgacuccgucuucacgcugcugcccggccagggggcguucgugcgcagccagaccgagaccaagguggagccguucgagguccccaacccccucccccugaucgugggcuccagcguggggggccugcuccugcuggcccucaucaccgccgcccuguacaagcugggguucuucaagcggcaguacaaggacaugauguccgagggcggcccgcccggggccgagccccaguga

SEQ ID NO: 288 - RNA, 1404 nt, Artificial Sequence
  derived and/or modified CDS sequence (opt1) from Homo sapiens__NP_002415.1__HsMMP8
auguucagccugaagacccuccccuuccugcugcuccugcacgugcagaucuccaaggccuucccggucagcuccaaggagaagaacaccaagacggugcaggacuaccuggagaaguucuaccagcuccccagcaaccaguaccaguccacccgcaagaacggcaccaacgugaucgucgagaagcugaaggagaugcagcgguucuucgggcugaacgugaccggcaagcccaacgaggagacgcucgacaugaugaagaagccccgcugcggggugccggacagcggcggguucaugcugacccccggcaaccccaagugggagcggaccaaccugaccuaccgcauccggaacuacacgccccagcucuccgaggccgaggucgagcgcgcgaucaaggacgccuucgagcuguggagcguggccuccccgcugaucuucacccggaucagccagggcgaggccgacaucaacaucgccuucuaccagcgcgaccacggggacaacucccccuucgacggccccaacgggauccucgcgcacgccuuccagcccggccaggggaucggcggcgacgcccacuucgacgccgaggagaccuggaccaacacgagcgcgaacuacaaccuguuccugguggccgcccacgaguucgggcacucccucggccuggcccacagcuccgacccgggggcccugauguaccccaacuacgcguuccgggagaccagcaacuacucccucccccaggacgacaucgacggcauccaggccaucuacggccugagcuccaaccccauccagccgaccgggcccagcacccccaagcccugcgacccgagccugacguucgacgccaucaccacccuccgcggcgagauccuguucuucaaggaccgguacuucuggcgccggcacccccagcugcagcgcgucgagaugaacuucaucucccucuucuggcccagccugcccaccgggauccaggccgccuacgaggacuucgaccgggaccugaucuuccucuucaagggcaaccaguacugggcgcuguccggguacgacauccugcagggcuacccgaaggacaucagcaacuacggcuuccccuccagcgugcaggccaucgacgccgccguguucuaccgcuccaagacguacuucuucgucaacgaccaguucuggcgguacgacaaccagcgccaguucauggagcccggguaccccaagagcaucuccggcgccuucccggggaucgagagcaagguggacgcgguguuccagcaggagcacuucuuccacgucuucuccggcccccgguacuacgccuucgaccucaucgcccagcgcgugacccggguggcccgcgggaacaaguggcugaacugccgcuacggcuga

SEQ ID NO: 289 - RNA, 2124 nt, Artificial Sequence
  derived and/or modified CDS sequence (opt1) from Homo sapiens__NP_004985.2__HsMMP9
augagccuguggcagccccucgugcugguccugcucgugcugggcugcugcuucgccgccccgcgccagcggcaguccacccugguccucuuccccggggaccugcgcaccaaccugacggaccggcagcucgcggaggaguaccuguaccgcuacggcuacacccggguggccgagaugcgcggggagagcaagucccugggccccgcccuccugcugcuccagaagcagcugagccugcccgagaccggggagcucgacuccgccacccugaaggccaugcggacgccgcgcugcggcgugcccgaccugggccgguuccagaccuucgagggggaccucaaguggcaccaccacaacaucaccuacuggauccagaacuacagcgaggaccugccccgcgcggugaucgacgacgccuucgcccgggccuucgcgcugugguccgccgucacgccccucaccuucacccgcguguacagccgggacgccgacaucgugauccaguucggcgucgccgagcacggggacggcuacccguucgacgggaaggacggccugcuggcccacgcguucccgcccggccccgggauccagggcgacgcccacuucgacgacgacgagcucuggucccuggggaagggcguggugguccccacccgcuucggcaacgccgacggggccgccugccacuuccccuucaucuucgagggccggagcuacuccgcgugcaccacggacgggcgcagcgacggccugcccuggugcuccaccaccgccaacuacgacaccgacgaccgguucggguucugccccagcgagcgccucuacacgcaggacggcaacgccgacggcaagccgugccaguuccccuucaucuuccaggggcaguccuacagcgccugcaccaccgacggccgguccgacggguaccgcuggugcgccaccacggcgaacuacgaccgggacaagcuguucggcuucugccccacccgcgccgacagcaccgugaugggcggcaacuccgccggcgagcugugcguguuccccuucaccuuccucgggaaggaguacagcacgugcaccagcgagggccgcggggacggccggcuguggugcgccaccaccuccaacuucgacagcgacaagaaguggggguucugcccggaccagggcuacucccuguuccucgucgccgcgcacgaguucggccacgcccuggggcuggaccacagcuccgugcccgaggcccucauguaccccauguaccgcuucacggaggggcccccgcugcacaaggacgacgugaacgggauccggcaccuguacggcccccgccccgagcccgagccgcggccgcccaccaccaccacgccccagcccaccgccccgcccaccgucugccccaccggcccgcccacggugcaccccagcgagcgccccaccgcggggcccaccggcccgcccuccgccgggcccaccggcccgcccaccgccgggcccagcacggccaccaccgugccccucucccccgucgacgacgccugcaacgugaacaucuucgacgcgaucgccgagaucggcaaccagcuguaccuguucaaggacggcaaguacuggcgguucagcgaggggcgcggcucccggccccaggggcccuuccucaucgccgacaaguggccggcccugccccgcaagcuggacagcguguucgaggagcggcucuccaagaagcuguucuucuucagcggccgccaggucuggguguacaccggggccuccguccugggcccccggcgccuggacaagcucggccugggggcggacguggcccaggugacgggcgcccugcggagcgggcgcggcaagaugcuccuguucuccgggcggcgccuguggcgguucgacgucaaggcccagaugguggacccccgcagcgccuccgagguggaccgcauguucccgggcgucccccucgacacccacgacguguuccaguaccgggagaaggcguacuucugccaggaccgcuucuacuggcgggugagcagccgcuccgagcugaaccaggucgaccaggugggcuacgugaccuacgacauccugcagugccccgaggacuga

SEQ ID NO: 290 - RNA, 1416 nt, Artificial Sequence
  derived and/or modified CDS sequence (opt1) from Homo sapiens__NP_002418.1__HsMMP13
augcaccccggcgugcuggccgccuuccucuuccugagcuggacccacugccgcgcgcugccgcuccccuccgggggcgacgaggacgaccugagcgaggaggaccugcaguucgccgagcgguaccuccgcuccuacuaccaccccaccaaccuggccgggauccugaaggagaacgccgccagcuccaugacggagcggcuccgcgagaugcagagcuucuucggccuggaggucaccgggaagcuggacgacaacacccucgacgugaugaagaagccccggugcggcgugccggacgucggcgaguacaacguguucccccgcacccugaagugguccaagaugaaccugacguaccggaucgugaacuacacccccgacaugacccacagcgaggucgagaaggcguucaagaaggccuucaaggugugguccgacgugacgccccucaacuucacccgccugcacgacgggaucgccgacaucaugaucagcuucggcaucaaggagcacggggacuucuacccguucgacggccccuccgggcugcucgcccacgcguucccgcccggccccaacuacggcggggacgcccacuucgacgacgacgagaccuggaccagcuccagcaagggcuacaaccuguuccuggucgccgcccacgaguucgggcacucccucggccuggaccacagcaaggaccccggcgcccugauguuccccaucuacaccuacacggggaagucccacuucaugcuccccgacgacgacgugcagggcauccagagccuguacgggccgggcgacgaggaccccaaccccaagcaccccaagaccccggacaagugcgaccccucccugagccucgacgcgaucaccagccugcgcggggagaccaugaucuucaaggaccgguucuucuggcggcugcacccccagcaggucgacgccgagcuguuccugacgaaguccuucuggcccgagcugccgaaccgcaucgacgccgccuacgagcaccccagccacgaccucaucuucaucuuccggggccgcaaguucugggcccugaacggcuacgacauccuggagggguaccccaagaagaucuccgagcucggccugcccaaggaggugaagaagaucagcgcggccgugcacuucgaggacaccgggaagacccuccucuucuccggcaaccagguguggcgguacgacgacaccaaccacaucauggacaaggacuacccgcgccugaucgaggaggacuuccccgggaucggcgacaaggucgacgccguguacgagaagaacggcuacaucuacuucuucaacgggcccauccaguucgaguacagcaucugguccaaccggaucgugcgcgucaugccggccaacagcauccuguggugcuga

SEQ ID NO: 291 - RNA, 1068 nt, Artificial Sequence
  derived and/or modified CDS sequence (opt1) from Homo sapiens__NP_001286.1__HsCCR1
auggagacccccaacaccacggaggacuacgacaccaccaccgaguucgacuacggcgacgccacgccgugccagaaggugaacgagcgcgccuucggggcgcagcugcucccgccccuguacagccuggucuucgugaucggccucguggggaacauccuggucgugcuggugcucguccaguacaagcggcugaagaacaugaccuccaucuaccugcucaaccuggccaucagcgaccuccucuuccuguucacccugcccuucuggaucgacuacaagcucaaggacgacuggguguucggcgacgccaugugcaagauccuguccggguucuacuacaccggccuguacagcgagaucuucuucaucauccuccugacgaucgaccgcuaccuggccaucgugcacgccgucuucgcgcuccgggcccgcaccgugaccuucggcgugaucaccuccaucaucaucugggcccuggccauccuggcgagcaugcccgggcucuacuucuccaagacgcagugggaguucacccaccacacgugcagccugcacuucccccacgagucccugcgggaguggaagcuguuccaggcccugaagcugaaccucuucggccugguccugccccuccuggugaugaucaucugcuacaccgggaucaucaagauccugcuccgccggcccaacgagaagaaguccaaggccgugcgccugaucuucgucaucaugaucaucuucuuccuguucuggaccccguacaaccucaccauccugaucagcguguuccaggacuuccuguucacccacgagugcgagcagagccggcaccucgaccuggccgugcaggucaccgaggugaucgccuacacgcacugcugcgugaaccccgucaucuacgcguucgugggcgagcgcuuccggaaguaccugcgccagcuguuccaccggcgcguggccguccaccucgugaaguggcugcccuuccucuccgucgaccggcuggagcgcgugagcuccaccagccccuccaccggggagcacgagcugagcgccggcuucuga

SEQ ID NO: 292 - RNA, 636 nt, Artificial Sequence
  derived and/or modified CDS sequence (opt1) from Homo sapiens__NP_002598.4__HsPDGFA
augcgcacccuggccugccuccugcugcucggcugcggguaccuggcccacgugcuggcggaggaggccgagaucccccgggaggugaucgagcgccucgcccggagccagauccacuccauccgcgaccugcagcggcugcucgagaucgacagcgugggcuccgaggacagccuggacaccucccugcgcgcccacggggugcacgccacgaagcacgucccggagaagcggccccuccccauccgccggaagcgcagcaucgaggaggcggugcccgccgugugcaagacccggaccgucaucuacgagaucccgcgcucccagguggaccccaccagcgccaacuuccugaucuggccgcccugcguggaggucaagcggugcacgggcugcugcaacaccuccagcgugaagugccagcccucccgcgugcaccaccggagcgucaagguggccaagguggaguacguccgcaagaagcccaagcugaaggagguccaggugcggcucgaggagcaccuggagugcgcgugcgccaccaccucccugaaccccgacuaccgcgaggaggacacggggcggccccgcgagagcggcaagaagcggaagcgcaagcgccucaagccgaccuga

SEQ ID NO: 293 - RNA, 726 nt, Artificial Sequence
  derived and/or modified CDS sequence (opt1) from Homo sapiens__NP_002599.1__HsPDGFB
augaaccgcugcugggcccuguuccucagccugugcugcuaccugcggcucguguccgccgagggcgaccccaucccggaggagcuguacgagaugcugagcgaccacuccauccgcagcuucgacgaccuccagcggcugcugcacggggaccccggcgaggaggacggggcggagcucgaccugaacaugacccgcucccacagcggcggggagcuggagucccucgcccggggccgccggagccugggcucccugaccaucgccgagcccgccaugaucgccgagugcaagacgcgcaccgaggucuucgagaucagccggcgccucaucgaccggaccaacgcgaacuuccugguguggcccccgugcguggagguccagcgcugcuccgggugcugcaacaaccggaacgugcagugccgccccacccaggugcagcugcggcccguccaggugcgcaagaucgagaucgugcggaagaagcccaucuucaagaaggccacggucacccucgaggaccaccuggccugcaagugcgagaccguggccgcggcccgcccggugacccggagccccggcgggucccaggagcagcgcgccaagacgccccagacccgggucaccauccgcaccgugcgcgugcggcggcccccgaagggcaagcaccgcaaguucaagcacacgcacgacaagaccgcccugaaggagacccucggggccuga

SEQ ID NO: 294 - RNA, 1038 nt, Artificial Sequence
  derived and/or modified CDS sequence (opt1) from Homo sapiens__NP_057289.1__HsPDGFC
augagccuguucggccuccugcugcucaccuccgcccuggccgggcagcgccagggcacccaggcggagagcaaccuguccagcaaguuccaguucuccagcaacaaggagcagaacggggugcaggacccccagcacgagcggaucaucacggucuccaccaacggcagcauccacuccccgcgcuucccccacaccuacccccggaacaccgugcucguguggcgccuggucgccguggaggagaacguguggauccagcugacguucgacgagcgguucgggcucgaggaccccgaggacgacaucugcaaguacgacuucgucgagguggaggagccgagcgacggcaccauccugggccgcuggugcggguccggcaccgugcccgggaagcagaucagcaagggcaaccagauccggauccgcuucgucuccgacgaguacuuccccagcgagcccggguucugcauccacuacaacaucgugaugccgcaguucaccgaggccgugucccccagcguccugccgcccuccgcccucccccuggaccugcucaacaacgccaucacggcguucagcacccuggaggaccugauccgguaccucgagcccgagcgcuggcagcuggaccuggaggaccucuaccggcccaccuggcagcugcugggcaaggccuucguguucggccgcaagucccggguggucgaccucaaccugcugaccgaggaggugcgccucuacagcugcacgccccggaacuucagcguguccauccgcgaggagcugaagcggaccgacaccaucuucuggccggggugccugcucgucaagcgcugcggcgggaacugcgccugcugccugcacaacugcaacgagugccagugcgugcccagcaaggugaccaagaaguaccacgagguccugcagcuccggcccaagacgggcgugcgcggccugcacaagucccugaccgacguggcccucgagcaccacgaggagugcgacugcgucugccgggggagcaccggcggguga

SEQ ID NO: 295 - RNA, 1095 nt, Artificial Sequence
  derived and/or modified CDS sequence (opt1) from Homo sapiens__NP_149126.1__HsPDGFD
augcaccgccugaucuucguguacacccucaucugcgccaacuucugcagcugccgggacaccuccgccacgccccagagcgcguccaucaaggcccugcgcaacgccaaccugcggcgcgacgaccucuaccggcgcgacgagaccauccaggucaagggcaacggguacgugcagagcccccgguuccccaacuccuacccccgcaaccugcugcucaccuggcggcugcacagccaggagaacacccgcauccagcugguguucgacaaccaguucggccucgaggaggccgagaacgacaucugccgguacgacuucgucgagguggaggacaucuccgagaccagcaccaucauccgcgggcgguggugcggccacaaggaggugcccccgcgcaucaagucccggaccaaccagaucaagaucaccuucaagagcgacgacuacuucgucgccaagcccggguucaagaucuacuacucccugcuggaggacuuccagcccgcggccgccagcgagacgaacugggaguccgugaccagcuccaucagcggcguguccuacaacagccccuccgucaccgacccgacccucaucgccgacgcgcuggacaagaagaucgccgaguucgacacgguggaggaccugcucaaguacuucaaccccgagagcuggcaggaggaccuggagaacauguaccuggacaccccgcgcuaccggggccgcagcuaccacgaccggaaguccaagguggaccucgaccgccugaacgacgacgccaagcgguacagcugcacgccccgcaacuacuccgucaacauccgcgaggagcugaagcucgccaacgugguguucuucccccggugccugcugguccagcgcugcgggggcaacugcgggugcggcaccgugaacuggcggagcugcacgugcaacuccgggaagaccgugaagaaguaccacgagguccuccaguucgagcccggccacaucaagcgccggggccgcgccaagaccauggcgcugguggacauccagcuggaccaccacgagcggugcgacugcaucugcagcucccgcccgccccgguga

SEQ ID NO: 296 - RNA, 678 nt, Artificial Sequence
  derived and/or modified CDS sequence (opt1) from Homo sapiens__NP_003946.3__HsSOCS3
auggugacccacagcaaguuccccgccgccggcaugucccgcccgcuggacaccagccuccggcugaagacguucuccagcaaguccgaguaccagcuggucgugaacgcggugcgcaagcuccaggagagcggguucuacugguccgccgucaccggcggggaggccaaccugcugcucagcgccgagcccgccggcaccuuccugauccgggacuccagcgaccagcgccacuucuucacccuguccgugaagacgcagagcgggaccaagaaccuccggauccagugcgagggcggcuccuucagccugcaguccgacccccgcagcacccagcccgugccgcgguucgacugcguccugaagcucgugcaccacuacaugcccccgcccggggcgcccuccuuccccagcccgcccaccgagcccuccagcgaggugcccgagcagcccagcgcccagccccugccgggcuccccgccccgccgggccuacuacaucuacagcgggggcgagaagaucccccugguccucucccgcccccugagcuccaacguggccacgcugcagcaccucugccggaagaccgugaacgggcaccuggacagcuacgagaaggucacccagcugcccggccccauccgcgaguuccucgaccaguacgacgcgccccuguga

SEQ ID NO: 297 - RNA, 483 nt, Artificial Sequence
  derived and/or modified CDS sequence (opt1) from Homo sapiens__NP_003227.1__HsTGFA
auggugcccagcgccggccagcuggcccucuucgcgcuggggaucguccuggccgccugccaggcccucgagaacuccaccagcccgcuguccgccgacccgcccguggcggccgccguggucagccacuucaacgacugccccgacucccacacccaguucugcuuccacggcacgugccgcuuccuggugcaggaggacaagcccgccugcgugugccacagcggguacgucggcgcgcggugcgagcacgccgaccuccuggccgugguggccgccucccagaagaagcaggcgaucaccgcccuggucguggugagcaucgucgcccucgccgugcugaucaucacgugcgugcugauccacugcugccagguccgcaagcacugcgaguggugccgggcccucaucugccgccacgagaagcccuccgcgcugcugaaggggcggaccgccugcugccacagcgagaccgugguguga

SEQ ID NO: 298 - RNA, 1173 nt, Artificial Sequence
  derived and/or modified CDS sequence (opt1) from Homo sapiens__NP_000651.3__HsTGFB1
augcccccgagcggccugcgccuccugccccugcuccugccccugcucuggcugcuggugcucacccccgggcggccggccgccggccuguccacgugcaagaccaucgacauggagcuggucaagcgcaagcggaucgaggcgauccgcgggcagauccucagcaagcugcggcuggccuccccgcccagccagggcgaggugccgcccgggccccuccccgaggccgugcuggcccuguacaacuccacccgcgaccgggucgccggcgagagcgcggagcccgagcccgagcccgaggccgacuacuacgccaaggaggugacccgcgugcucauggucgagacccacaacgagaucuacgacaaguucaagcaguccacgcacagcaucuacauguucuucaacaccuccgagcugcgggaggccgugcccgagcccgugcugcucagccgcgcggagcugcggcugcuccgccugaagcugaaggucgagcagcacguggagcucuaccagaaguacuccaacaacagcuggcgguaccuguccaaccgccugcucgccccgagcgacucccccgaguggcugagcuucgacgugaccggcgucgugcggcaguggcugucccgcgggggcgagaucgagggguuccggcucagcgcccacugcuccugcgacagccgcgacaacacccuccagguggacaucaacggcuucacgaccgggcggcgcggcgaccuggccaccauccacggcaugaaccggcccuuccugcugcugauggccacgccccucgagcgcgcgcagcaccuccagagcucccgccaccggcgcgcccuggacaccaacuacugcuucagcuccaccgagaagaacugcugcguccggcagcuguacaucgacuuccgcaaggaccugggguggaaguggauccacgagccgaagggcuaccacgccaacuucugccuggggcccugccccuacaucuggagccucgacacccaguacuccaaggugcuggcccuguacaaccagcacaaccccggcgccagcgcggccccgugcugcgugccccaggcccucgagccccugcccaucgucuacuacgugggccggaagccgaagguggagcagcuguccaacaugaucguccgcagcugcaagugcuccuga

SEQ ID NO: 299 - RNA, 1245 nt, Artificial Sequence
  derived and/or modified CDS sequence (opt1) from Homo sapiens__NP_003229.1__HsTGFB2
augcacuacugcgugcugagcgccuuccucauccugcaccuggucaccguggcccucucccugagcacgugcuccacccuggacauggaccaguucaugcgcaagcggaucgaggcgauccgcggccagauccucagcaagcugaagcugaccagcccgcccgaggacuaccccgagcccgaggaggugcccccggaggucaucuccaucuacaacuccacccgggaccuccugcaggagaaggccagccgccgggccgccgccugcgagcgcgagcgguccgacgaggaguacuacgcgaaggagguguacaagaucgacaugccgcccuucuuccccagcgagaacgccaucccgcccaccuucuaccgccccuacuuccggaucgugcgcuucgacgucuccgccauggagaagaacgccagcaaccuggugaaggcggaguuccggguguuccgccuccagaaccccaaggcccggguccccgagcagcgcaucgagcuguaccagauccugaaguccaaggaccucacgagccccacccagcgguacaucgacuccaagguggugaagacccgcgccgagggggaguggcugagcuucgacgucaccgacgccgugcacgaguggcugcaccacaaggaccggaaccucggcuucaagaucucccugcacugccccugcugcacguucgugcccagcaacaacuacaucaucccgaacaaguccgaggagcuggaggcccgcuucgcggggaucgacggcaccagcaccuacaccagcggggaccagaagacgaucaaguccacccggaagaagaacagcggcaagacgccccaccuccugcugaugcuccugcccuccuaccgccuggagagccagcagaccaaccggcgcaagaagcgcgcccucgacgccgccuacugcuuccggaacguccaggacaacugcugccugcgcccccuguacaucgacuucaagcgggaccucggcuggaaguggauccacgagccgaagggguacaacgccaacuucugcgcgggcgccugccccuaccugugguccagcgacacccagcacucccgcgugcugagccucuacaacaccaucaaccccgaggccuccgccagccccugcugcgugucccaggaccuggagccgcugaccauccucuacuacaucgggaagacccccaagaucgagcagcugagcaacaugaucgucaaguccugcaagugcagcuga

SEQ ID NO: 300 - RNA, 1239 nt, Artificial Sequence
  derived and/or modified CDS sequence (opt1) from Homo sapiens__NP_003230.1__HsTGFB3
augaagaugcaccuccagcgcgcccucguggugcuggcccugcucaacuucgcgaccgugagccugucccugagcacgugcaccacccucgacuucggccacaucaagaagaagcggguggaggccauccgcgggcagauccuguccaagcugcggcucaccagcccgcccgagcccaccgucaugacgcacgugcccuaccaggugcuggcccuguacaacuccacccgcgagcuccuggaggagaugcacggcgagcgggaggaggggugcacccaggagaacaccgagagcgaguacuacgccaaggagauccacaaguucgacaugauccagggccuggccgagcacaacgagcucgcggucugccccaaggggaucacguccaagguguuccgcuucaacgugagcuccgucgagaagaaccggaccaaccuguuccgcgccgaguuccgggugcugcgcgugccgaaccccagcuccaagcggaacgagcagcgcaucgagcuguuccagauccugcggcccgacgagcacaucgccaagcagcgcuacaucggcggcaagaaccugcccacccgggggaccgccgaguggcucagcuucgacgucacggacaccgugcgcgaguggcugcugcggcgcgaguccaaccucggccuggagaucagcauccacugcccgugccacaccuuccagcccaacggggacauccuggagaacauccacgaggugauggagaucaaguucaagggcgucgacaacgaggacgaccacgggcggggcgaccucggccgccugaagaagcagaaggaccaccacaacccccaccugauccucaugaugaucccgccccaccggcuggacaaccccgggcagggcgggcagcgcaagaagcgcgcgcuggacaccaacuacugcuuccggaaccucgaggagaacugcugcgugcgcccccuguacaucgacuuccggcaggaccugggcuggaagugggugcacgagcccaagggcuacuacgccaacuucugcuccgggccgugccccuaccuccgcagcgccgacacgacccacuccaccguccugggccuguacaacacccucaaccccgaggccagcgccucccccugcugcgugccgcaggaccuggagccccugacgauccucuacuacguggggcggacccccaaggucgagcagcugagcaacaugguggucaagagcugcaagugcuccuga

SEQ ID NO: 301 - RNA, 1386 nt, Artificial Sequence
  derived and/or modified CDS sequence (opt1) from Homo sapiens__NP_001057.1__HsTNFRSF1B
auggcccccguggccgucugggcggcccuggccgugggccucgagcugugggccgccgcgcacgcccugccggcccagguggccuucacccccuacgcgcccgagcccgggagcacgugccgccuccgggaguacuacgaccagaccgcccagaugugcugcuccaagugcagcccgggccagcacgccaaggucuucugcaccaagaccuccgacaccgugugcgacagcugcgaggacuccacguacacccagcuguggaacugggugcccgagugccugagcugcgggucccgcugcagcuccgaccaggucgagacccaggccugcacccgggagcagaaccgcaucugcacgugccggcccggcugguacugcgcccucagcaagcaggaggggugccgccugugcgcgccccugcggaagugccgcccgggcuucggcguggcccggcccgggaccgagaccuccgacguggucugcaagcccugcgcccccggcaccuucagcaacacgaccuccagcaccgacaucugccgcccgcaccagaucugcaacgugguggccauccccgggaacgccuccauggacgcggucugcaccagcacgucccccacccggagcauggcccccggcgccgugcaccucccgcagcccguguccacccgcagccagcacacccagcccacgcccgagccgagcaccgcccccuccaccagcuuccugcugcccauggggcccuccccgcccgccgagggcagcaccggcgacuucgcgcuccccgucgggcugaucgugggcgugacggcccuggggcuccugaucaucggcgucgugaacugcgugaucaugacccaggucaagaagaagccccugugccuccagcgggaggccaaggugccgcaccuccccgccgacaaggcccgcggcacccaggggcccgagcagcagcaccuccugaucaccgcgccguccagcuccagcuccagccuggaguccagcgccuccgcccuggaccggcgcgcccccacgcggaaccagccccaggcgcccggcguggaggccagcggggccggcgaggcccgcgccuccaccgggagcuccgacagcuccccgggcggccacgggacccaggucaacgugaccugcaucgucaacgugugcagcagcuccgaccacagcucccagugcagcucccaggcgagcuccacgaugggcgacaccgacagcucccccagcgagucccccaaggacgagcagguccccuucagcaaggaggagugcgccuuccggucccagcuggagaccccggagacccugcuggggagcacggaggagaagccccucccccugggcgugcccgacgccgggaugaagccguccuga

SEQ ID NO: 302 - RNA, 513 nt, Artificial Sequence
  derived and/or modified CDS sequence (opt1) from Homo sapiens__NP_002623.2__HsPGF
augcccgugaugcgccuguucccgugcuuccuccagcugcuggccggccucgcccugcccgcggucccgccccagcagugggcccugagcgccgggaacggcuccagcgagguggaggugguccccuuccaggaggugugggggcgguccuacugccgcgcccucgagcggcugguggacgucgugagcgaguaccccuccgagguggagcacauguucagccccuccugcgucagccugcuccgcugcaccggcugcugcggggacgagaaccugcacugcgugcccguggagaccgccaacgucacgaugcagcugcucaagauccgguccggcgaccgcccgagcuacguggagcugaccuucucccagcacgugcggugcgagugccgcccccugcgggagaagaugaagcccgagcgccggcgccccaagggccgggggaagcgccggcgcgagaagcagcggccgaccgacugccaccucugcggcgacgcggucccccgccgguga

SEQ ID NO: 303 - RNA, 1239 nt, Artificial Sequence
  derived and/or modified CDS sequence (opt1) from Homo sapiens__NP_001020537.2__HsVEGFA
augaccgaccgccagaccgacacggcccccagcccguccuaccaccuccugcccggccggcgccggaccguggacgccgcggccagccgcgggcagggccccgagcccgcccccgggggcggggucgagggcgugggcgcccgcgggguggcccugaagcuguucguccagcuccugggcugcucccgguucgggggcgcgguggugcgggccggggaggccgagcccagcggcgccgcgcgcuccgccagcuccggccgggaggagccccagcccgaggagggggaggaggaggaggagaaggaggaggagcgcggcccgcaguggcggcugggggcccgcaagcccggcagcuggaccggcgaggccgccgucugcgcggacuccgcccccgccgcccgggccccgcaggcgcucgcccgcgccagcgggcggggcgggcgcguggcccggcgcggcgccgaggaguccgggccgccccacagccccucccggcgcggcagcgcgucccgggccggccccgggcgcgccagcgagaccaugaacuuccugcuguccugggugcacuggagccucgcccugcugcucuaccugcaccacgccaaguggucccaggcggccccgauggccgagggcgggggccagaaccaccacgaggucgugaaguucauggacguguaccagcgcagcuacugccaccccaucgagacgcuggucgacaucuuccaggaguaccccgacgagaucgaguacaucuucaagcccagcugcgugccgcucaugcggugcgggggcugcugcaacgacgagggccuggagugcgugcccaccgaggaguccaacaucaccaugcagaucaugcgcaucaagccccaccaggggcagcacaucggcgagaugagcuuccugcagcacaacaagugcgagugccggcccaagaaggaccgcgcccggcaggagaagaaguccguccgcgggaagggcaaggggcagaagcggaagcgcaagaagucccgguacaagagcuggagcguguacgugggcgcgcgcugcugccucaugccguggucccugcccggcccccaccccugcgggccgugcagcgagcggcgcaagcaccuguucguccaggacccccagaccugcaagugcuccugcaagaacacggacagccggugcaaggcccgccagcucgagcugaacgagcggaccugccgcugcgacaagccccggcgcuga

SEQ ID NO: 304 - RNA, 699 nt, Artificial Sequence
  derived and/or modified CDS sequence (opt1) from Homo sapiens__NP_001165094.1__HsVEGFA
augaacuuccugcucagcugggugcacuggucccuggcccugcuccuguaccugcaccacgccaaguggagccaggcggcccccauggccgagggcgggggccagaaccaccacgaggucgugaaguucauggacguguaccagcgcuccuacugccacccgaucgagacccucgucgacaucuuccaggaguaccccgacgagaucgaguacaucuucaagcccagcugcgugccccugaugcggugcgggggcugcugcaacgacgaggggcuggagugcgugccgaccgaggaguccaacaucacgaugcagaucaugcgcaucaagccccaccagggccagcacaucggcgagaugagcuuccuccagcacaacaagugcgagugccggcccaagaaggaccgcgcccggcaggagaagaaguccguccgcgggaagggcaaggggcagaagcggaagcgcaagaagucccgguacaagagcuggagcguguacgugggcgcccgcugcugccugaugcccuggucccugccggggccccaccccugcggccccugcagcgagcggcgcaagcaccucuucguccaggacccgcagaccugcaagugcuccugcaagaacaccgacagccggugcaaggcgcgccagcuggagcugaacgagcggaccugccgcugcgacaagccccggcgcuga

SEQ ID NO: 305 - RNA, 624 nt, Artificial Sequence
  derived and/or modified CDS sequence (opt1) from Homo sapiens__NP_003368.1__HsVEGFB
augagcccccugcuccgccggcugcugcucgccgcccugcugcagcucgcgccggcccaggcccccgugucccagcccgacgcccccggccaccagcgcaaggucgugagcuggaucgacguguacacccgggcgaccugccagccgcgcgaggucguggugccccugacggucgagcugauggggaccguggccaagcagcucgugcccuccugcgucaccgugcagcggugcggcgggugcugccccgacgacggccuggagugcgugccgaccgggcagcaccagguccgcaugcagauccugaugauccgguaccccagcucccagcucggcgagaugagccuggaggagcacucccagugcgagugccgccccaagaagaaggacagcgccgugaagcccgaccgggccgccacgccgcaccaccgcccccagccccgguccgugcccggcugggacagcgcgccgggggcccccucccccgccgacaucacccaccccaccccggcccccggccccagcgcccacgcggcccccuccaccacgagcgcccugaccccggggcccgccgccgcggccgccgacgccgccgcguccagcgucgccaagggcggggccuga

SEQ ID NO: 306 - RNA, 1260 nt, Artificial Sequence
  derived and/or modified CDS sequence (opt1) from Homo sapiens__NP_005420.1__HsVEGFC
augcaccuccugggcuucuucagcguggccugcucccugcuggccgcggcccuccugcccgggccgcgcgaggcccccgccgccgcggccgccuucgagagcggccuggaccucuccgacgccgagcccgacgcgggggaggccaccgccuacgccagcaaggaccuggaggagcagcugcgguccgucagcuccguggacgagcucaugaccgugcuguaccccgaguacuggaagauguacaagugccagcugcgcaagggcggguggcagcacaaccgggagcaggccaaccucaacagccgcacggaggagaccaucaaguucgcggccgcccacuacaacaccgagauccugaaguccaucgacaacgaguggcggaagacccagugcaugccgcgcgaggucugcaucgacgugggcaaggaguucggcguggccacgaacaccuucuucaagccgcccugcgucagcguguaccggugcgggggcugcugcaacuccgaggggcugcagugcaugaacaccagcaccuccuaccucagcaagacgcuguucgagaucaccgugccccugucccagggccccaagcccgucaccaucagcuucgccaaccacaccuccugccgcugcaugagcaagcucgacguguaccgccaggugcacuccaucauccggcggagccugcccgcgacgcugccccagugccaggccgccaacaagaccugcccgaccaacuacauguggaacaaccacaucugccgcugccucgcccaggaggacuucauguucagcuccgacgccggggacgacagcaccgacggcuuccacgacaucugcggccccaacaaggagcuggacgaggagacgugccagugcgucugccgggcggggcugcgccccgccuccugcggcccccacaaggagcucgaccggaacagcugccagugcgugugcaagaacaagcuguucccgucccagugcggggccaaccgcgaguucgacgagaacacgugccagugcgugugcaagcggaccugcccccgcaaccagccccugaaccccggcaagugcgccugcgagugcaccgagagcccgcagaagugccuccugaagggcaagaaguuccaccaccagaccugcuccugcuaccggcgccccugcaccaaccggcagaaggccugcgagcccggguucagcuacuccgaggaggucugccgcugcgugcccagcuacuggaagcgcccgcagauguccuga

SEQ ID NO: 307 - RNA, 1065 nt, Artificial Sequence
  derived and/or modified CDS sequence (opt1) from Homo sapiens__NP_004460.1__HsVEGFD
auguaccgcgaguggguggucgugaacguguucaugaugcuguacguccagcucgugcagggcagcuccaacgagcacgggcccgugaagcggagcucccagagcacccuggagcgcuccgagcagcagauccgggccgccagcucccuggaggagcuccugcgcaucacccacagcgaggacuggaagcuguggcggugccgccuccggcugaaguccuucacgagcauggacucccgcagcgcgucccaccggagcacccgcuucgccgccaccuucuacgacaucgagacccugaaggucaucgacgaggaguggcagcggacgcagugcuccccgcgcgagaccugcguggagguggccagcgagcucggcaaguccaccaacaccuucuucaagccgcccugcgucaacguguuccggugcgggggcugcugcaacgaggagagccugaucugcaugaacacguccaccagcuacaucagcaagcagcuguucgagaucuccgugccccucaccagcguccccgagcuggugcccgugaaggucgccaaccacaccgggugcaagugccugcccacggcgccccgccacccguacuccaucauccggcgcagcauccagauccccgaggaggaccggugcucccacagcaagaagcucugccccaucgacaugcugugggacuccaacaagugcaagugcgugcugcaggaggagaacccccucgccggcaccgaggaccacagccaccuccaggagccggcccugugcggcccccacaugauguucgacgaggaccgcugcgagugcgugugcaagacccccugccccaaggaccugauccagcacccgaagaacugcuccugcuucgagugcaaggagagccuggagaccugcugccagaagcacaagcuguuccaccccgacacgugcuccugcgaggaccggugccccuuccacacccgccccugcgccagcgggaagaccgcgugcgccaagcacugccgguucccgaaggagaagcgcgccgcccagggcccccacucccgcaagaaccccuga

SEQ ID NO: 308 - RNA, 72 nt, Artificial Sequence
  derived and/or modified CDS sequence (opt2) from Homo sapiens__AAA59606.1__signal peptide-HLA-A2-SP
auggccgucauggccccccgcacccucguccuccuccucuccggcgcccucgcccucacccagaccugggcc

SEQ ID NO: 309 - RNA, 69 nt, Artificial Sequence
  derived and/or modified CDS sequence (opt2) from Homo sapiens__AAA61213.1__signal peptide-HsPLAT
auggacgccaugaagcgcggccucugcugcguccuccuccucugcggcgccgucuucgucucccccucc

SEQ ID NO: 310 - RNA, 81 nt, Artificial Sequence
  derived and/or modified CDS sequence (opt2) from Homo sapiens__NP_000790.2__signal peptide-HsEPO
augggcguccacgagugccccgccuggcucuggcuccuccucucccuccucucccucccccucggccuccccguccucggc

SEQ ID NO: 311 - RNA, 54 nt, Artificial Sequence
  derived and/or modified CDS sequence (opt2) from Homo sapiens__NP_000468.1__signal peptide-HsALB
augaagugggucaccuucaucucccuccucuuccucuucuccuccgccuacucc

SEQ ID NO: 312 - RNA, 18 nt, Artificial Sequence
  derived and/or modified CDS sequence (opt2) from Artificial____cleavage site-Furin
cgccgccgccgcaagcgc

SEQ ID NO: 313 - RNA, 630 nt, Artificial Sequence
  derived and/or modified CDS sequence (opt2) from Homo sapiens__NP_061986.1__HsFGF21
auggacuccgacgagaccggcuucgagcacuccggccucugggucuccguccucgccggccuccuccucggcgccugccaggcccaccccauccccgacuccuccccccuccuccaguucggcggccagguccgccagcgcuaccucuacaccgacgacgcccagcagaccgaggcccaccucgagauccgcgaggacggcaccgucggcggcgccgccgaccagucccccgagucccuccuccagcucaaggcccucaagcccggcgucauccagauccucggcgucaagaccucccgcuuccucugccagcgccccgacggcgcccucuacggcucccuccacuucgaccccgaggccugcuccuuccgcgagcuccuccucgaggacggcuacaacgucuaccaguccgaggcccacggccucccccuccaccuccccggcaacaaguccccccaccgcgaccccgccccccgcggccccgcccgcuuccucccccuccccggccucccccccgcccuccccgagccccccggcauccucgccccccagccccccgacgucggcuccuccgacccccucuccauggucggccccucccagggccgcucccccuccuacgccuccuga

SEQ ID NO: 314 - RNA, 1410 nt, Artificial Sequence
  derived and/or modified CDS sequence (opt2) from Homo sapiens__NP_002412.1__HsMMP1
augcacuccuuccccccccuccuccuccuccucuucuggggcgucgucucccacuccuuccccgccacccucgagacccaggagcaggacgucgaccucguccagaaguaccucgagaaguacuacaaccucaagaacgacggccgccaggucgagaagcgccgcaacuccggccccgucgucgagaagcucaagcagaugcaggaguucuucggccucaaggucaccggcaagcccgacgccgagacccucaaggucaugaagcagccccgcugcggcguccccgacgucgcccaguucguccucaccgagggcaacccccgcugggagcagacccaccucaccuaccgcaucgagaacuacacccccgaccucccccgcgccgacgucgaccacgccaucgagaaggccuuccagcucugguccaacgucaccccccucaccuucaccaaggucuccgagggccaggccgacaucaugaucuccuucguccgcggcgaccaccgcgacaacucccccuucgacggccccggcggcaaccucgcccacgccuuccagcccggccccggcaucggcggcgacgcccacuucgacgaggacgagcgcuggaccaacaacuuccgcgaguacaaccuccaccgcgucgccgcccacgagcucggccacucccucggccucucccacuccaccgacaucggcgcccucauguaccccuccuacaccuucuccggcgacguccagcucgcccaggacgacaucgacggcauccaggccaucuacggccgcucccagaaccccguccagcccaucggcccccagacccccaaggccugcgacuccaagcucaccuucgacgccaucaccaccauccgcggcgaggucauguucuucaaggaccgcuucuacaugcgcaccaaccccuucuaccccgaggucgagcucaacuucaucuccgucuucuggccccagcuccccaacggccucgaggccgccuacgaguucgccgaccgcgacgagguccgcuucuucaagggcaacaaguacugggccguccagggccagaacguccuccacggcuaccccaaggacaucuacuccuccuucggcuucccccgcaccgucaagcacaucgacgccgcccucuccgaggagaacaccggcaagaccuacuucuucgucgccaacaaguacuggcgcuacgacgaguacaagcgcuccauggaccccggcuaccccaagaugaucgcccacgacuuccccggcaucggccacaaggucgacgccgucuucaugaaggacggcuucuucuacuucuuccacggcacccgccaguacaaguucgaccccaagaccaagcgcauccucacccuccagaaggccaacuccugguucaacugccgcaagaacuga

SEQ ID NO: 315 - RNA, 1170 nt, Artificial Sequence
  derived and/or modified CDS sequence (opt2) from Homo sapiens__NP_002412.1__HsMMP1(1-19,100-469)
augcacuccuuccccccccuccuccuccuccucuucuggggcgucgucucccacuccuucguccucaccgagggcaacccccgcugggagcagacccaccucaccuaccgcaucgagaacuacacccccgaccucccccgcgccgacgucgaccacgccaucgagaaggccuuccagcucugguccaacgucaccccccucaccuucaccaaggucuccgagggccaggccgacaucaugaucuccuucguccgcggcgaccaccgcgacaacucccccuucgacggccccggcggcaaccucgcccacgccuuccagcccggccccggcaucggcggcgacgcccacuucgacgaggacgagcgcuggaccaacaacuuccgcgaguacaaccuccaccgcgucgccgcccacgagcucggccacucccucggccucucccacuccaccgacaucggcgcccucauguaccccuccuacaccuucuccggcgacguccagcucgcccaggacgacaucgacggcauccaggccaucuacggccgcucccagaaccccguccagcccaucggcccccagacccccaaggccugcgacuccaagcucaccuucgacgccaucaccaccauccgcggcgaggucauguucuucaaggaccgcuucuacaugcgcaccaaccccuucuaccccgaggucgagcucaacuucaucuccgucuucuggccccagcuccccaacggccucgaggccgccuacgaguucgccgaccgcgacgagguccgcuucuucaagggcaacaaguacugggccguccagggccagaacguccuccacggcuaccccaaggacaucuacuccuccuucggcuucccccgcaccgucaagcacaucgacgccgcccucuccgaggagaacaccggcaagaccuacuucuucgucgccaacaaguacuggcgcuacgacgaguacaagcgcuccauggaccccggcuaccccaagaugaucgcccacgacuuccccggcaucggccacaaggucgacgccgucuucaugaaggacggcuucuucuacuucuuccacggcacccgccaguacaaguucgaccccaagaccaagcgcauccucacccuccagaaggccaacuccugguucaacugccgcaagaacuga

SEQ ID NO: 316 - RNA, 3357 nt, Artificial Sequence
  derived and/or modified CDS sequence (opt2) from Clostridium histolyticum__BAA77453.1__ColG
augaagaagaacauccucaagauccucauggacuccuacuccaaggaguccaagauccagaccguccgccgcgucaccuccgucucccuccucgccgucuaccucaccaugaacaccuccucccucguccucgccaagcccaucgagaacaccaacgacaccuccaucaagaacgucgagaagcuccgcaacgcccccaacgaggagaacuccaagaaggucgaggacuccaagaacgacaaggucgagcacgucaagaacaucgaggaggccaaggucgagcaggucgcccccgaggucaaguccaaguccacccuccgcuccgccuccaucgccaacaccaacuccgagaaguacgacuucgaguaccucaacggccucuccuacaccgagcucaccaaccucaucaagaacaucaaguggaaccagaucaacggccucuucaacuacuccaccggcucccagaaguucuucggcgacaagaaccgcguccaggccaucaucaacgcccuccaggaguccggccgcaccuacaccgccaacgacaugaagggcaucgagaccuucaccgagguccuccgcgccggcuucuaccucggcuacuacaacgacggccucuccuaccucaacgaccgcaacuuccaggacaagugcauccccgccaugaucgccauccagaagaaccccaacuucaagcucggcaccgccguccaggacgaggucaucaccucccucggcaagcucaucggcaacgccuccgccaacgccgaggucgucaacaacugcguccccguccucaagcaguuccgcgagaaccucaaccaguacgcccccgacuacgucaagggcaccgccgucaacgagcucaucaagggcaucgaguucgacuucuccggcgccgccuacgagaaggacgucaagaccaugcccugguacggcaagaucgaccccuucaucaacgagcucaaggcccucggccucuacggcaacaucaccuccgccaccgagugggccuccgacgucggcaucuacuaccucuccaaguucggccucuacuccaccaaccgcaacgacaucguccagucccucgagaaggccgucgacauguacaaguacggcaagaucgccuucgucgccauggagcgcaucaccugggacuacgacggcaucggcuccaacggcaagaaggucgaccacgacaaguuccucgacgacgccgagaagcacuaccuccccaagaccuacaccuucgacaacggcaccuucaucauccgcgccggcgacaaggucuccgaggagaagaucaagcgccucuacugggccucccgcgaggucaagucccaguuccaccgcgucgucggcaacgacaaggcccucgaggucggcaacgccgacgacguccucaccaugaagaucuucaacucccccgaggaguacaaguucaacaccaacaucaacggcgucuccaccgacaacggcggccucuacaucgagccccgcggcaccuucuacaccuacgagcgcaccccccagcaguccaucuucucccucgaggagcucuuccgccacgaguacacccacuaccuccaggcccgcuaccucgucgacggccucuggggccagggccccuucuacgagaagaaccgccucaccugguucgacgagggcaccgccgaguucuucgccggcuccacccgcaccuccggcguccucccccgcaaguccauccucggcuaccucgccaaggacaaggucgaccaccgcuacucccucaagaagacccucaacuccggcuacgacgacuccgacuggauguucuacaacuacggcuucgccgucgcccacuaccucuacgagaaggacaugcccaccuucaucaagaugaacaaggccauccucaacaccgacgucaaguccuacgacgagaucaucaagaagcucuccgacgacgccaacaagaacaccgaguaccagaaccacauccaggagcucgccgacaaguaccagggcgccggcaucccccucgucuccgacgacuaccucaaggaccacggcuacaagaaggccuccgaggucuacuccgagaucuccaaggccgccucccucaccaacaccuccgucaccgccgagaagucccaguacuucaacaccuucacccuccgcggcaccuacaccggcgagaccuccaagggcgaguucaaggacugggacgagauguccaagaagcucgacggcacccucgagucccucgccaagaacuccugguccggcuacaagacccucaccgccuacuucaccaacuaccgcgucaccuccgacaacaagguccaguacgacgucgucuuccacggcguccucaccgacaacgccgacaucuccaacaacaaggcccccaucgccaaggucaccggccccuccaccggcgccgucggccgcaacaucgaguucuccggcaaggacuccaaggacgaggacggcaagaucgucuccuacgacugggacuucggcgacggcgccaccucccgcggcaagaacuccguccacgccuacaagaaggccggcaccuacaacgucacccucaaggucaccgacgacaagggcgccaccgccaccgaguccuucaccaucgagaucaagaacgaggacaccaccacccccaucaccaaggagauggagcccaacgacgacaucaaggaggccaacggccccaucgucgagggcgucaccgucaagggcgaccucaacggcuccgacgacgccgacaccuucuacuucgacgucaaggaggacggcgacgucaccaucgagcuccccuacuccggcuccuccaacuucaccuggcucgucuacaaggagggcgacgaccagaaccacaucgccuccggcaucgacaagaacaacuccaaggucggcaccuucaaguccaccaagggccgccacuacgucuucaucuacaagcacgacuccgccuccaacaucuccuacucccucaacaucaagggccucggcaacgagaagcucaaggagaaggagaacaacgacuccuccgacaaggccaccgucauccccaacuucaacaccaccaugcagggcucccuccucggcgacgacucccgcgacuacuacuccuucgaggucaaggaggagggcgaggucaacaucgagcucgacaagaaggacgaguucggcgucaccuggacccuccaccccgaguccaacaucaacgaccgcaucaccuacggccaggucgacggcaacaaggucuccaacaaggucaagcuccgccccggcaaguacuaccuccucgucuacaaguacuccggcuccggcaacuacgagcuccgcgucaacaaguga

SEQ ID NO: 317 - RNA, 3081 nt, Artificial Sequence
  derived and/or modified CDS sequence (opt2) from Clostridium histolyticum__BAA77453.1__HsALB(1-18)_ColG(111-1118)
augaagugggucaccuucaucucccuccucuuccucuucuccuccgccuacuccaucgccaacaccaacuccgagaaguacgacuucgaguaccucaacggccucuccuacaccgagcucaccaaccucaucaagaacaucaaguggaaccagaucaacggccucuucaacuacuccaccggcucccagaaguucuucggcgacaagaaccgcguccaggccaucaucaacgcccuccaggaguccggccgcaccuacaccgccaacgacaugaagggcaucgagaccuucaccgagguccuccgcgccggcuucuaccucggcuacuacaacgacggccucuccuaccucaacgaccgcaacuuccaggacaagugcauccccgccaugaucgccauccagaagaaccccaacuucaagcucggcaccgccguccaggacgaggucaucaccucccucggcaagcucaucggcaacgccuccgccaacgccgaggucgucaacaacugcguccccguccucaagcaguuccgcgagaaccucaaccaguacgcccccgacuacgucaagggcaccgccgucaacgagcucaucaagggcaucgaguucgacuucuccggcgccgccuacgagaaggacgucaagaccaugcccugguacggcaagaucgaccccuucaucaacgagcucaaggcccucggccucuacggcaacaucaccuccgccaccgagugggccuccgacgucggcaucuacuaccucuccaaguucggccucuacuccaccaaccgcaacgacaucguccagucccucgagaaggccgucgacauguacaaguacggcaagaucgccuucgucgccauggagcgcaucaccugggacuacgacggcaucggcuccaacggcaagaaggucgaccacgacaaguuccucgacgacgccgagaagcacuaccuccccaagaccuacaccuucgacaacggcaccuucaucauccgcgccggcgacaaggucuccgaggagaagaucaagcgccucuacugggccucccgcgaggucaagucccaguuccaccgcgucgucggcaacgacaaggcccucgaggucggcaacgccgacgacguccucaccaugaagaucuucaacucccccgaggaguacaaguucaacaccaacaucaacggcgucuccaccgacaacggcggccucuacaucgagccccgcggcaccuucuacaccuacgagcgcaccccccagcaguccaucuucucccucgaggagcucuuccgccacgaguacacccacuaccuccaggcccgcuaccucgucgacggccucuggggccagggccccuucuacgagaagaaccgccucaccugguucgacgagggcaccgccgaguucuucgccggcuccacccgcaccuccggcguccucccccgcaaguccauccucggcuaccucgccaaggacaaggucgaccaccgcuacucccucaagaagacccucaacuccggcuacgacgacuccgacuggauguucuacaacuacggcuucgccgucgcccacuaccucuacgagaaggacaugcccaccuucaucaagaugaacaaggccauccucaacaccgacgucaaguccuacgacgagaucaucaagaagcucuccgacgacgccaacaagaacaccgaguaccagaaccacauccaggagcucgccgacaaguaccagggcgccggcaucccccucgucuccgacgacuaccucaaggaccacggcuacaagaaggccuccgaggucuacuccgagaucuccaaggccgccucccucaccaacaccuccgucaccgccgagaagucccaguacuucaacaccuucacccuccgcggcaccuacaccggcgagaccuccaagggcgaguucaaggacugggacgagauguccaagaagcucgacggcacccucgagucccucgccaagaacuccugguccggcuacaagacccucaccgccuacuucaccaacuaccgcgucaccuccgacaacaagguccaguacgacgucgucuuccacggcguccucaccgacaacgccgacaucuccaacaacaaggcccccaucgccaaggucaccggccccuccaccggcgccgucggccgcaacaucgaguucuccggcaaggacuccaaggacgaggacggcaagaucgucuccuacgacugggacuucggcgacggcgccaccucccgcggcaagaacuccguccacgccuacaagaaggccggcaccuacaacgucacccucaaggucaccgacgacaagggcgccaccgccaccgaguccuucaccaucgagaucaagaacgaggacaccaccacccccaucaccaaggagauggagcccaacgacgacaucaaggaggccaacggccccaucgucgagggcgucaccgucaagggcgaccucaacggcuccgacgacgccgacaccuucuacuucgacgucaaggaggacggcgacgucaccaucgagcuccccuacuccggcuccuccaacuucaccuggcucgucuacaaggagggcgacgaccagaaccacaucgccuccggcaucgacaagaacaacuccaaggucggcaccuucaaguccaccaagggccgccacuacgucuucaucuacaagcacgacuccgccuccaacaucuccuacucccucaacaucaagggccucggcaacgagaagcucaaggagaaggagaacaacgacuccuccgacaaggccaccgucauccccaacuucaacaccaccaugcagggcucccuccucggcgacgacucccgcgacuacuacuccuucgaggucaaggaggagggcgaggucaacaucgagcucgacaagaaggacgaguucggcgucaccuggacccuccaccccgaguccaacaucaacgaccgcaucaccuacggccaggucgacggcaacaaggucuccaacaaggucaagcuccgccccggcaaguacuaccuccucgucuacaaguacuccggcuccggcaacuacgagcuccgcgucaacaaguga

SEQ ID NO: 318 - RNA, 3429 nt, Artificial Sequence
  derived and/or modified CDS sequence (opt2) from Clostridium histolyticum__BAA77453.1__HsALB(1-18)_ColG(1-110)_CS-F_ColG(111-1 118)
augaagugggucaccuucaucucccuccucuuccucuucuccuccgccuacuccaugaagaagaacauccucaagauccucauggacuccuacuccaaggaguccaagauccagaccguccgccgcgucaccuccgucucccuccucgccgucuaccucaccaugaacaccuccucccucguccucgccaagcccaucgagaacaccaacgacaccuccaucaagaacgucgagaagcuccgcaacgcccccaacgaggagaacuccaagaaggucgaggacuccaagaacgacaaggucgagcacgucaagaacaucgaggaggccaaggucgagcaggucgcccccgaggucaaguccaaguccacccuccgcuccgccucccgccgccgccgcaagcgcaucgccaacaccaacuccgagaaguacgacuucgaguaccucaacggccucuccuacaccgagcucaccaaccucaucaagaacaucaaguggaaccagaucaacggccucuucaacuacuccaccggcucccagaaguucuucggcgacaagaaccgcguccaggccaucaucaacgcccuccaggaguccggccgcaccuacaccgccaacgacaugaagggcaucgagaccuucaccgagguccuccgcgccggcuucuaccucggcuacuacaacgacggccucuccuaccucaacgaccgcaacuuccaggacaagugcauccccgccaugaucgccauccagaagaaccccaacuucaagcucggcaccgccguccaggacgaggucaucaccucccucggcaagcucaucggcaacgccuccgccaacgccgaggucgucaacaacugcguccccguccucaagcaguuccgcgagaaccucaaccaguacgcccccgacuacgucaagggcaccgccgucaacgagcucaucaagggcaucgaguucgacuucuccggcgccgccuacgagaaggacgucaagaccaugcccugguacggcaagaucgaccccuucaucaacgagcucaaggcccucggccucuacggcaacaucaccuccgccaccgagugggccuccgacgucggcaucuacuaccucuccaaguucggccucuacuccaccaaccgcaacgacaucguccagucccucgagaaggccgucgacauguacaaguacggcaagaucgccuucgucgccauggagcgcaucaccugggacuacgacggcaucggcuccaacggcaagaaggucgaccacgacaaguuccucgacgacgccgagaagcacuaccuccccaagaccuacaccuucgacaacggcaccuucaucauccgcgccggcgacaaggucuccgaggagaagaucaagcgccucuacugggccucccgcgaggucaagucccaguuccaccgcgucgucggcaacgacaaggcccucgaggucggcaacgccgacgacguccucaccaugaagaucuucaacucccccgaggaguacaaguucaacaccaacaucaacggcgucuccaccgacaacggcggccucuacaucgagccccgcggcaccuucuacaccuacgagcgcaccccccagcaguccaucuucucccucgaggagcucuuccgccacgaguacacccacuaccuccaggcccgcuaccucgucgacggccucuggggccagggccccuucuacgagaagaaccgccucaccugguucgacgagggcaccgccgaguucuucgccggcuccacccgcaccuccggcguccucccccgcaaguccauccucggcuaccucgccaaggacaaggucgaccaccgcuacucccucaagaagacccucaacuccggcuacgacgacuccgacuggauguucuacaacuacggcuucgccgucgcccacuaccucuacgagaaggacaugcccaccuucaucaagaugaacaaggccauccucaacaccgacgucaaguccuacgacgagaucaucaagaagcucuccgacgacgccaacaagaacaccgaguaccagaaccacauccaggagcucgccgacaaguaccagggcgccggcaucccccucgucuccgacgacuaccucaaggaccacggcuacaagaaggccuccgaggucuacuccgagaucuccaaggccgccucccucaccaacaccuccgucaccgccgagaagucccaguacuucaacaccuucacccuccgcggcaccuacaccggcgagaccuccaagggcgaguucaaggacugggacgagauguccaagaagcucgacggcacccucgagucccucgccaagaacuccugguccggcuacaagacccucaccgccuacuucaccaacuaccgcgucaccuccgacaacaagguccaguacgacgucgucuuccacggcguccucaccgacaacgccgacaucuccaacaacaaggcccccaucgccaaggucaccggccccuccaccggcgccgucggccgcaacaucgaguucuccggcaaggacuccaaggacgaggacggcaagaucgucuccuacgacugggacuucggcgacggcgccaccucccgcggcaagaacuccguccacgccuacaagaaggccggcaccuacaacgucacccucaaggucaccgacgacaagggcgccaccgccaccgaguccuucaccaucgagaucaagaacgaggacaccaccacccccaucaccaaggagauggagcccaacgacgacaucaaggaggccaacggccccaucgucgagggcgucaccgucaagggcgaccucaacggcuccgacgacgccgacaccuucuacuucgacgucaaggaggacggcgacgucaccaucgagcuccccuacuccggcuccuccaacuucaccuggcucgucuacaaggagggcgacgaccagaaccacaucgccuccggcaucgacaagaacaacuccaaggucggcaccuucaaguccaccaagggccgccacuacgucuucaucuacaagcacgacuccgccuccaacaucuccuacucccucaacaucaagggccucggcaacgagaagcucaaggagaaggagaacaacgacuccuccgacaaggccaccgucauccccaacuucaacaccaccaugcagggcucccuccucggcgacgacucccgcgacuacuacuccuucgaggucaaggaggagggcgaggucaacaucgagcucgacaagaaggacgaguucggcgucaccuggacccuccaccccgaguccaacaucaacgaccgcaucaccuacggccaggucgacggcaacaaggucuccaacaaggucaagcuccgccccggcaaguacuaccuccucgucuacaaguacuccggcuccggcaacuacgagcuccgcgucaacaaguga

SEQ ID NO: 319 - RNA, 3105 nt, Artificial Sequence
  derived and/or modified CDS sequence (opt2) from Clostridium histolyticum__BAA34542.1__ColH
augaacuuccucaagaucauccucaaccgcggcaagaccaugaagcgcaagugccucuccaagcgccucaugcucgccaucaccauggccaccaucuucaccgucaacuccacccuccccaucuacgccgccgucgacaagaacaacgccaccgccgccguccagaacgaguccaagcgcuacaccgucuccuaccucaagacccucaacuacuacgaccucgucgaccuccucgucaagaccgagaucgagaaccuccccgaccucuuccaguacuccuccgacgccaaggaguucuacggcaacaagacccgcauguccuucaucauggacgagaucggccgccgcgccccccaguacaccgagaucgaccacaagggcauccccacccucgucgaggucguccgcgccggcuucuaccucggcuuccacaacaaggagcucaacgagaucaacaagcgcuccuucaaggagcgcgucauccccuccauccucgccauccagaagaaccccaacuucaagcucggcaccgagguccaggacaagaucgucuccgccaccggccuccucgccggcaacgagaccgccccccccgaggucgucaacaacuucacccccauccuccaggacugcaucaagaacaucgaccgcuacgcccucgacgaccucaaguccaaggcccucuucaacguccucgccgcccccaccuacgacaucaccgaguaccuccgcgccaccaaggagaagcccgagaacacccccugguacggcaagaucgacggcuucaucaacgagcucaagaagcucgcccucuacggcaagaucaacgacaacaacuccuggaucaucgacaacggcaucuaccacaucgccccccucggcaagcuccacuccaacaacaagaucggcaucgagacccucaccgaggucaugaaggucuaccccuaccucuccaugcagcaccuccaguccgccgaccagaucaagcgccacuacgacuccaaggacgccgagggcaacaagaucccccucgacaaguucaagaaggagggcaaggagaaguacugccccaagaccuacaccuucgacgacggcaaggucaucaucaaggccggcgcccgcgucgaggaggagaaggucaagcgccucuacugggccuccaaggaggucaacucccaguucuuccgcgucuacggcaucgacaagccccucgaggagggcaaccccgacgacauccucaccauggucaucuacaacucccccgaggaguacaagcucaacuccguccucuacggcuacgacaccaacaacggcggcauguacaucgagcccgagggcaccuucuucaccuacgagcgcgaggcccaggaguccaccuacacccucgaggagcucuuccgccacgaguacacccacuaccuccagggccgcuacgccguccccggccaguggggccgcaccaagcucuacgacaacgaccgccucaccugguacgaggagggcggcgccgagcucuucgccggcuccacccgcaccuccggcauccucccccgcaaguccaucgucuccaacauccacaacaccacccgcaacaaccgcuacaagcucuccgacaccguccacuccaaguacggcgccuccuucgaguucuacaacuacgccugcauguucauggacuacauguacaacaaggacaugggcauccucaacaagcucaacgaccucgccaagaacaacgacgucgacggcuacgacaacuacauccgcgaccucuccuccaacuacgcccucaacgacaaguaccaggaccacaugcaggagcgcaucgacaacuacgagaaccucaccguccccuucgucgccgacgacuaccucguccgccacgccuacaagaaccccaacgagaucuacuccgagaucuccgaggucgccaagcucaaggacgccaaguccgaggucaagaagucccaguacuucuccaccuucacccuccgcggcuccuacaccggcggcgccuccaagggcaagcucgaggaccagaaggccaugaacaaguucaucgacgacucccucaagaagcucgacaccuacuccugguccggcuacaagacccucaccgccuacuucaccaacuacaaggucgacuccuccaaccgcgucaccuacgacgucgucuuccacggcuaccuccccaacgagggcgacuccaagaacucccuccccuacggcaagaucaacggcaccuacaagggcaccgagaaggagaagaucaaguucuccuccgagggcuccuucgaccccgacggcaagaucgucuccuacgagugggacuucggcgacggcaacaaguccaacgaggagaaccccgagcacuccuacgacaaggucggcaccuacaccgucaagcucaaggucaccgacgacaagggcgaguccuccgucuccaccaccaccgccgagaucaaggaccucuccgagaacaagcuccccgucaucuacaugcacguccccaaguccggcgcccucaaccagaaggucgucuucuacggcaagggcaccuacgaccccgacggcuccaucgccggcuaccagugggacuucggcgacggcuccgacuucuccuccgagcagaaccccucccacgucuacaccaagaagggcgaguacaccgucacccuccgcgucauggacuccuccggccagauguccgagaagaccaugaagaucaagaucaccgaccccgucuaccccaucggcaccgagaaggagcccaacaacuccaaggagaccgccuccggccccaucguccccggcauccccgucuccggcaccaucgagaacaccuccgaccaggacuacuucuacuucgacgucaucacccccggcgaggucaagaucgacaucaacaagcucggcuacggcggcgccaccugggucgucuacgacgagaacaacaacgccgucuccuacgccaccgacgacggccagaaccucuccggcaaguucaaggccgacaagcccggccgcuacuacauccaccucuacauguucaacggcuccuacaugcccuaccgcaucaacaucgagggcuccgucggccgcuga

SEQ ID NO: 320 - RNA, 3066 nt, Artificial Sequence
  derived and/or modified CDS sequence (opt2) from Clostridium histolyticum__BAA34542.1__ColH
augaagcgcaagugccucuccaagcgccucaugcucgccaucaccauggccaccaucuucaccgucaacuccacccuccccaucuacgccgccgucgacaagaacaacgccaccgccgccguccagaacgaguccaagcgcuacaccgucuccuaccucaagacccucaacuacuacgaccucgucgaccuccucgucaagaccgagaucgagaaccuccccgaccucuuccaguacuccuccgacgccaaggaguucuacggcaacaagacccgcauguccuucaucauggacgagaucggccgccgcgccccccaguacaccgagaucgaccacaagggcauccccacccucgucgaggucguccgcgccggcuucuaccucggcuuccacaacaaggagcucaacgagaucaacaagcgcuccuucaaggagcgcgucauccccuccauccucgccauccagaagaaccccaacuucaagcucggcaccgagguccaggacaagaucgucuccgccaccggccuccucgccggcaacgagaccgccccccccgaggucgucaacaacuucacccccauccuccaggacugcaucaagaacaucgaccgcuacgcccucgacgaccucaaguccaaggcccucuucaacguccucgccgcccccaccuacgacaucaccgaguaccuccgcgccaccaaggagaagcccgagaacacccccugguacggcaagaucgacggcuucaucaacgagcucaagaagcucgcccucuacggcaagaucaacgacaacaacuccuggaucaucgacaacggcaucuaccacaucgccccccucggcaagcuccacuccaacaacaagaucggcaucgagacccucaccgaggucaugaaggucuaccccuaccucuccaugcagcaccuccaguccgccgaccagaucaagcgccacuacgacuccaaggacgccgagggcaacaagaucccccucgacaaguucaagaaggagggcaaggagaaguacugccccaagaccuacaccuucgacgacggcaaggucaucaucaaggccggcgcccgcgucgaggaggagaaggucaagcgccucuacugggccuccaaggaggucaacucccaguucuuccgcgucuacggcaucgacaagccccucgaggagggcaaccccgacgacauccucaccauggucaucuacaacucccccgaggaguacaagcucaacuccguccucuacggcuacgacaccaacaacggcggcauguacaucgagcccgagggcaccuucuucaccuacgagcgcgaggcccaggaguccaccuacacccucgaggagcucuuccgccacgaguacacccacuaccuccagggccgcuacgccguccccggccaguggggccgcaccaagcucuacgacaacgaccgccucaccugguacgaggagggcggcgccgagcucuucgccggcuccacccgcaccuccggcauccucccccgcaaguccaucgucuccaacauccacaacaccacccgcaacaaccgcuacaagcucuccgacaccguccacuccaaguacggcgccuccuucgaguucuacaacuacgccugcauguucauggacuacauguacaacaaggacaugggcauccucaacaagcucaacgaccucgccaagaacaacgacgucgacggcuacgacaacuacauccgcgaccucuccuccaacuacgcccucaacgacaaguaccaggaccacaugcaggagcgcaucgacaacuacgagaaccucaccguccccuucgucgccgacgacuaccucguccgccacgccuacaagaaccccaacgagaucuacuccgagaucuccgaggucgccaagcucaaggacgccaaguccgaggucaagaagucccaguacuucuccaccuucacccuccgcggcuccuacaccggcggcgccuccaagggcaagcucgaggaccagaaggccaugaacaaguucaucgacgacucccucaagaagcucgacaccuacuccugguccggcuacaagacccucaccgccuacuucaccaacuacaaggucgacuccuccaaccgcgucaccuacgacgucgucuuccacggcuaccuccccaacgagggcgacuccaagaacucccuccccuacggcaagaucaacggcaccuacaagggcaccgagaaggagaagaucaaguucuccuccgagggcuccuucgaccccgacggcaagaucgucuccuacgagugggacuucggcgacggcaacaaguccaacgaggagaaccccgagcacuccuacgacaaggucggcaccuacaccgucaagcucaaggucaccgacgacaagggcgaguccuccgucuccaccaccaccgccgagaucaaggaccucuccgagaacaagcuccccgucaucuacaugcacguccccaaguccggcgcccucaaccagaaggucgucuucuacggcaagggcaccuacgaccccgacggcuccaucgccggcuaccagugggacuucggcgacggcuccgacuucuccuccgagcagaaccccucccacgucuacaccaagaagggcgaguacaccgucacccuccgcgucauggacuccuccggccagauguccgagaagaccaugaagaucaagaucaccgaccccgucuaccccaucggcaccgagaaggagcccaacaacuccaaggagaccgccuccggccccaucguccccggcauccccgucuccggcaccaucgagaacaccuccgaccaggacuacuucuacuucgacgucaucacccccggcgaggucaagaucgacaucaacaagcucggcuacggcggcgccaccugggucgucuacgacgagaacaacaacgccgucuccuacgccaccgacgacggccagaaccucuccggcaaguucaaggccgacaagcccggccgcuacuacauccaccucuacauguucaacggcuccuacaugcccuaccgcaucaacaucgagggcuccgucggccgcuga

SEQ ID NO: 321 - RNA, 3000 nt, Artificial Sequence
  derived and/or modified CDS sequence (opt2) from Clostridium histolyticum__BAA34542.1__HsALB(1-18)_ColH(41-1021)
augaagugggucaccuucaucucccuccucuuccucuucuccuccgccuacuccguccagaacgaguccaagcgcuacaccgucuccuaccucaagacccucaacuacuacgaccucgucgaccuccucgucaagaccgagaucgagaaccuccccgaccucuuccaguacuccuccgacgccaaggaguucuacggcaacaagacccgcauguccuucaucauggacgagaucggccgccgcgccccccaguacaccgagaucgaccacaagggcauccccacccucgucgaggucguccgcgccggcuucuaccucggcuuccacaacaaggagcucaacgagaucaacaagcgcuccuucaaggagcgcgucauccccuccauccucgccauccagaagaaccccaacuucaagcucggcaccgagguccaggacaagaucgucuccgccaccggccuccucgccggcaacgagaccgccccccccgaggucgucaacaacuucacccccauccuccaggacugcaucaagaacaucgaccgcuacgcccucgacgaccucaaguccaaggcccucuucaacguccucgccgcccccaccuacgacaucaccgaguaccuccgcgccaccaaggagaagcccgagaacacccccugguacggcaagaucgacggcuucaucaacgagcucaagaagcucgcccucuacggcaagaucaacgacaacaacuccuggaucaucgacaacggcaucuaccacaucgccccccucggcaagcuccacuccaacaacaagaucggcaucgagacccucaccgaggucaugaaggucuaccccuaccucuccaugcagcaccuccaguccgccgaccagaucaagcgccacuacgacuccaaggacgccgagggcaacaagaucccccucgacaaguucaagaaggagggcaaggagaaguacugccccaagaccuacaccuucgacgacggcaaggucaucaucaaggccggcgcccgcgucgaggaggagaaggucaagcgccucuacugggccuccaaggaggucaacucccaguucuuccgcgucuacggcaucgacaagccccucgaggagggcaaccccgacgacauccucaccauggucaucuacaacucccccgaggaguacaagcucaacuccguccucuacggcuacgacaccaacaacggcggcauguacaucgagcccgagggcaccuucuucaccuacgagcgcgaggcccaggaguccaccuacacccucgaggagcucuuccgccacgaguacacccacuaccuccagggccgcuacgccguccccggccaguggggccgcaccaagcucuacgacaacgaccgccucaccugguacgaggagggcggcgccgagcucuucgccggcuccacccgcaccuccggcauccucccccgcaaguccaucgucuccaacauccacaacaccacccgcaacaaccgcuacaagcucuccgacaccguccacuccaaguacggcgccuccuucgaguucuacaacuacgccugcauguucauggacuacauguacaacaaggacaugggcauccucaacaagcucaacgaccucgccaagaacaacgacgucgacggcuacgacaacuacauccgcgaccucuccuccaacuacgcccucaacgacaaguaccaggaccacaugcaggagcgcaucgacaacuacgagaaccucaccguccccuucgucgccgacgacuaccucguccgccacgccuacaagaaccccaacgagaucuacuccgagaucuccgaggucgccaagcucaaggacgccaaguccgaggucaagaagucccaguacuucuccaccuucacccuccgcggcuccuacaccggcggcgccuccaagggcaagcucgaggaccagaaggccaugaacaaguucaucgacgacucccucaagaagcucgacaccuacuccugguccggcuacaagacccucaccgccuacuucaccaacuacaaggucgacuccuccaaccgcgucaccuacgacgucgucuuccacggcuaccuccccaacgagggcgacuccaagaacucccuccccuacggcaagaucaacggcaccuacaagggcaccgagaaggagaagaucaaguucuccuccgagggcuccuucgaccccgacggcaagaucgucuccuacgagugggacuucggcgacggcaacaaguccaacgaggagaaccccgagcacuccuacgacaaggucggcaccuacaccgucaagcucaaggucaccgacgacaagggcgaguccuccgucuccaccaccaccgccgagaucaaggaccucuccgagaacaagcuccccgucaucuacaugcacguccccaaguccggcgcccucaaccagaaggucgucuucuacggcaagggcaccuacgaccccgacggcuccaucgccggcuaccagugggacuucggcgacggcuccgacuucuccuccgagcagaaccccucccacgucuacaccaagaagggcgaguacaccgucacccuccgcgucauggacuccuccggccagauguccgagaagaccaugaagaucaagaucaccgaccccgucuaccccaucggcaccgagaaggagcccaacaacuccaaggagaccgccuccggccccaucguccccggcauccccgucuccggcaccaucgagaacaccuccgaccaggacuacuucuacuucgacgucaucacccccggcgaggucaagaucgacaucaacaagcucggcuacggcggcgccaccugggucgucuacgacgagaacaacaacgccgucuccuacgccaccgacgacggccagaaccucuccggcaaguucaaggccgacaagcccggccgcuacuacauccaccucuacauguucaacggcuccuacaugcccuaccgcaucaacaucgagggcuccgucggccgcuga

SEQ ID NO: 322 - RNA, 3138 nt, Artificial Sequence
  derived and/or modified CDS sequence (opt2) from Clostridium histolyticum__BAA34542.1__HsALB(1-18)_ColH(1-40)_CS-F_ColH(41-102 1)
augaagugggucaccuucaucucccuccucuuccucuucuccuccgccuacuccaugaagcgcaagugccucuccaagcgccucaugcucgccaucaccauggccaccaucuucaccgucaacuccacccuccccaucuacgccgccgucgacaagaacaacgccaccgccgcccgccgccgccgcaagcgcguccagaacgaguccaagcgcuacaccgucuccuaccucaagacccucaacuacuacgaccucgucgaccuccucgucaagaccgagaucgagaaccuccccgaccucuuccaguacuccuccgacgccaaggaguucuacggcaacaagacccgcauguccuucaucauggacgagaucggccgccgcgccccccaguacaccgagaucgaccacaagggcauccccacccucgucgaggucguccgcgccggcuucuaccucggcuuccacaacaaggagcucaacgagaucaacaagcgcuccuucaaggagcgcgucauccccuccauccucgccauccagaagaaccccaacuucaagcucggcaccgagguccaggacaagaucgucuccgccaccggccuccucgccggcaacgagaccgccccccccgaggucgucaacaacuucacccccauccuccaggacugcaucaagaacaucgaccgcuacgcccucgacgaccucaaguccaaggcccucuucaacguccucgccgcccccaccuacgacaucaccgaguaccuccgcgccaccaaggagaagcccgagaacacccccugguacggcaagaucgacggcuucaucaacgagcucaagaagcucgcccucuacggcaagaucaacgacaacaacuccuggaucaucgacaacggcaucuaccacaucgccccccucggcaagcuccacuccaacaacaagaucggcaucgagacccucaccgaggucaugaaggucuaccccuaccucuccaugcagcaccuccaguccgccgaccagaucaagcgccacuacgacuccaaggacgccgagggcaacaagaucccccucgacaaguucaagaaggagggcaaggagaaguacugccccaagaccuacaccuucgacgacggcaaggucaucaucaaggccggcgcccgcgucgaggaggagaaggucaagcgccucuacugggccuccaaggaggucaacucccaguucuuccgcgucuacggcaucgacaagccccucgaggagggcaaccccgacgacauccucaccauggucaucuacaacucccccgaggaguacaagcucaacuccguccucuacggcuacgacaccaacaacggcggcauguacaucgagcccgagggcaccuucuucaccuacgagcgcgaggcccaggaguccaccuacacccucgaggagcucuuccgccacgaguacacccacuaccuccagggccgcuacgccguccccggccaguggggccgcaccaagcucuacgacaacgaccgccucaccugguacgaggagggcggcgccgagcucuucgccggcuccacccgcaccuccggcauccucccccgcaaguccaucgucuccaacauccacaacaccacccgcaacaaccgcuacaagcucuccgacaccguccacuccaaguacggcgccuccuucgaguucuacaacuacgccugcauguucauggacuacauguacaacaaggacaugggcauccucaacaagcucaacgaccucgccaagaacaacgacgucgacggcuacgacaacuacauccgcgaccucuccuccaacuacgcccucaacgacaaguaccaggaccacaugcaggagcgcaucgacaacuacgagaaccucaccguccccuucgucgccgacgacuaccucguccgccacgccuacaagaaccccaacgagaucuacuccgagaucuccgaggucgccaagcucaaggacgccaaguccgaggucaagaagucccaguacuucuccaccuucacccuccgcggcuccuacaccggcggcgccuccaagggcaagcucgaggaccagaaggccaugaacaaguucaucgacgacucccucaagaagcucgacaccuacuccugguccggcuacaagacccucaccgccuacuucaccaacuacaaggucgacuccuccaaccgcgucaccuacgacgucgucuuccacggcuaccuccccaacgagggcgacuccaagaacucccuccccuacggcaagaucaacggcaccuacaagggcaccgagaaggagaagaucaaguucuccuccgagggcuccuucgaccccgacggcaagaucgucuccuacgagugggacuucggcgacggcaacaaguccaacgaggagaaccccgagcacuccuacgacaaggucggcaccuacaccgucaagcucaaggucaccgacgacaagggcgaguccuccgucuccaccaccaccgccgagaucaaggaccucuccgagaacaagcuccccgucaucuacaugcacguccccaaguccggcgcccucaaccagaaggucgucuucuacggcaagggcaccuacgaccccgacggcuccaucgccggcuaccagugggacuucggcgacggcuccgacuucuccuccgagcagaaccccucccacgucuacaccaagaagggcgaguacaccgucacccuccgcgucauggacuccuccggccagauguccgagaagaccaugaagaucaagaucaccgaccccgucuaccccaucggcaccgagaaggagcccaacaacuccaaggagaccgccuccggccccaucguccccggcauccccgucuccggcaccaucgagaacaccuccgaccaggacuacuucuacuucgacgucaucacccccggcgaggucaagaucgacaucaacaagcucggcuacggcggcgccaccugggucgucuacgacgagaacaacaacgccgucuccuacgccaccgacgacggccagaaccucuccggcaaguucaaggccgacaagcccggccgcuacuacauccaccucuacauguucaacggcuccuacaugcccuaccgcaucaacaucgagggcuccgucggccgcuga

SEQ ID NO: 323 - RNA, 576 nt, Artificial Sequence
  derived and/or modified CDS sequence (opt2) from Homo sapiens__NP_001133.1__HsAMELX
augggcaccuggauccucuucgccugccuccucggcgccgccuucgccaugccccuccccccccaccccggccaccccggcuacaucaacuucuccuacgagguccucaccccccucaagugguaccaguccauccgcccccccuaccccuccuacggcuacgagcccaugggcggcuggcuccaccaccagaucauccccguccucucccagcagcacccccccacccacacccuccagccccaccaccacauccccgucguccccgcccagcagcccgucaucccccagcagcccaugaugcccguccccggccagcacuccaugacccccauccagcaccaccagcccaaccuccccccccccgcccagcagcccuaccagccccagcccguccagccccagccccaccagcccaugcagccccagccccccguccaccccaugcagccccuccccccccagcccccccucccccccauguuccccaugcagccccucccccccaugcuccccgaccucacccucgaggccuggcccuccaccgacaagaccaagcgcgaggaggucgacuga

SEQ ID NO: 324 - RNA, 135 nt, Artificial Sequence
  derived and/or modified CDS sequence (opt2) from Homo sapiens__NP_001133.1__HsAMELX-TRAP
augccccuccccccccaccccggccaccccggcuacaucaacuucuccuacgagguccucaccccccucaagugguaccaguccauccgcccccccuaccccuccuacggcuacgagcccaugggcggcugguga

SEQ ID NO: 325 - RNA, 168 nt, Artificial Sequence
  derived and/or modified CDS sequence (opt2) from Homo sapiens__NP_001133.1__HsAMELX-LRAP
augccccuccccccccaccccggccaccccggcuacaucaacuucuccuacgagguccucaccccccucaagugguaccaguccauccgccccccccccaugcuccccgaccucacccucgaggccuggcccuccaccgacaagaccaagcgcgaggaggucgacuga

SEQ ID NO: 326 - RNA, 207 nt, Artificial Sequence
  derived and/or modified CDS sequence (opt2) from Homo sapiens__NP_001133.1__HLA-A2-SP_HsAMELX(17-60)
auggccgucauggccccccgcacccucguccuccuccucuccggcgcccucgcccucacccagaccugggccaugccccuccccccccaccccggccaccccggcuacaucaacuucuccuacgagguccucaccccccucaagugguaccaguccauccgcccccccuaccccuccuacggcuacgagcccaugggcggcugguga

SEQ ID NO: 327 - RNA, 240 nt, Artificial Sequence
  derived and/or modified CDS sequence (opt2) from Homo sapiens__NP_001133.1__HLA-A2-SP_HsAMELX(17-47,168-191)
auggccgucauggccccccgcacccucguccuccuccucuccggcgcccucgcccucacccagaccugggccaugccccuccccccccaccccggccaccccggcuacaucaacuucuccuacgagguccucaccccccucaagugguaccaguccauccgccccccccccaugcuccccgaccucacccucgaggccuggcccuccaccgacaagaccaagcgcgaggaggucgacuga

SEQ ID NO: 328 - RNA, 579 nt, Artificial Sequence
  derived and/or modified CDS sequence (opt2) from Homo sapiens__NP_001134.1__HsAMELY
augggcaccuggauccucuucgccugccucgucggcgccgccuucgccaugccccuccccccccaccccggccaccccggcuacaucaacuucuccuacgagguccucaccccccucaagugguaccaguccaugauccgcccccccuacuccuccuacggcuacgagcccaugggcggcuggcuccaccaccagaucauccccgucgucucccagcagcacccccucacccacacccuccagucccaccaccacauccccgucguccccgcccagcagccccgcguccgccagcaggcccucaugcccguccccggccagcaguccaugacccccacccagcaccaccagcccaaccucccccuccccgcccagcagcccuuccagccccagcccguccagccccagccccaccagcccaugcagccccagccccccguccagcccaugcagccccuccucccccagcccccccucccccccauguucccccuccgcccccucccccccauccuccccgaccuccaccucgaggccuggcccgccaccgacaagaccaagcaggaggaggucgacuga

SEQ ID NO: 329 - RNA, 138 nt, Artificial Sequence
  derived and/or modified CDS sequence (opt2) from Homo sapiens__NP_001134.1__HsAMELY-TRAP
augccccuccccccccaccccggccaccccggcuacaucaacuucuccuacgagguccucaccccccucaagugguaccaguccaugauccgcccccccuacuccuccuacggcuacgagcccaugggcggcugguga

SEQ ID NO: 330 - RNA, 171 nt, Artificial Sequence
  derived and/or modified CDS sequence (opt2) from Homo sapiens__NP_001134.1__HsAMELY-LRAP
augccccuccccccccaccccggccaccccggcuacaucaacuucuccuacgagguccucaccccccucaagugguaccaguccaugauccgccccccccccauccuccccgaccuccaccucgaggccuggcccgccaccgacaagaccaagcaggaggaggucgacuga

SEQ ID NO: 331 - RNA, 210 nt, Artificial Sequence
  derived and/or modified CDS sequence (opt2) from Homo sapiens__NP_001134.1__HLA-A2-SP_HsAMELY(17-61)
auggccgucauggccccccgcacccucguccuccuccucuccggcgcccucgcccucacccagaccugggccaugccccuccccccccaccccggccaccccggcuacaucaacuucuccuacgagguccucaccccccucaagugguaccaguccaugauccgcccccccuacuccuccuacggcuacgagcccaugggcggcugguga

SEQ ID NO: 332 - RNA, 243 nt, Artificial Sequence
  derived and/or modified CDS sequence (opt2) from Homo sapiens__NP_001134.1__HLA-A2-SP_HsAMELY(17-48,169-192)
auggccgucauggccccccgcacccucguccuccuccucuccggcgcccucgcccucacccagaccugggccaugccccuccccccccaccccggccaccccggcuacaucaacuucuccuacgagguccucaccccccucaagugguaccaguccaugauccgccccccccccauccuccccgaccuccaccucgaggccuggcccgccaccgacaagaccaagcaggaggaggucgacuga

SEQ ID NO: 333 - RNA, 570 nt, Artificial Sequence
  derived and/or modified CDS sequence (opt2) from Sus scrofa__NP_999071.1__SsAMELX-001-1
augggcaccuggauccucuucgccugccuccucggcgccgccuucuccaugccccuccccccccaccccggccaccccggcuacaucaacuucuccuacgagguccucaccccccucaagugguaccagaacaugauccgccaccccuacaccuccuacggcuacgagcccaugggcggcuggcuccaccaccagaucauccccgucgucucccagcagaccccccagucccacgcccuccagccccaccaccacauccccaugguccccgcccagcagcccggcaucccccagcagcccaugaugccccuccccggccagcacuccaugacccccacccagcaccaccagcccaaccucccccuccccgcccagcagcccuuccagccccagcccguccagccccagccccaccagccccuccagccccagucccccaugcaccccauccagccccuccucccccagcccccccucccccccauguucuccaugcagucccuccuccccgaccucccccucgaggccuggcccgccaccgacaagaccaagcgcgaggaggucgacuga

SEQ ID NO: 334 - RNA, 138 nt, Artificial Sequence
  derived and/or modified CDS sequence (opt2) from Sus scrofa__NP_999071.1__SsAMELX-TRAP
augccccuccccccccaccccggccaccccggcuacaucaacuucuccuacgagguccucaccccccucaagugguaccagaacaugauccgccaccccuacaccuccuacggcuacgagcccaugggcggcugguga

SEQ ID NO: 335 - RNA, 171 nt, Artificial Sequence
  derived and/or modified CDS sequence (opt2) from Sus scrofa__NP_999071.1__SsAMELX-LRAP
augccccuccccccccaccccggccaccccggcuacaucaacuucuccuacgagguccucaccccccucaagugguaccagaacaugauccgccaccccucccuccuccccgaccucccccucgaggccuggcccgccaccgacaagaccaagcgcgaggaggucgacuga

SEQ ID NO: 336 - RNA, 210 nt, Artificial Sequence
  derived and/or modified CDS sequence (opt2) from Sus scrofa__NP_999071.1__HLA-A2-SP_SsAMEL(17-61)
auggccgucauggccccccgcacccucguccuccuccucuccggcgcccucgcccucacccagaccugggccaugccccuccccccccaccccggccaccccggcuacaucaacuucuccuacgagguccucaccccccucaagugguaccagaacaugauccgccaccccuacaccuccuacggcuacgagcccaugggcggcugguga

SEQ ID NO: 337 - RNA, 243 nt, Artificial Sequence
  derived and/or modified CDS sequence (opt2) from Sus scrofa__NP_999071.1__HLA-A2-SP_SsAMEL(17-49,167-189)
auggccgucauggccccccgcacccucguccuccuccucuccggcgcccucgcccucacccagaccugggccaugccccuccccccccaccccggccaccccggcuacaucaacuucuccuacgagguccucaccccccucaagugguaccagaacaugauccgccaccccucccuccuccccgaccucccccucgaggccuggcccgccaccgacaagaccaagcgcgaggaggucgacuga

SEQ ID NO: 338 - RNA, 534 nt, Artificial Sequence
  derived and/or modified CDS sequence (opt2) from Sus scrofa__P45561-2__SsAMELX-001-2
augggcaccuggauccucuucgccugccuccucggcgccgccuucuccaugccccuccccccccaccccggccaccccggcuacaucaacuucuccuacauccgccaccccuacaccuccuacggcuacgagcccaugggcggcuggcuccaccaccagaucauccccgucgucucccagcagaccccccagucccacgcccuccagccccaccaccacauccccaugguccccgcccagcagcccggcaucccccagcagcccaugaugccccuccccggccagcacuccaugacccccacccagcaccaccagcccaaccucccccuccccgcccagcagcccuuccagccccagcccguccagccccagccccaccagccccuccagccccagucccccaugcaccccauccagccccuccucccccagcccccccucccccccauguucuccaugcagucccuccuccccgaccucccccucgaggccuggcccgccaccgacaagaccaagcgcgaggaggucgacuga

SEQ ID NO: 339 - RNA, 570 nt, Artificial Sequence
  derived and/or modified CDS sequence (opt2) from Sus scrofa__NP_998965.1__SsAMELX-001-3
augggcaccuggaucuucuucgccugccuccucggcgccucccucgccaugccccuccccccccaccccggccaccccggcuacaucaacuucuccuacgagguccucaccccccucaagugguaccagaacaugauccgccaccccuacaccuccuacggcuacgagcccaugggcggcuggcuccaccaccagaucauccccgucgucucccagcagaccccccagucccacgcccuccagccccaccaccacauccccaugguccccgcccagcagcccggcaucccccagcagcccaugaugccccuccccggccagcacuccaugacccccacccagcaccaccagcccaaccucccccuccccgcccagcagcccuuccagccccagcccguccagccccagccccaccagccccuccagccccagucccccaugcaccccauccagccccuccucccccagcccccccucccccccauguucuccaugcagucccuccuccccgaccucccccucgaggccuggcccgccaccgacaagaccaagcgcgaggaggucgacuga

SEQ ID NO: 340 - RNA, 219 nt, Artificial Sequence
  derived and/or modified CDS sequence (opt2) from Sus scrofa__K7GPB2__SsAMELX-002
augggcaccuggauccucuucgccugccuccucggcgccgccuucuccaugccccuccccccccaccccggccaccccggcuacaucaacuucuccuacgagguccucaccccccucaagugguaccagaacaugauccgccaccccucccuccuccccgaccucccccucgaggccuggcccgccaccgacaagaccaagcgcgaggaggucgacuga

SEQ ID NO: 341 - RNA, 612 nt, Artificial Sequence
  derived and/or modified CDS sequence (opt2) from Sus scrofa__K7GLD0__SsAMELX-003
augggcaccuggauccucuucgccugccuccucggcgccgccuucuccaugccccuccccccccaccccggccaccccggcuacaucaacuucuccuacgaggaccucuaccucgaggccauccgcaucgaccgcaccgccuucguccucaccccccucaagugguaccagaacaugauccgccaccccuacaccuccuacggcuacgagcccaugggcggcuggcuccaccaccagaucauccccgucgucucccagcagaccccccagucccacgcccuccagccccaccaccacauccccaugguccccgcccagcagcccggcaucccccagcagcccaugaugccccuccccggccagcacuccaugacccccacccagcaccaccagcccaaccucccccuccccgcccagcagcccuuccagccccagcccguccagccccagccccaccagccccuccagccccagucccccaugcaccccauccagccccuccucccccagcccccccucccccccauguucuccaugcagucccuccuccccgaccucccccucgaggccuggcccgccaccgacaagaccaagcgcgaggaggucgacuga

SEQ ID NO: 342 - RNA, 498 nt, Artificial Sequence
  derived and/or modified CDS sequence (opt2) from Sus scrofa__K7GPE9__SsAMELX-004
augggcaccuggauccucuucgccugccuccucggcgccgccuucuccaugccccuccccccccaccccggccaccccggcuacaucaacuucuccuacgagguccucaccccccucaagugguaccagaacaugauccgccaccccaccccccagucccacgcccuccagccccaccaccacauccccaugguccccgcccagcagcccggcaucccccagcagcccaugaugccccuccccggccagcacuccaugacccccacccagcaccaccagcccaaccucccccuccccgcccagcagcccuuccagccccagcccguccagccccagccccaccagccccuccagccccagucccccaugcaccccauccagccccuccucccccagcccccccucccccccauguucuccaugcagucccuccuccccgaccucccccucgaggccuggcccgccaccgacaagaccaagcgcgaggaggucgacuga

SEQ ID NO: 343 - RNA, 522 nt, Artificial Sequence
  derived and/or modified CDS sequence (opt2) from Sus scrofa__J9JIM4__SsAMELX-201
augccccuccccccccaccccggccaccccggcuacaucaacuucuccuacgagguccucaccccccucaagugguaccagaacaugauccgccaccccuacaccuccuacggcuacgagcccaugggcggcuggcuccaccaccagaucauccccgucgucucccagcagaccccccagucccacgcccuccagccccaccaccacauccccaugguccccgcccagcagcccggcaucccccagcagcccaugaugccccuccccggccagcacuccaugacccccacccagcaccaccagcccaaccucccccuccccgcccagcagcccuuccagccccagcccguccagccccagccccaccagccccuccagccccagucccccaugcaccccauccagccccuccucccccagcccccccucccccccauguucuccaugcagucccuccuccccgaccucccccucgaggccuggcccgccaccgacaagaccaagcgcgaggaggucgacuga

SEQ ID NO: 344 - RNA, 2961 nt, Artificial Sequence
  derived and/or modified CDS sequence (opt2) from Homo sapiens__NP_006120.1__HsBMP1
augcccggcgucgcccgccucccccuccuccucggccuccuccuccucccccgccccggccgcccccucgaccucgccgacuacaccuacgaccucgccgaggaggacgacuccgagccccucaacuacaaggaccccugcaaggccgccgccuuccucggcgacaucgcccucgacgaggaggaccuccgcgccuuccagguccagcaggccgucgaccuccgccgccacaccgcccgcaaguccuccaucaaggccgccguccccggcaacaccuccacccccuccugccaguccaccaacggccagccccagcgcggcgccugcggccgcuggcgcggccgcucccgcucccgccgcgccgccaccucccgccccgagcgcgucuggcccgacggcgucauccccuucgucaucggcggcaacuucaccggcucccagcgcgccgucuuccgccaggccaugcgccacugggagaagcacaccugcgucaccuuccucgagcgcaccgacgaggacuccuacaucgucuucaccuaccgccccugcggcugcugcuccuacgucggccgccgcggcggcggcccccaggccaucuccaucggcaagaacugcgacaaguucggcaucgucguccacgagcucggccacgucgucggcuucuggcacgagcacacccgccccgaccgcgaccgccacgucuccaucguccgcgagaacauccagcccggccaggaguacaacuuccucaagauggagccccaggaggucgagucccucggcgagaccuacgacuucgacuccaucaugcacuacgcccgcaacaccuucucccgcggcaucuuccucgacaccaucguccccaaguacgaggucaacggcgucaagccccccaucggccagcgcacccgccucuccaagggcgacaucgcccaggcccgcaagcucuacaagugccccgccugcggcgagacccuccaggacuccaccggcaacuucuccucccccgaguaccccaacggcuacuccgcccacaugcacugcgucuggcgcaucuccgucacccccggcgagaagaucauccucaacuucaccucccucgaccucuaccgcucccgccucugcugguacgacuacgucgagguccgcgacggcuucuggcgcaaggccccccuccgcggccgcuucugcggcuccaagcuccccgagcccaucgucuccaccgacucccgccucugggucgaguuccgcuccuccuccaacugggucggcaagggcuucuucgccgucuacgaggccaucugcggcggcgacgucaagaaggacuacggccacauccagucccccaacuaccccgacgacuaccgccccuccaaggucugcaucuggcgcauccaggucuccgagggcuuccacgucggccucaccuuccaguccuucgagaucgagcgccacgacuccugcgccuacgacuaccucgagguccgcgacggccacuccgaguccuccacccucaucggccgcuacugcggcuacgagaagcccgacgacaucaaguccaccuccucccgccucuggcucaaguucgucuccgacggcuccaucaacaaggccggcuucgccgucaacuucuucaaggaggucgacgagugcucccgccccaaccgcggcggcugcgagcagcgcugccucaacacccucggcuccuacaagugcuccugcgaccccggcuacgagcucgcccccgacaagcgccgcugcgaggccgccugcggcggcuuccucaccaagcucaacggcuccaucaccucccccggcuggcccaaggaguacccccccaacaagaacugcaucuggcagcucgucgcccccacccaguaccgcaucucccuccaguucgacuucuucgagaccgagggcaacgacgucugcaaguacgacuucgucgagguccgcuccggccucaccgccgacuccaagcuccacggcaaguucugcggcuccgagaagcccgaggucaucaccucccaguacaacaacaugcgcgucgaguucaaguccgacaacaccgucuccaagaagggcuucaaggcccacuucuucuccgacaaggacgagugcuccaaggacaacggcggcugccagcaggacugcgucaacaccuucggcuccuacgagugccagugccgcuccggcuucguccuccacgacaacaagcacgacugcaaggaggccggcugcgaccacaaggucaccuccaccuccggcaccaucaccucccccaacuggcccgacaaguaccccuccaagaaggagugcaccugggccaucuccuccacccccggccaccgcgucaagcucaccuucauggagauggacaucgagucccagcccgagugcgccuacgaccaccucgaggucuucgacggccgcgacgccaaggcccccguccucggccgcuucugcggcuccaagaagcccgagcccguccucgccaccggcucccgcauguuccuccgcuucuacuccgacaacuccguccagcgcaagggcuuccaggccucccacgccaccgagugcggcggccagguccgcgccgacgucaagaccaaggaccucuacucccacgcccaguucggcgacaacaacuaccccggcggcgucgacugcgagugggucaucgucgccgaggagggcuacggcgucgagcucgucuuccagaccuucgaggucgaggaggagaccgacugcggcuacgacuacauggagcucuucgacggcuacgacuccaccgccccccgccucggccgcuacugcggcuccggcccccccgaggaggucuacuccgccggcgacuccguccucgucaaguuccacuccgacgacaccaucaccaagaagggcuuccaccuccgcuacaccuccaccaaguuccaggacacccuccacucccgcaaguga

SEQ ID NO: 345 - RNA, 1191 nt, Artificial Sequence
  derived and/or modified CDS sequence (opt2) from Homo sapiens__NP_001191.1__HsBMP2
auggucgccggcacccgcugccuccucgcccuccuccucccccagguccuccucggcggcgccgccggccucguccccgagcucggccgccgcaaguucgccgccgccuccuccggccgccccuccucccagcccuccgacgagguccucuccgaguucgagcuccgccuccucuccauguucggccucaagcagcgccccacccccucccgcgacgccgucgucccccccuacaugcucgaccucuaccgccgccacuccggccagcccggcucccccgcccccgaccaccgccucgagcgcgccgccucccgcgccaacaccguccgcuccuuccaccacgaggagucccucgaggagcuccccgagaccuccggcaagaccacccgccgcuucuucuucaaccucuccuccauccccaccgaggaguucaucaccuccgccgagcuccaggucuuccgcgagcagaugcaggacgcccucggcaacaacuccuccuuccaccaccgcaucaacaucuacgagaucaucaagcccgccaccgccaacuccaaguuccccgucacccgccuccucgacacccgccucgucaaccagaacgccucccgcugggaguccuucgacgucacccccgccgucaugcgcuggaccgcccagggccacgccaaccacggcuucgucgucgaggucgcccaccucgaggagaagcagggcgucuccaagcgccacguccgcaucucccgcucccuccaccaggacgagcacuccuggucccagauccgcccccuccucgucaccuucggccacgacggcaagggccacccccuccacaagcgcgagaagcgccaggccaagcacaagcagcgcaagcgccucaaguccuccugcaagcgccacccccucuacgucgacuucuccgacgucggcuggaacgacuggaucgucgccccccccggcuaccacgccuucuacugccacggcgagugccccuucccccucgccgaccaccucaacuccaccaaccacgccaucguccagacccucgucaacuccgucaacuccaagauccccaaggccugcugcguccccaccgagcucuccgccaucuccaugcucuaccucgacgagaacgagaaggucguccucaagaacuaccaggacauggucgucgagggcugcggcugccgcuga

SEQ ID NO: 346 - RNA, 1227 nt, Artificial Sequence
  derived and/or modified CDS sequence (opt2) from Homo sapiens__NP_001193.2__HsBMP4
augauccccggcaaccgcaugcucauggucguccuccucugccagguccuccucggcggcgccucccacgccucccucauccccgagaccggcaagaagaaggucgccgagauccagggccacgccggcggccgccgcuccggccagucccacgagcuccuccgcgacuucgaggccacccuccuccagauguucggccuccgccgccgcccccagcccuccaaguccgccgucauccccgacuacaugcgcgaccucuaccgccuccaguccggcgaggaggaggaggagcagauccacuccaccggccucgaguaccccgagcgccccgccucccgcgccaacaccguccgcuccuuccaccacgaggagcaccucgagaacauccccggcaccuccgagaacuccgccuuccgcuuccucuucaaccucuccuccauccccgagaacgaggucaucuccuccgccgagcuccgccucuuccgcgagcaggucgaccagggccccgacugggagcgcggcuuccaccgcaucaacaucuacgaggucaugaagccccccgccgaggucguccccggccaccucaucacccgccuccucgacacccgccucguccaccacaacgucacccgcugggagaccuucgacgucucccccgccguccuccgcuggacccgcgagaagcagcccaacuacggccucgccaucgaggucacccaccuccaccagacccgcacccaccagggccagcacguccgcaucucccgcucccucccccagggcuccggcaacugggcccagcuccgcccccuccucgucaccuucggccacgacggccgcggccacgcccucacccgccgccgccgcgccaagcgcucccccaagcaccacucccagcgcgcccgcaagaagaacaagaacugccgccgccacucccucuacgucgacuucuccgacgucggcuggaacgacuggaucgucgccccccccggcuaccaggccuucuacugccacggcgacugccccuucccccucgccgaccaccucaacuccaccaaccacgccaucguccagacccucgucaacuccgucaacuccuccauccccaaggccugcugcguccccaccgagcucuccgccaucuccaugcucuaccucgacgaguacgacaaggucguccucaagaacuaccaggagauggucgucgagggcugcggcugccgcuga

SEQ ID NO: 347 - RNA, 1542 nt, Artificial Sequence
  derived and/or modified CDS sequence (opt2) from Homo sapiens__NP_001709.1__HsBMP6
augcccggccucggccgccgcgcccaguggcucugcuggugguggggccuccucugcuccugcugcggcccccccccccuccgccccccccuccccgccgccgccgccgccgccgccggcggccagcuccucggcgacggcggcucccccggccgcaccgagcagcccccccccuccccccaguccuccuccggcuuccucuaccgccgccucaagacccaggagaagcgcgagaugcagaaggagauccucuccguccucggccucccccaccgcccccgcccccuccacggccuccagcagccccagccccccgcccuccgccagcaggaggagcagcagcagcagcagcagcucccccgcggcgagcccccccccggccgccucaaguccgccccccucuucaugcucgaccucuacaacgcccucuccgccgacaacgacgaggacggcgccuccgagggcgagcgccagcaguccuggccccacgaggccgccuccuccucccagcgccgccagcccccccccggcgccgcccacccccucaaccgcaagucccuccucgcccccggcuccggcuccggcggcgccuccccccucaccuccgcccaggacuccgccuuccucaacgacgccgacauggucauguccuucgucaaccucgucgaguacgacaaggaguucuccccccgccagcgccaccacaaggaguucaaguucaaccucucccagauccccgagggcgaggucgucaccgccgccgaguuccgcaucuacaaggacugcgucaugggcuccuucaagaaccagaccuuccucaucuccaucuaccagguccuccaggagcaccagcaccgcgacuccgaccucuuccuccucgacacccgcgucgucugggccuccgaggagggcuggcucgaguucgacaucaccgccaccuccaaccucugggucgucaccccccagcacaacaugggccuccagcucuccgucgucacccgcgacggcguccacguccacccccgcgccgccggccucgucggccgcgacggccccuacgacaagcagcccuucauggucgccuucuucaaggucuccgagguccacguccgcaccacccgcuccgccuccucccgccgccgccagcagucccgcaaccgcuccacccagucccaggacgucgcccgcgucuccuccgccuccgacuacaacuccuccgagcucaagaccgccugccgcaagcacgagcucuacgucuccuuccaggaccucggcuggcaggacuggaucaucgcccccaagggcuacgccgccaacuacugcgacggcgagugcuccuucccccucaacgcccacaugaacgccaccaaccacgccaucguccagacccucguccaccucaugaaccccgaguacguccccaagcccugcugcgcccccaccaagcucaacgccaucuccguccucuacuucgacgacaacuccaacgucauccucaagaaguaccgcaacauggucguccgcgccugcggcugccacuga

SEQ ID NO: 348 - RNA, 1296 nt, Artificial Sequence
  derived and/or modified CDS sequence (opt2) from Homo sapiens__NP_001710.1__HsBMP7
augcacguccgcucccuccgcgccgccgccccccacuccuucgucgcccucugggccccccucuuccuccuccgcuccgcccucgccgacuucucccucgacaacgagguccacuccuccuucauccaccgccgccuccgcucccaggagcgccgcgagaugcagcgcgagauccucuccauccucggccucccccaccgcccccgcccccaccuccagggcaagcacaacuccgcccccauguucaugcucgaccucuacaacgccauggccgucgaggagggcggcggccccggcggccagggcuucuccuaccccuacaaggccgucuucuccacccagggccccccccucgccucccuccaggacucccacuuccucaccgacgccgacauggucauguccuucgucaaccucgucgagcacgacaaggaguucuuccacccccgcuaccaccaccgcgaguuccgcuucgaccucuccaagauccccgagggcgaggccgucaccgccgccgaguuccgcaucuacaaggacuacauccgcgagcgcuucgacaacgagaccuuccgcaucuccgucuaccagguccuccaggagcaccucggccgcgaguccgaccucuuccuccucgacucccgcacccucugggccuccgaggagggcuggcucgucuucgacaucaccgccaccuccaaccacugggucgucaacccccgccacaaccucggccuccagcucuccgucgagacccucgacggccaguccaucaaccccaagcucgccggccucaucggccgccacggcccccagaacaagcagcccuucauggucgccuucuucaaggccaccgagguccacuuccgcuccauccgcuccaccggcuccaagcagcgcucccagaaccgcuccaagacccccaagaaccaggaggcccuccgcauggccaacgucgccgagaacuccuccuccgaccagcgccaggccugcaagaagcacgagcucuacgucuccuuccgcgaccucggcuggcaggacuggaucaucgcccccgagggcuacgccgccuacuacugcgagggcgagugcgccuucccccucaacuccuacaugaacgccaccaaccacgccaucguccagacccucguccacuucaucaaccccgagaccguccccaagcccugcugcgcccccacccagcucaacgccaucuccguccucuacuucgacgacuccuccaacgucauccucaagaaguaccgcaacauggucguccgcgccugcggcugccacuga

SEQ ID NO: 349 - RNA, 300 nt, Artificial Sequence
  derived and/or modified CDS sequence (opt2) from Homo sapiens__NP_006264.2__HsCCL7
augaaggccuccgccgcccuccucugccuccuccucaccgccgccgccuucuccccccagggccucgcccagcccgucggcaucaacaccuccaccaccugcugcuaccgcuucaucaacaagaagauccccaagcagcgccucgaguccuaccgccgcaccaccuccucccacugcccccgcgaggccgucaucuucaagaccaagcucgacaaggagaucugcgccgaccccacccagaaguggguccaggacuucaugaagcaccucgacaagaagacccagacccccaagcucuga

SEQ ID NO: 350 - RNA, 3624 nt, Artificial Sequence
  derived and/or modified CDS sequence (opt2) from Homo sapiens__NP_001954.2__HsEGF
augcuccucacccucaucauccuccuccccgucgucuccaaguucuccuucgucucccucuccgccccccagcacugguccugccccgagggcacccucgccggcaacggcaacuccaccugcgucggccccgcccccuuccucaucuucucccacggcaacuccaucuuccgcaucgacaccgagggcaccaacuacgagcagcucgucgucgacgccggcgucuccgucaucauggacuuccacuacaacgagaagcgcaucuacugggucgaccucgagcgccagcuccuccagcgcgucuuccucaacggcucccgccaggagcgcgucugcaacaucgagaagaacgucuccggcauggccaucaacuggaucaacgaggaggucaucugguccaaccagcaggagggcaucaucaccgucaccgacaugaagggcaacaacucccacauccuccucuccgcccucaaguaccccgccaacgucgccgucgaccccgucgagcgcuucaucuucugguccuccgaggucgccggcucccucuaccgcgccgaccucgacggcgucggcgucaaggcccuccucgagaccuccgagaagaucaccgccgucucccucgacguccucgacaagcgccucuucuggauccaguacaaccgcgagggcuccaacucccucaucugcuccugcgacuacgacggcggcuccguccacaucuccaagcaccccacccagcacaaccucuucgccaugucccucuucggcgaccgcaucuucuacuccaccuggaagaugaagaccaucuggaucgccaacaagcacaccggcaaggacaugguccgcaucaaccuccacuccuccuucgucccccucggcgagcucaaggucguccacccccucgcccagcccaaggccgaggacgacaccugggagcccgagcagaagcucugcaagcuccgcaagggcaacugcuccuccaccgucugcggccaggaccuccagucccaccucugcaugugcgccgagggcuacgcccucucccgcgaccgcaaguacugcgaggacgucaacgagugcgccuucuggaaccacggcugcacccucggcugcaagaacacccccggcuccuacuacugcaccugccccgucggcuucguccuccuccccgacggcaagcgcugccaccagcucgucuccugcccccgcaacgucuccgagugcucccacgacugcguccucaccuccgagggcccccucugcuucugccccgagggcuccguccucgagcgcgacggcaagaccugcuccggcugcuccucccccgacaacggcggcugcucccagcucugcgucccccucucccccgucuccugggagugcgacugcuuccccggcuacgaccuccagcucgacgagaaguccugcgccgccuccggcccccagcccuuccuccucuucgccaacucccaggacauccgccacaugcacuucgacggcaccgacuacggcacccuccucucccagcagaugggcauggucuacgcccucgaccacgaccccgucgagaacaagaucuacuucgcccacaccgcccucaaguggaucgagcgcgccaacauggacggcucccagcgcgagcgccucaucgaggagggcgucgacguccccgagggccucgccgucgacuggaucggccgccgcuucuacuggaccgaccgcggcaagucccucaucggccgcuccgaccucaacggcaagcgcuccaagaucaucaccaaggagaacaucucccagccccgcggcaucgccguccaccccauggccaagcgccucuucuggaccgacaccggcaucaacccccgcaucgaguccuccucccuccagggccucggccgccucgucaucgccuccuccgaccucaucuggcccuccggcaucaccaucgacuuccucaccgacaagcucuacuggugcgacgccaagcaguccgucaucgagauggccaaccucgacggcuccaagcgccgccgccucacccagaacgacgucggccaccccuucgccgucgccgucuucgaggacuacgucugguucuccgacugggccaugcccuccgucaugcgcgucaacaagcgcaccggcaaggaccgcguccgccuccagggcuccaugcucaagcccuccucccucgucgucguccacccccucgccaagcccggcgccgaccccugccucuaccagaacggcggcugcgagcacaucugcaagaagcgccucggcaccgccuggugcuccugccgcgagggcuucaugaaggccuccgacggcaagaccugccucgcccucgacggccaccagcuccucgccggcggcgaggucgaccucaagaaccaggucaccccccucgacauccucuccaagacccgcgucuccgaggacaacaucaccgagucccagcacaugcucgucgccgagaucauggucuccgaccaggacgacugcgcccccgucggcugcuccauguacgcccgcugcaucuccgagggcgaggacgccaccugccagugccucaagggcuucgccggcgacggcaagcucugcuccgacaucgacgagugcgagaugggcguccccgucugcccccccgccuccuccaagugcaucaacaccgagggcggcuacgucugccgcugcuccgagggcuaccagggcgacggcauccacugccucgacaucgacgagugccagcucggcgagcacuccugcggcgagaacgccuccugcaccaacaccgagggcggcuacaccugcaugugcgccggccgccucuccgagcccggccucaucugccccgacuccaccccccccccccaccuccgcgaggacgaccaccacuacuccguccgcaacuccgacuccgagugcccccucucccacgacggcuacugccuccacgacggcgucugcauguacaucgaggcccucgacaaguacgccugcaacugcgucgucggcuacaucggcgagcgcugccaguaccgcgaccucaaguggugggagcuccgccacgccggccacggccagcagcagaaggucaucgucgucgccgucugcgucgucguccucgucaugcuccuccuccucucccucuggggcgcccacuacuaccgcacccagaagcuccucuccaagaaccccaagaaccccuacgaggaguccucccgcgacguccgcucccgccgccccgccgacaccgaggacggcauguccuccugcccccagcccugguucgucgucaucaaggagcaccaggaccucaagaacggcggccagcccgucgccggcgaggacggccaggccgccgacggcuccaugcagcccaccuccuggcgccaggagccccagcucugcggcaugggcaccgagcagggcugcuggauccccgucuccuccgacaagggcuccugcccccaggucauggagcgcuccuuccacaugcccuccuacggcacccagacccucgagggcggcgucgagaagccccacucccuccucuccgccaacccccucuggcagcagcgcgcccucgaccccccccaccagauggagcucacccaguga

SEQ ID NO: 351 - RNA, 510 nt, Artificial Sequence
  derived and/or modified CDS sequence (opt2) from Homo sapiens__NP_001423.1__HsEREG
augaccgccggccgccgcauggagaugcucugcgccggccgcguccccgcccuccuccucugccucggcuuccaccuccuccaggccguccucuccaccaccgucauccccuccugcauccccggcgaguccuccgacaacugcaccgcccucguccagaccgaggacaacccccgcgucgcccaggucuccaucaccaagugcuccuccgacaugaacggcuacugccuccacggccagugcaucuaccucgucgacaugucccagaacuacugccgcugcgaggucggcuacaccggcguccgcugcgagcacuucuuccucaccguccaccagccccucuccaaggaguacgucgcccucaccgucauccucaucauccucuuccucaucaccgucgucggcuccaccuacuacuucugccgcugguaccgcaaccgcaaguccaaggagcccaagaaggaguacgagcgcgucaccuccggcgaccccgagcucccccaggucuga

SEQ ID NO: 352 - RNA, 468 nt, Artificial Sequence
  derived and/or modified CDS sequence (opt2) from Homo sapiens__NP_000791.1__HsFGF1
auggccgagggcgagaucaccaccuucaccgcccucaccgagaaguucaaccucccccccggcaacuacaagaagcccaagcuccucuacugcuccaacggcggccacuuccuccgcauccuccccgacggcaccgucgacggcacccgcgaccgcuccgaccagcacauccagcuccagcucuccgccgaguccgucggcgaggucuacaucaaguccaccgagaccggccaguaccucgccauggacaccgacggccuccucuacggcucccagacccccaacgaggagugccucuuccucgagcgccucgaggagaaccacuacaacaccuacaucuccaagaagcacgccgagaagaacugguucgucggccucaagaagaacggcuccugcaagcgcggcccccgcacccacuacggccagaaggccauccucuuccucccccuccccgucuccuccgacuga

SEQ ID NO: 353 - RNA, 867 nt, Artificial Sequence
  derived and/or modified CDS sequence (opt2) from Homo sapiens__NP_001997.5__HsFGF2
auggucggcgucggcggcggcgacgucgaggacgucaccccccgccccggcggcugccagaucuccggccgcggcgcccgcggcugcaacggcauccccggcgccgccgccugggaggccgcccucccccgccgccgcccccgccgccaccccuccgucaacccccgcucccgcgccgccggcuccccccgcacccgcggccgccgcaccgaggagcgccccuccggcucccgccucggcgaccgcggccgcggccgcgcccuccccggcggccgccucggcggccgcggccgcggccgcgcccccgagcgcgucggcggccgcggccgcggccgcggcaccgccgccccccgcgccgcccccgccgcccgcggcucccgccccggccccgccggcaccauggccgccggcuccaucaccacccuccccgcccuccccgaggacggcggcuccggcgccuucccccccggccacuucaaggaccccaagcgccucuacugcaagaacggcggcuucuuccuccgcauccaccccgacggccgcgucgacggcguccgcgagaaguccgacccccacaucaagcuccagcuccaggccgaggagcgcggcgucgucuccaucaagggcgucugcgccaaccgcuaccucgccaugaaggaggacggccgccuccucgccuccaagugcgucaccgacgagugcuucuucuucgagcgccucgaguccaacaacuacaacaccuaccgcucccgcaaguacaccuccugguacgucgcccucaagcgcaccggccaguacaagcucggcuccaagaccggccccggccagaaggccauccucuuccuccccauguccgccaaguccuga

SEQ ID NO: 354 - RNA, 585 nt, Artificial Sequence
  derived and/or modified CDS sequence (opt2) from Homo sapiens__NP_002000.1__HsFGF7
augcacaaguggauccucaccuggauccuccccacccuccucuaccgcuccugcuuccacaucaucugccucgucggcaccaucucccucgccugcaacgacaugacccccgagcagauggccaccaacgucaacugcuccucccccgagcgccacacccgcuccuacgacuacauggagggcggcgacauccgcguccgccgccucuucugccgcacccagugguaccuccgcaucgacaagcgcggcaaggucaagggcacccaggagaugaagaacaacuacaacaucauggagauccgcaccgucgccgucggcaucgucgccaucaagggcgucgaguccgaguucuaccucgccaugaacaaggagggcaagcucuacgccaagaaggagugcaacgaggacugcaacuucaaggagcucauccucgagaaccacuacaacaccuacgccuccgccaaguggacccacaacggcggcgagauguucgucgcccucaaccagaagggcauccccguccgcggcaagaagaccaagaaggagcagaagaccgcccacuuccuccccauggccaucaccuga

SEQ ID NO: 355 - RNA, 627 nt, Artificial Sequence
  derived and/or modified CDS sequence (opt2) from Homo sapiens__NP_001936.1__HsHBEGF
augaagcuccuccccuccgucguccucaagcucuuccucgccgccguccucuccgcccucgucaccggcgagucccucgagcgccuccgccgcggccucgccgccggcaccuccaaccccgacccccccaccgucuccaccgaccagcuccucccccucggcggcggccgcgaccgcaagguccgcgaccuccaggaggccgaccucgaccuccuccgcgucacccucuccuccaagccccaggcccucgccacccccaacaaggaggagcacggcaagcgcaagaagaagggcaagggccucggcaagaagcgcgaccccugccuccgcaaguacaaggacuucugcauccacggcgagugcaaguacgucaaggagcuccgcgcccccuccugcaucugccaccccggcuaccacggcgagcgcugccacggccucucccuccccgucgagaaccgccucuacaccuacgaccacaccaccauccucgccgucgucgccgucguccucuccuccgucugccuccucgucaucgucggccuccucauguuccgcuaccaccgccgcggcggcuacgacgucgagaacgaggagaaggucaagcucggcaugaccaacucccacuga

SEQ ID NO: 356 - RNA, 2187 nt, Artificial Sequence
  derived and/or modified CDS sequence (opt2) from Homo sapiens__NP_000592.3__HsHGF
augugggucaccaagcuccuccccgcccuccuccuccagcacguccuccuccaccuccuccuccuccccaucgccauccccuacgccgagggccagcgcaagcgccgcaacaccauccacgaguucaagaaguccgccaagaccacccucaucaagaucgaccccgcccucaagaucaagaccaagaaggucaacaccgccgaccagugcgccaaccgcugcacccgcaacaagggccuccccuucaccugcaaggccuucgucuucgacaaggcccgcaagcagugccucugguuccccuucaacuccauguccuccggcgucaagaaggaguucggccacgaguucgaccucuacgagaacaaggacuacauccgcaacugcaucaucggcaagggccgcuccuacaagggcaccgucuccaucaccaaguccggcaucaagugccagcccugguccuccaugaucccccacgagcacuccuuccuccccuccuccuaccgcggcaaggaccuccaggagaacuacugccgcaacccccgcggcgaggagggcggccccuggugcuucaccuccaaccccgagguccgcuacgaggucugcgacaucccccagugcuccgaggucgagugcaugaccugcaacggcgaguccuaccgcggccucauggaccacaccgaguccggcaagaucugccagcgcugggaccaccagaccccccaccgccacaaguuccuccccgagcgcuaccccgacaagggcuucgacgacaacuacugccgcaaccccgacggccagccccgccccuggugcuacacccucgacccccacacccgcugggaguacugcgccaucaagaccugcgccgacaacaccaugaacgacaccgacgucccccucgagaccaccgagugcauccagggccagggcgagggcuaccgcggcaccgucaacaccaucuggaacggcauccccugccagcgcugggacucccaguacccccacgagcacgacaugacccccgagaacuucaagugcaaggaccuccgcgagaacuacugccgcaaccccgacggcuccgagucccccuggugcuucaccaccgaccccaacauccgcgucggcuacugcucccagauccccaacugcgacaugucccacggccaggacugcuaccgcggcaacggcaagaacuacaugggcaaccucucccagacccgcuccggccucaccugcuccaugugggacaagaacauggaggaccuccaccgccacaucuucugggagcccgacgccuccaagcucaacgagaacuacugccgcaaccccgacgacgacgcccacggccccuggugcuacaccggcaacccccucauccccugggacuacugccccaucucccgcugcgagggcgacaccacccccaccaucgucaaccucgaccaccccgucaucuccugcgccaagaccaagcagcuccgcgucgucaacggcauccccacccgcaccaacaucggcuggauggucucccuccgcuaccgcaacaagcacaucugcggcggcucccucaucaaggaguccuggguccucaccgcccgccagugcuuccccucccgcgaccucaaggacuacgaggccuggcucggcauccacgacguccacggccgcggcgacgagaagugcaagcagguccucaacgucucccagcucgucuacggccccgagggcuccgaccucguccucaugaagcucgcccgccccgccguccucgacgacuucgucuccaccaucgaccuccccaacuacggcugcaccauccccgagaagaccuccugcuccgucuacggcuggggcuacaccggccucaucaacuacgacggccuccuccgcgucgcccaccucuacaucaugggcaacgagaagugcucccagcaccaccgcggcaaggucacccucaacgaguccgagaucugcgccggcgccgagaagaucggcuccggccccugcgagggcgacuacggcggcccccucgucugcgagcagcacaagaugcgcaugguccucggcgucaucguccccggccgcggcugcgccauccccaaccgccccggcaucuucguccgcgucgccuacuacgccaaguggauccacaagaucauccucaccuacaaggucccccaguccuga

SEQ ID NO: 357 - RNA, 1926 nt, Artificial Sequence
  derived and/or modified CDS sequence (opt2) from Homo sapiens__NP_005336.3 __HsHSPA1A
auggccaaggccgccgccaucggcaucgaccucggcaccaccuacuccugcgucggcgucuuccagcacggcaaggucgagaucaucgccaacgaccagggcaaccgcaccacccccuccuacgucgccuucaccgacaccgagcgccucaucggcgacgccgccaagaaccaggucgcccucaacccccagaacaccgucuucgacgccaagcgccucaucggccgcaaguucggcgaccccgucguccaguccgacaugaagcacuggcccuuccaggucaucaacgacggcgacaagcccaagguccaggucuccuacaagggcgagaccaaggccuucuaccccgaggagaucuccuccaugguccucaccaagaugaaggagaucgccgaggccuaccucggcuaccccgucaccaacgccgucaucaccguccccgccuacuucaacgacucccagcgccaggccaccaaggacgccggcgucaucgccggccucaacguccuccgcaucaucaacgagcccaccgccgccgccaucgccuacggccucgaccgcaccggcaagggcgagcgcaacguccucaucuucgaccucggcggcggcaccuucgacgucuccauccucaccaucgacgacggcaucuucgaggucaaggccaccgccggcgacacccaccucggcggcgaggacuucgacaaccgccucgucaaccacuucgucgaggaguucaagcgcaagcacaagaaggacaucucccagaacaagcgcgccguccgccgccuccgcaccgccugcgagcgcgccaagcgcacccucuccuccuccacccaggccucccucgagaucgacucccucuucgagggcaucgacuucuacaccuccaucacccgcgcccgcuucgaggagcucugcuccgaccucuuccgcuccacccucgagcccgucgagaaggcccuccgcgacgccaagcucgacaaggcccagauccacgaccucguccucgucggcggcuccacccgcauccccaagguccagaagcuccuccaggacuucuucaacggccgcgaccucaacaaguccaucaaccccgacgaggccgucgccuacggcgccgccguccaggccgccauccucaugggcgacaaguccgagaacguccaggaccuccuccuccucgacgucgccccccucucccucggccucgagaccgccggcggcgucaugaccgcccucaucaagcgcaacuccaccauccccaccaagcagacccagaucuucaccaccuacuccgacaaccagcccggcguccucauccaggucuacgagggcgagcgcgccaugaccaaggacaacaaccuccucggccgcuucgagcucuccggcaucccccccgccccccgcggcgucccccagaucgaggucaccuucgacaucgacgccaacggcauccucaacgucaccgccaccgacaaguccaccggcaaggccaacaagaucaccaucaccaacgacaagggccgccucuccaaggaggagaucgagcgcaugguccaggaggccgagaaguacaaggccgaggacgagguccagcgcgagcgcgucuccgccaagaacgcccucgaguccuacgccuucaacaugaaguccgccgucgaggacgagggccucaagggcaagaucuccgaggccgacaagaagaagguccucgacaagugccaggaggucaucuccuggcucgacgccaacacccucgccgagaaggacgaguucgagcacaagcgcaaggagcucgagcaggucugcaaccccaucaucuccggccucuaccagggcgccggcggccccggccccggcggcuucggcgcccagggccccaagggcggcuccggcuccggccccaccaucgaggaggucgacuga

SEQ ID NO: 358 - RNA, 1926 nt, Artificial Sequence; identical to SEQ ID NO: 357
  derived and/or modified CDS sequence (opt2) from Homo sapiens__NP_005337.2 __HsHSPA1B

SEQ ID NO: 359 - RNA, 1926 nt, Artificial Sequence
  derived and/or modified CDS sequence (opt2) from Homo sapiens__NP_005518.3 __HsHSPA1L
auggccaccgccaagggcaucgccaucggcaucgaccucggcaccaccuacuccugcgucggcgucuuccagcacggcaaggucgagaucaucgccaacgaccagggcaaccgcaccacccccuccuacgucgccuucaccgacaccgagcgccucaucggcgacgccgccaagaaccaggucgccaugaacccccagaacaccgucuucgacgccaagcgccucaucggccgcaaguucaacgaccccgucguccaggccgacaugaagcucuggcccuuccaggucaucaacgagggcggcaagcccaagguccucgucuccuacaagggcgagaacaaggccuucuaccccgaggagaucuccuccaugguccucaccaagcucaaggagaccgccgaggccuuccucggccaccccgucaccaacgccgucaucaccguccccgccuacuucaacgacucccagcgccaggccaccaaggacgccggcgucaucgccggccucaacguccuccgcaucaucaacgagcccaccgccgccgccaucgccuacggccucgacaagggcggccagggcgagcgccacguccucaucuucgaccucggcggcggcaccuucgacgucuccauccucaccaucgacgacggcaucuucgaggucaaggccaccgccggcgacacccaccucggcggcgaggacuucgacaaccgccucgucucccacuucgucgaggaguucaagcgcaagcacaagaaggacaucucccagaacaagcgcgccguccgccgccuccgcaccgccugcgagcgcgccaagcgcacccucuccuccuccacccaggccaaccucgagaucgacucccucuacgagggcaucgacuucuacaccuccaucacccgcgcccgcuucgaggagcucugcgccgaccucuuccgcggcacccucgagcccgucgagaaggcccuccgcgacgccaagauggacaaggccaagauccacgacaucguccucgucggcggcuccacccgcauccccaagguccagcgccuccuccaggacuacuucaacggccgcgaccucaacaaguccaucaaccccgacgaggccgucgccuacggcgccgccguccaggccgccauccucaugggcgacaaguccgagaagguccaggaccuccuccuccucgacgucgccccccucucccucggccucgagaccgccggcggcgucaugaccgcccucaucaagcgcaacuccaccauccccaccaagcagacccagaucuucaccaccuacuccgacaaccagcccggcguccucauccaggucuacgagggcgagcgcgccaugaccaaggacaacaaccuccucggccgcuucgaccucaccggcaucccccccgccccccgcggcgucccccagaucgaggucaccuucgacaucgacgccaacggcauccucaacgucaccgccaccgacaaguccaccggcaaggucaacaagaucaccaucaccaacgacaagggccgccucuccaaggaggagaucgagcgcaugguccucgacgccgagaaguacaaggccgaggacgagguccagcgcgagaagaucgccgccaagaacgcccucgaguccuacgccuucaacaugaaguccgucgucuccgacgagggccucaagggcaagaucuccgaguccgacaagaacaagauccucgacaagugcaacgagcuccucuccuggcucgaggucaaccagcucgccgagaaggacgaguucgaccacaagcgcaaggagcucgagcagaugugcaaccccaucaucaccaagcucuaccagggcggcugcaccggccccgccugcggcaccggcuacguccccggccgccccgccaccggccccaccaucgaggaggucgacuga

SEQ ID NO: 360 - RNA, 1920 nt, Artificial Sequence
  derived and/or modified CDS sequence (opt2) from Homo sapiens__NP_068814.2 __HsHSPA2
auguccgcccgcggccccgccaucggcaucgaccucggcaccaccuacuccugcgucggcgucuuccagcacggcaaggucgagaucaucgccaacgaccagggcaaccgcaccacccccuccuacgucgccuucaccgacaccgagcgccucaucggcgacgccgccaagaaccaggucgccaugaaccccaccaacaccaucuucgacgccaagcgccucaucggccgcaaguucgaggacgccaccguccaguccgacaugaagcacuggcccuuccgcgucgucuccgagggcggcaagcccaagguccaggucgaguacaagggcgagaccaagaccuucuuccccgaggagaucuccuccaugguccucaccaagaugaaggagaucgccgaggccuaccucggcggcaagguccacuccgccgucaucaccguccccgccuacuucaacgacucccagcgccaggccaccaaggacgccggcaccaucaccggccucaacguccuccgcaucaucaacgagcccaccgccgccgccaucgccuacggccucgacaagaagggcugcgccggcggcgagaagaacguccucaucuucgaccucggcggcggcaccuucgacgucuccauccucaccaucgaggacggcaucuucgaggucaaguccaccgccggcgacacccaccucggcggcgaggacuucgacaaccgcauggucucccaccucgccgaggaguucaagcgcaagcacaagaaggacaucggccccaacaagcgcgccguccgccgccuccgcaccgccugcgagcgcgccaagcgcacccucuccuccuccacccaggccuccaucgagaucgacucccucuacgagggcgucgacuucuacaccuccaucacccgcgcccgcuucgaggagcucaacgccgaccucuuccgcggcacccucgagcccgucgagaaggcccuccgcgacgccaagcucgacaagggccagauccaggagaucguccucgucggcggcuccacccgcauccccaagauccagaagcuccuccaggacuucuucaacggcaaggagcucaacaaguccaucaaccccgacgaggccgucgccuacggcgccgccguccaggccgccauccucaucggcgacaaguccgagaacguccaggaccuccuccuccucgacgucaccccccucucccucggcaucgagaccgccggcggcgucaugaccccccucaucaagcgcaacaccaccauccccaccaagcagacccagaccuucaccaccuacuccgacaaccaguccuccguccucguccaggucuacgagggcgagcgcgccaugaccaaggacaacaaccuccucggcaaguucgaccucaccggcaucccccccgccccccgcggcgucccccagaucgaggucaccuucgacaucgacgccaacggcauccucaacgucaccgccgccgacaaguccaccggcaaggagaacaagaucaccaucaccaacgacaagggccgccucuccaaggacgacaucgaccgcaugguccaggaggccgagcgcuacaaguccgaggacgaggccaaccgcgaccgcgucgccgccaagaacgcccucgaguccuacaccuacaacaucaagcagaccgucgaggacgagaagcuccgcggcaagaucuccgagcaggacaagaacaagauccucgacaagugccaggaggucaucaacuggcucgaccgcaaccagauggccgagaaggacgaguacgagcacaagcagaaggagcucgagcgcgucugcaaccccaucaucuccaagcucuaccagggcggccccggcggcggcuccggcggcggcggcuccggcgccuccggcggccccaccaucgaggaggucgacuga

SEQ ID NO: 361 - RNA, 2523 nt, Artificial Sequence
  derived and/or modified CDS sequence (opt2) from Homo sapiens__NP_002145.3 __HsHSPA4
auguccgucgucggcaucgaccucggcuuccaguccugcuacgucgccgucgcccgcgccggcggcaucgagaccaucgccaacgaguacuccgaccgcugcacccccgccugcaucuccuucggccccaagaaccgcuccaucggcgccgccgccaagucccaggucaucuccaacgccaagaacaccguccagggcuucaagcgcuuccacggccgcgccuucuccgaccccuucgucgaggccgagaaguccaaccucgccuacgacaucguccagcuccccaccggccucaccggcaucaaggucaccuacauggaggaggagcgcaacuucaccaccgagcaggucaccgccaugcuccucuccaagcucaaggagaccgccgaguccguccucaagaagcccgucgucgacugcgucgucuccguccccugcuucuacaccgacgccgagcgccgcuccgucauggacgccacccagaucgccggccucaacugccuccgccucaugaacgagaccaccgccgucgcccucgccuacggcaucuacaagcaggaccuccccgcccucgaggagaagccccgcaacgucgucuucgucgacaugggccacuccgccuaccaggucuccgucugcgccuucaaccgcggcaagcucaagguccucgccaccgccuucgacaccacccucggcggccgcaaguucgacgagguccucgucaaccacuucugcgaggaguucggcaagaaguacaagcucgacaucaaguccaagauccgcgcccuccuccgccucucccaggagugcgagaagcucaagaagcucauguccgccaacgccuccgaccucccccucuccaucgagugcuucaugaacgacgucgacgucuccggcaccaugaaccgcggcaaguuccucgagaugugcaacgaccuccucgcccgcgucgagcccccccuccgcuccguccucgagcagaccaagcucaagaaggaggacaucuacgccgucgagaucgucggcggcgccacccgcauccccgccgucaaggagaagaucuccaaguucuucggcaaggagcucuccaccacccucaacgccgacgaggccgucacccgcggcugcgcccuccagugcgccauccucucccccgccuucaagguccgcgaguucuccaucaccgacgucguccccuaccccaucucccuccgcuggaacucccccgccgaggagggcuccuccgacugcgaggucuucuccaagaaccacgccgcccccuucuccaagguccucaccuucuaccgcaaggagcccuucacccucgaggccuacuacuccuccccccaggaccuccccuaccccgaccccgccaucgcccaguucuccguccagaaggucaccccccaguccgacggcuccuccuccaaggucaaggucaagguccgcgucaacguccacggcaucuucuccgucuccuccgccucccucgucgagguccacaaguccgaggagaacgaggagcccauggagaccgaccagaacgccaaggaggaggagaagaugcaggucgaccaggaggagccccacgucgaggagcagcagcagcagacccccgccgagaacaaggccgaguccgaggagauggagaccucccaggccggcuccaaggacaagaagauggaccagcccccccaggccaagaaggccaaggucaagaccuccaccgucgaccuccccaucgagaaccagcuccucuggcagaucgaccgcgagaugcucaaccucuacaucgagaacgagggcaagaugaucaugcaggacaagcucgagaaggagcgcaacgacgccaagaacgccgucgaggaguacgucuacgagaugcgcgacaagcucuccggcgaguacgagaaguucgucuccgaggacgaccgcaacuccuucacccucaagcucgaggacaccgagaacuggcucuacgaggacggcgaggaccagcccaagcaggucuacgucgacaagcucgccgagcucaagaaccucggccagcccaucaagauccgcuuccaggaguccgaggagcgccccaagcucuucgaggagcucggcaagcagauccagcaguacaugaagaucaucuccuccuucaagaacaaggaggaccaguacgaccaccucgacgccgccgacaugaccaaggucgagaaguccaccaacgaggccauggaguggaugaacaacaagcucaaccuccagaacaagcagucccucaccauggaccccgucgucaaguccaaggagaucgaggccaagaucaaggagcucaccuccaccugcucccccaucaucuccaagcccaagcccaaggucgagccccccaaggaggagcagaagaacgccgagcagaacggccccgucgacggccagggcgacaaccccggcccccaggccgccgagcagggcaccgacaccgccguccccuccgacuccgacaagaagcuccccgagauggacaucgacuga

SEQ ID NO: 362 - RNA, 2520 nt, Artificial Sequence
  derived and/or modified CDS sequence (opt2) from Homo sapiens__NP_055093.2 __HsHSPA4L
auguccgucgucggcaucgaccucggcuuccucaacugcuacaucgccgucgcccgcuccggcggcaucgagaccaucgccaacgaguacuccgaccgcugcacccccgccugcaucucccucggcucccgcacccgcgccaucggcaacgccgccaagucccagaucgucaccaacguccgcaacaccauccacggcuucaagaagcuccacggccgcuccuucgacgaccccaucguccagaccgagcgcauccgccuccccuacgagcuccagaagaugcccaacggcuccgccggcgucaagguccgcuaccucgaggaggagcgccccuucgccaucgagcaggucaccggcaugcuccucgccaagcucaaggagaccuccgagaacgcccucaagaagcccgucgccgacugcgucaucuccauccccuccuucuucaccgacgccgagcgccgcuccgucauggccgccgcccaggucgccggccucaacugccuccgccucaugaacgagaccaccgccgucgcccucgccuacggcaucuacaagcaggaccuccccccccucgacgagaagccccgcaacgucgucuucaucgacaugggccacuccgccuaccagguccucgucugcgccuucaacaagggcaagcucaagguccucgccaccaccuucgaccccuaccucggcggccgcaacuucgacgaggcccucgucgacuacuucugcgacgaguucaagaccaaguacaagaucaacgucaaggagaacucccgcgcccuccuccgccucuaccaggagugcgagaagcucaagaagcucauguccgccaacgccuccgaccucccccucaacaucgagugcuucaugaacgaccucgacgucuccuccaagaugaaccgcgcccaguucgagcagcucugcgccucccuccucgcccgcgucgagcccccccucaaggccgucauggagcaggccaaccuccagcgcgaggacaucuccuccaucgagaucgucggcggcgccacccgcauccccgccgucaaggagcagaucaccaaguucuuccucaaggacaucuccaccacccucaacgccgacgaggccgucgcccgcggcugcgcccuccagugcgccauccucucccccgccuucaagguccgcgaguucuccaucaccgaccucguccccuacuccaucacccuccgcuggaagaccuccuucgaggacggcuccggcgagugcgaggucuucugcaagaaccaccccgcccccuucuccaaggucaucaccuuccacaagaaggagcccuucgagcucgaggccuucuacaccaaccuccacgagguccccuaccccgacgcccgcaucggcuccuucaccauccagaacgucuucccccaguccgacggcgacuccuccaaggucaaggucaagguccgcgucaacauccacggcaucuucuccgucgccuccgccuccgucaucgagaagcagaaccucgagggcgaccacuccgacgcccccauggagaccgagaccuccuucaagaacgagaacaaggacaacauggacaagaugcaggucgaccaggaggagggccaccagaagugccacgccgagcacacccccgaggaggagaucgaccacaccggcgccaagaccaaguccgccgucuccgacaagcaggaccgccucaaccagacccucaagaagggcaaggucaaguccaucgaccuccccauccaguccucccucugccgccagcucggccaggaccuccucaacuccuacaucgagaacgagggcaagaugaucaugcaggacaagcucgagaaggagcgcaacgacgccaagaacgccgucgaggaguacgucuacgacuuccgcgaccgccucggcaccgucuacgagaaguucaucacccccgaggaccucuccaagcucuccgccguccucgaggacaccgagaacuggcucuacgaggacggcgaggaccagcccaagcaggucuacgucgacaagcuccaggagcucaagaaguacggccagcccauccagaugaaguacauggagcacgaggagcgccccaaggcccucaacgaccucggcaagaagauccagcucgucaugaaggucaucgaggccuaccgcaacaaggacgagcgcuacgaccaccucgaccccaccgagauggagaaggucgagaagugcaucuccgacgccauguccuggcucaacuccaagaugaacgcccagaacaagcucucccucacccaggaccccgucgucaaggucuccgagaucgucgccaaguccaaggagcucgacaacuucugcaaccccaucaucuacaagcccaagcccaaggccgagguccccgaggacaagcccaaggccaacuccgagcacaacggccccauggacggccaguccggcaccgagaccaaguccgacuccaccaaggacuccucccagcacaccaaguccuccggcgagauggaggucgacuga

SEQ ID NO: 363 - RNA, 1965 nt, Artificial Sequence
  derived and/or modified CDS sequence (opt2) from Homo sapiens__NP_005338.1__HsHSPA5
augaagcucucccucgucgccgccaugcuccuccuccucuccgccgcccgcgccgaggaggaggacaagaaggaggacgucggcaccgucgucggcaucgaccucggcaccaccuacuccugcgucggcgucuucaagaacggccgcgucgagaucaucgccaacgaccagggcaaccgcaucacccccuccuacgucgccuucacccccgagggcgagcgccucaucggcgacgccgccaagaaccagcucaccuccaaccccgagaacaccgucuucgacgccaagcgccucaucggccgcaccuggaacgaccccuccguccagcaggacaucaaguuccuccccuucaaggucgucgagaagaagaccaagcccuacauccaggucgacaucggcggcggccagaccaagaccuucgcccccgaggagaucuccgccaugguccucaccaagaugaaggagaccgccgaggccuaccucggcaagaaggucacccacgccgucgucaccguccccgccuacuucaacgacgcccagcgccaggccaccaaggacgccggcaccaucgccggccucaacgucaugcgcaucaucaacgagcccaccgccgccgccaucgccuacggccucgacaagcgcgagggcgagaagaacauccucgucuucgaccucggcggcggcaccuucgacgucucccuccucaccaucgacaacggcgucuucgaggucgucgccaccaacggcgacacccaccucggcggcgaggacuucgaccagcgcgucauggagcacuucaucaagcucuacaagaagaagaccggcaaggacguccgcaaggacaaccgcgccguccagaagcuccgccgcgaggucgagaaggccaagcgcgcccucuccucccagcaccaggcccgcaucgagaucgaguccuucuacgagggcgaggacuucuccgagacccucacccgcgccaaguucgaggagcucaacauggaccucuuccgcuccaccaugaagcccguccagaagguccucgaggacuccgaccucaagaaguccgacaucgacgagaucguccucgucggcggcuccacccgcauccccaagauccagcagcucgucaaggaguucuucaacggcaaggagcccucccgcggcaucaaccccgacgaggccgucgccuacggcgccgccguccaggccggcguccucuccggcgaccaggacaccggcgaccucguccuccucgacgucugcccccucacccucggcaucgagaccgucggcggcgucaugaccaagcucaucccccgcaacaccgucguccccaccaagaagucccagaucuucuccaccgccuccgacaaccagcccaccgucaccaucaaggucuacgagggcgagcgcccccucaccaaggacaaccaccuccucggcaccuucgaccucaccggcaucccccccgccccccgcggcgucccccagaucgaggucaccuucgagaucgacgucaacggcauccuccgcgucaccgccgaggacaagggcaccggcaacaagaacaagaucaccaucaccaacgaccagaaccgccucacccccgaggagaucgagcgcauggucaacgacgccgagaaguucgccgaggaggacaagaagcucaaggagcgcaucgacacccgcaacgagcucgaguccuacgccuacucccucaagaaccagaucggcgacaaggagaagcucggcggcaagcucuccuccgaggacaaggagaccauggagaaggccgucgaggagaagaucgaguggcucgagucccaccaggacgccgacaucgaggacuucaaggccaagaagaaggagcucgaggagaucguccagcccaucaucuccaagcucuacggcuccgccggccccccccccaccggcgaggaggacaccgccgagaaggacgagcucuga

SEQ ID NO: 364 - RNA, 1932 nt, Artificial Sequence
  derived and/or modified CDS sequence (opt2) from Homo sapiens__NP_002146.2__HsHSPA6
augcaggccccccgcgagcucgccgucggcaucgaccucggcaccaccuacuccugcgucggcgucuuccagcagggccgcgucgagauccucgccaacgaccagggcaaccgcaccacccccuccuacgucgccuucaccgacaccgagcgccucgucggcgacgccgccaagucccaggccgcccucaacccccacaacaccgucuucgacgccaagcgccucaucggccgcaaguucgccgacaccaccguccaguccgacaugaagcacuggcccuuccgcgucgucuccgagggcggcaagcccaagguccgcgucugcuaccgcggcgaggacaagaccuucuaccccgaggagaucuccuccaugguccucuccaagaugaaggagaccgccgaggccuaccucggccagcccgucaagcacgccgucaucaccguccccgccuacuucaacgacucccagcgccaggccaccaaggacgccggcgccaucgccggccucaacguccuccgcaucaucaacgagcccaccgccgccgccaucgccuacggccucgaccgccgcggcgccggcgagcgcaacguccucaucuucgaccucggcggcggcaccuucgacgucuccguccucuccaucgacgccggcgucuucgaggucaaggccaccgccggcgacacccaccucggcggcgaggacuucgacaaccgccucgucaaccacuucauggaggaguuccgccgcaagcacggcaaggaccucuccggcaacaagcgcgcccuccgccgccuccgcaccgccugcgagcgcgccaagcgcacccucuccuccuccacccaggccacccucgagaucgacucccucuucgagggcgucgacuucuacaccuccaucacccgcgcccgcuucgaggagcucugcuccgaccucuuccgcuccacccucgagcccgucgagaaggcccuccgcgacgccaagcucgacaaggcccagauccacgacgucguccucgucggcggcuccacccgcauccccaagguccagaagcuccuccaggacuucuucaacggcaaggagcucaacaaguccaucaaccccgacgaggccgucgccuacggcgccgccguccaggccgccguccucaugggcgacaagugcgagaagguccaggaccuccuccuccucgacgucgccccccucucccucggccucgagaccgccggcggcgucaugaccacccucauccagcgcaacgccaccauccccaccaagcagacccagaccuucaccaccuacuccgacaaccagcccggcgucuucauccaggucuacgagggcgagcgcgccaugaccaaggacaacaaccuccucggccgcuucgagcucuccggcaucccccccgccccccgcggcgucccccagaucgaggucaccuucgacaucgacgccaacggcauccucuccgucaccgccaccgaccgcuccaccggcaaggccaacaagaucaccaucaccaacgacaagggccgccucuccaaggaggaggucgagcgcaugguccacgaggccgagcaguacaaggccgaggacgaggcccagcgcgaccgcgucgccgccaagaacucccucgaggcccacgucuuccacgucaagggcucccuccaggaggagucccuccgcgacaagauccccgaggaggaccgccgcaagaugcaggacaagugccgcgagguccucgccuggcucgagcacaaccagcucgccgagaaggaggaguacgagcaccagaagcgcgagcucgagcagaucugccgccccaucuucucccgccucuacggcggccccggcguccccggcggcuccuccugcggcacccaggcccgccagggcgaccccuccaccggccccaucaucgaggaggucgacuga

SEQ ID NO: 365 - RNA, 1104 nt, Artificial Sequence
  derived and/or modified CDS sequence (opt2) from Homo sapiens__P48741__HsHSPA7
augcaggccccccgcgagcucgccgucggcaucgaccucggcaccaccuacuccugcgucggcgucuuccagcagggccgcgucgagauccucgccaacgaccagggcaaccgcaccacccccuccuacgucgccuucaccgacaccgagcgccucgucggcgacgccgccaagucccaggccgcccucaacccccacaacaccgucuucgacgccaagcgccucaucggccgcaaguucgccgacaccaccguccaguccgacaugaagcacuggcccuuccaggucgucuccgagggcggcaagcccaagguccgcgucugcuaccgcggcgaggacaagaccuucuaccccgaggagaucuccuccaugguccucuccaagaugaaggagaccgccgaggccuaccucggccagcccgucaagcacgccgucaucaccguccccaccuacuucuccaacucccagcgccaggccaccaaggacgccggcgccaucgccggccucaagguccuccccaucaucaacgaggccaccgccgccgccaucgccuacggccucgaccgccgcggcgccggcaagcgcaacguccucaucuucgaccucggcggcggcaccuucgacgucuccguccucuccaucgacgccggcgucuucgaggucaaggccaccgccggcgacacccaccucggcggcgaggacuucgacaaccgccucgucaaccacuucauggaggaguuccgccgcaagcacggcaaggaccucuccggcaacaagcgcgcccuccgccgccuccgcaccgccugcgagcgcgccaagcgcacccccuccuccuccacccaggccacccucgagaucgacucccucuucgagggcgucgacuucuacaaguccaucacccgcgcccgcuucgaggagcucugcuccgaccucuuccgcuccacccucgagcccgucgagaaggcccuccgcgacgccaagcucgacaaggcccagauccacgacuucguccucggcggcggccuccacucccacccccagggcgccgaggucgccgccggccuccuccagcgccagggcgccgagcaggagcaccagcccuga

SEQ ID NO: 366 - RNA, 1941 nt, Artificial Sequence
  derived and/or modified CDS sequence (opt2) from Homo sapiens__NP_006588.1 __HsHSPA8
auguccaagggccccgccgucggcaucgaccucggcaccaccuacuccugcgucggcgucuuccagcacggcaaggucgagaucaucgccaacgaccagggcaaccgcaccacccccuccuacgucgccuucaccgacaccgagcgccucaucggcgacgccgccaagaaccaggucgccaugaaccccaccaacaccgucuucgacgccaagcgccucaucggccgccgcuucgacgacgccgucguccaguccgacaugaagcacuggcccuucauggucgucaacgacgccggccgccccaagguccaggucgaguacaagggcgagaccaaguccuucuaccccgaggaggucuccuccaugguccucaccaagaugaaggagaucgccgaggccuaccucggcaagaccgucaccaacgccgucgucaccguccccgccuacuucaacgacucccagcgccaggccaccaaggacgccggcaccaucgccggccucaacguccuccgcaucaucaacgagcccaccgccgccgccaucgccuacggccucgacaagaaggucggcgccgagcgcaacguccucaucuucgaccucggcggcggcaccuucgacgucuccauccucaccaucgaggacggcaucuucgaggucaaguccaccgccggcgacacccaccucggcggcgaggacuucgacaaccgcauggucaaccacuucaucgccgaguucaagcgcaagcacaagaaggacaucuccgagaacaagcgcgccguccgccgccuccgcaccgccugcgagcgcgccaagcgcacccucuccuccuccacccaggccuccaucgagaucgacucccucuacgagggcaucgacuucuacaccuccaucacccgcgcccgcuucgaggagcucaacgccgaccucuuccgcggcacccucgaccccgucgagaaggcccuccgcgacgccaagcucgacaagucccagauccacgacaucguccucgucggcggcuccacccgcauccccaagauccagaagcuccuccaggacuucuucaacggcaaggagcucaacaaguccaucaaccccgacgaggccgucgccuacggcgccgccguccaggccgccauccucuccggcgacaaguccgagaacguccaggaccuccuccuccucgacgucaccccccucucccucggcaucgagaccgccggcggcgucaugaccguccucaucaagcgcaacaccaccauccccaccaagcagacccagaccuucaccaccuacuccgacaaccagcccggcguccucauccaggucuacgagggcgagcgcgccaugaccaaggacaacaaccuccucggcaaguucgagcucaccggcaucccccccgccccccgcggcgucccccagaucgaggucaccuucgacaucgacgccaacggcauccucaacgucuccgccgucgacaaguccaccggcaaggagaacaagaucaccaucaccaacgacaagggccgccucuccaaggaggacaucgagcgcaugguccaggaggccgagaaguacaaggccgaggacgagaagcagcgcgacaaggucuccuccaagaacucccucgaguccuacgccuucaacaugaaggccaccgucgaggacgagaagcuccagggcaagaucaacgacgaggacaagcagaagauccucgacaagugcaacgagaucaucaacuggcucgacaagaaccagaccgccgagaaggaggaguucgagcaccagcagaaggagcucgagaaggucugcaaccccaucaucaccaagcucuaccaguccgccggcggcaugcccggcggcaugcccggcggcuuccccggcggcggcgccccccccuccggcggcgccuccuccggccccaccaucgaggaggucgacuga

SEQ ID NO: 367 - RNA, 2040 nt, Artificial Sequence
  derived and/or modified CDS sequence (opt2) from Homo sapiens__NP_004125.3 __HsHSPA9
augaucuccgccucccgcgccgccgccgcccgccucgucggcgccgccgccucccgcggccccaccgccgcccgccaccaggacuccuggaacggccucucccacgaggccuuccgccucgucucccgccgcgacuacgccuccgaggccaucaagggcgccgucgucggcaucgaccucggcaccaccaacuccugcgucgccgucauggagggcaagcaggccaagguccucgagaacgccgagggcgcccgcaccacccccuccgucgucgccuucaccgccgacggcgagcgccucgucggcaugcccgccaagcgccaggccgucaccaaccccaacaacaccuucuacgccaccaagcgccucaucggccgccgcuacgacgaccccgagguccagaaggacaucaagaacguccccuucaagaucguccgcgccuccaacggcgacgccugggucgaggcccacggcaagcucuacucccccucccagaucggcgccuucguccucaugaagaugaaggagaccgccgagaacuaccucggccacaccgccaagaacgccgucaucaccguccccgccuacuucaacgacucccagcgccaggccaccaaggacgccggccagaucuccggccucaacguccuccgcgucaucaacgagcccaccgccgccgcccucgccuacggccucgacaaguccgaggacaaggucaucgccgucuacgaccucggcggcggcaccuucgacaucuccauccucgagauccagaagggcgucuucgaggucaaguccaccaacggcgacaccuuccucggcggcgaggacuucgaccaggcccuccuccgccacaucgucaaggaguucaagcgcgagaccggcgucgaccucaccaaggacaacauggcccuccagcgcguccgcgaggccgccgagaaggccaagugcgagcucuccuccuccguccagaccgacaucaaccuccccuaccucaccauggacuccuccggccccaagcaccucaacaugaagcucacccgcgcccaguucgagggcaucgucaccgaccucauccgccgcaccaucgcccccugccagaaggccaugcaggacgccgaggucuccaaguccgacaucggcgaggucauccucgucggcggcaugacccgcaugcccaagguccagcagaccguccaggaccucuucggccgcgcccccuccaaggccgucaaccccgacgaggccgucgccaucggcgccgccauccagggcggcguccucgccggcgacgucaccgacguccuccuccucgacgucaccccccucucccucggcaucgagacccucggcggcgucuucaccaagcucaucaaccgcaacaccaccauccccaccaagaagucccaggucuucuccaccgccgccgacggccagacccaggucgagaucaaggucugccagggcgagcgcgagauggccggcgacaacaagcuccucggccaguucacccucaucggcaucccccccgccccccgcggcgucccccagaucgaggucaccuucgacaucgacgccaacggcaucguccacgucuccgccaaggacaagggcaccggccgcgagcagcagaucgucauccaguccuccggcggccucuccaaggacgacaucgagaacauggucaagaacgccgagaaguacgccgaggaggaccgccgcaagaaggagcgcgucgaggccgucaacauggccgagggcaucauccacgacaccgagaccaagauggaggaguucaaggaccagcuccccgccgacgagugcaacaagcucaaggaggagaucuccaagaugcgcgagcuccucgcccgcaaggacuccgagaccggcgagaacauccgccaggccgccuccucccuccagcaggccucccucaagcucuucgagauggccuacaagaagauggccuccgagcgcgagggcuccggcuccuccggcaccggcgagcagaaggaggaccagaaggaggagaagcaguga

SEQ ID NO: 368 - RNA, 2028 nt, Artificial Sequence
  derived and/or modified CDS sequence (opt2) from Homo sapiens__NP_079291.2__HsHSPA12A
auggccgacaaggaggccggcggcuccgacggcccccgcgagaccgcccccaccuccgccuacuccucccccgcccgcucccucggcgacaccggcaucaccccccucucccccucccacaucgucaacgacaccgacuccaacgucuccgagcagcaguccuuccucgucgucgucgccgucgacuucggcaccaccuccuccggcuacgccuacuccuucaccaaggagcccgagugcauccacgucaugcgccgcugggagggcggcgaccccggcgucuccaaccagaagacccccaccaccauccuccucacccccgagcgcaaguuccacuccuucggcuacgccgcccgcgacuucuaccacgaccucgaccccaacgaggccaagcaguggcucuaccucgagaaguucaagaugaagcuccacaccaccggcgaccucaccauggacaccgaccucaccgccgccaacggcaagaaggucaaggcccucgagaucuucgccuacgcccuccaguacuucaaggagcaggcccucaaggagcucuccgaccaggccggcuccgaguucgagaacuccgacguccgcugggucaucaccguccccgccaucuggaagcagcccgccaagcaguucaugcgccaggccgccuaccaggccggccucgccucccccgagaacuccgagcagcucaucaucgcccucgagcccgaggccgccuccaucuacugccgcaagcuccgccuccaccagaugaucgagcucuccuccaaggccgccgucaacggcuacuccggcuccgacaccgucggcgccggcuucacccaggccaaggagcacauccgccgcaaccgccagucccgcaccuuccucgucgagaacgucaucggcgagaucugguccgagcucgaggagggcgacaaguacgucgucgucgacuccggcggcggcaccgucgaccucaccguccaccagauccgccuccccgagggccaccucaaggagcucuacaaggccaccggcggccccuacggcucccucggcgucgacuacgaguucgagaagcuccucuacaagaucuucggcgaggacuucaucgagcaguucaagaucaagcgccccgccgccugggucgaccucaugaucgccuucgagucccgcaagcgcgccgccgcccccgaccgcaccaacccccucaacaucacccuccccuucuccuucaucgacuacuacaagaaguuccgcggccacuccgucgagcacgcccuccgcaaguccaacgucgacuucgucaagugguccucccagggcaugcuccgcaugucccccgacgccaugaacgcccucuucaagcccaccaucgacuccaucaucgagcaccuccgcgaccucuuccagaagcccgaggucuccaccgucaaguuccucuuccucgucggcggcuucgccgaggccccccuccuccagcaggccguccaggccgccuucggcgaccagugccgcaucaucaucccccaggacgucggccucaccauccucaagggcgccguccucuucggccucgaccccgccgucaucaagguccgccgcuccccccucaccuacggcgucggcguccucaaccgcuacgucgagggcaagcacccccccgagaagcuccucgucaaggacggcacccgcuggugcaccgacgucuucgacaaguucaucuccgccgaccaguccgucgcccucggcgagcucgucaagcgcuccuacacccccgccaagcccucccagcucgucaucgucaucaacaucuacuccuccgagcacgacaacgucuccuucaucaccgaccccggcgucaagaagugcggcacccuccgccucgaccucaccggcaccuccggcaccgccguccccgcccgccgcgagauccagacccucaugcaguucggcgacaccgagaucaaggccaccgccaucgacaucgccaccuccaaguccgucaaggucggcaucgacuuccucaacuacuga

SEQ ID NO: 369 - RNA, 2061 nt, Artificial Sequence
  derived and/or modified CDS sequence (opt2) from Homo sapiens__NP_443202.3 __HsHSPA12B
augcucgccguccccgagaugggccuccagggccucuacaucggcuccucccccgagcgcucccccguccccuccccccccggcuccccccgcacccaggaguccugcggcaucgccccccucacccccucccagucccccaagcccgagguccgcgccccccagcaggccuccuucuccgucgucgucgccaucgacuucggcaccaccuccuccggcuacgccuucuccuucgccuccgaccccgaggccauccacaugaugcgcaagugggagggcggcgaccccggcgucgcccaccagaagacccccaccugccuccuccucacccccgagggcgccuuccacuccuucggcuacaccgcccgcgacuacuaccacgaccucgaccccgaggaggcccgcgacuggcucuacuucgagaaguucaagaugaagauccacuccgccaccgaccucacccucaagacccagcucgaggccgucaacggcaagaccaugcccgcccucgaggucuucgcccacgcccuccgcuucuuccgcgagcacgcccuccaggagcuccgcgagcagucccccucccuccccgagaaggacaccguccgcuggguccucaccguccccgccaucuggaagcagcccgccaagcaguucaugcgcgaggccgccuaccucgccggccucgucucccgcgagaacgccgagcagcuccucaucgcccucgagcccgaggccgccuccgucuacugccgcaagcuccgccuccaccagcuccucgaccucuccggccgcgcccccggcggcggccgccucggcgagcgccgcuccaucgacuccuccuuccgccaggcccgcgagcagcuccgccgcucccgccacucccgcaccuuccucgucgaguccggcgucggcgagcucugggccgagaugcaggccggcgaccgcuacgucgucgccgacugcggcggcggcaccgucgaccucaccguccaccagcucgagcagccccacggcacccucaaggagcucuacaaggccuccggcggccccuacggcgccgucggcgucgaccucgccuucgagcagcuccucugccgcaucuucggcgaggacuucaucgccaccuucaagcgccagcgccccgccgccugggucgaccucaccaucgccuucgaggcccgcaagcgcaccgccggcccccaccgcgccggcgcccucaacaucucccuccccuucuccuucaucgacuucuaccgcaagcagcgcggccacaacgucgagaccgcccuccgccgcuccuccgucaacuucgucaagugguccucccagggcaugcuccgcauguccugcgaggccaugaacgagcucuuccagcccaccgucuccggcaucauccagcacaucgaggcccuccucgcccgccccgagguccagggcgucaagcuccucuuccucgucggcggcuucgccgaguccgccguccuccagcacgccguccaggccgcccucggcgcccgcggccuccgcgucgucgucccccacgacgucggccucaccauccucaagggcgccguccucuucggccaggcccccggcgucguccgcguccgccgcuccccccucaccuacggcgucggcguccucaaccgcuucguccccggccgccacccccccgagaagcuccucguccgcgacggccgccgcuggugcaccgacgucuucgagcgcuucgucgccgccgagcaguccgucgcccucggcgaggagguccgccgcuccuacugccccgcccgccccggccagcgccgcguccucaucaaccucuacugcugcgccgccgaggacgcccgcuucaucaccgaccccggcguccgcaagugcggcgcccucucccucgagcucgagcccgccgacugcggccaggacaccgccggcgccccccccggccgccgcgagauccgcgccgccaugcaguucggcgacaccgagaucaaggucaccgccgucgacgucuccaccaaccgcuccguccgcgccuccaucgacuuccucuccaacuga

SEQ ID NO: 370 - RNA, 1416 nt, Artificial Sequence
  derived and/or modified CDS sequence (opt2) from Homo sapiens__NP_008879.3__HsHSPA13
auggcccgcgagaugaccauccucggcuccgccguccucacccuccuccucgccggcuaccucgcccagcaguaccucccccuccccacccccaaggucaucggcaucgaccucggcaccaccuacugcuccgucggcgucuucuuccccggcaccggcaaggucaaggucauccccgacgagaacggccacaucuccauccccuccauggucuccuucaccgacaacgacgucuacgucggcuacgaguccgucgagcucgccgacuccaacccccagaacaccaucuacgacgccaagcgcuucaucggcaagaucuucaccgccgaggagcucgaggccgagaucggccgcuaccccuucaagguccucaacaagaacggcauggucgaguucuccgucaccuccaacgagaccaucaccgucucccccgaguacgucggcucccgccuccuccucaagcucaaggagauggccgaggccuaccucggcaugcccgucgccaacgccgucaucuccguccccgccgaguucgaccucaagcagcgcaacuccaccaucgaggccgccaaccucgccggccucaagauccuccgcgucaucaacgagcccaccgccgccgccauggccuacggccuccacaaggccgacgucuuccacguccucgucaucgaccucggcggcggcacccucgacgucucccuccucaacaagcagggcggcauguuccucacccgcgccauguccggcaacaacaagcucggcggccaggacuucaaccagcgccuccuccaguaccucuacaagcagaucuaccagaccuacggcuucguccccucccgcaaggaggagauccaccgccuccgccaggccgucgagauggucaagcucaaccucacccuccaccaguccgcccagcucuccguccuccucaccgucgaggagcaggaccgcaaggagccccacuccuccgacaccgagcuccccaaggacaagcucuccuccgccgacgaccaccgcgucaacuccggcuucggccgcggccucuccgacaagaaguccggcgagucccagguccucuucgagaccgagaucucccgcaagcucuucgacacccucaacgaggaccucuuccagaagauccucguccccauccagcagguccucaaggagggccaccucgagaagaccgagaucgacgaggucguccucgucggcggcuccacccgcaucccccgcauccgccaggucauccaggaguucuucggcaaggaccccaacaccuccgucgaccccgaccucgccgucgucaccggcgucgccauccaggccggcaucgacggcggcuccuggccccuccaggucuccgcccucgagauccccaacaagcaccuccagaagaccaacuucaacuga

SEQ ID NO: 371 - RNA, 1530 nt, Artificial Sequence
  derived and/or modified CDS sequence (opt2) from Homo sapiens__NP_057383.2__HsHSPA14
auggccgccaucggcguccaccucggcugcaccuccgccugcgucgccgucuacaaggacggccgcgccggcgucgucgccaacgacgccggcgaccgcgucacccccgccgucgucgccuacuccgagaacgaggagaucgucggccucgccgccaagcagucccgcauccgcaacaucuccaacaccgucaugaaggucaagcagauccucggccgcuccuccuccgacccccaggcccagaaguacaucgccgaguccaagugccucgucaucgagaagaacggcaagcuccgcuacgagaucgacaccggcgaggagaccaaguucgucaaccccgaggacgucgcccgccucaucuucuccaagaugaaggagaccgcccacuccguccucggcuccgacgccaacgacgucgucaucaccguccccuucgacuucggcgagaagcagaagaacgcccucggcgaggccgcccgcgccgccggcuucaacguccuccgccucauccacgagcccuccgccgcccuccucgccuacggcaucggccaggacucccccaccggcaaguccaacauccucgucuucaagcucggcggcaccucccucucccucuccgucauggaggucaacuccggcaucuaccgcguccucuccaccaacaccgacgacaacaucggcggcgcccacuucaccgagacccucgcccaguaccucgccuccgaguuccagcgcuccuucaagcacgacguccgcggcaacgcccgcgccaugaugaagcucaccaacuccgccgaggucgccaagcacucccucuccacccucggcuccgccaacugcuuccucgacucccucuacgagggccaggacuucgacugcaacgucucccgcgcccgcuucgagcuccucugcuccccccucuucaacaagugcaucgaggccauccgcggccuccucgaccagaacggcuucaccgccgacgacaucaacaaggucguccucugcggcggcuccucccgcauccccaagcuccagcagcucaucaaggaccucuuccccgccgucgagcuccucaacuccaucccccccgacgaggucauccccaucggcgccgccaucgaggccggcauccucaucggcaaggagaaccuccucgucgaggacucccucaugaucgagugcuccgcccgcgacauccucgucaagggcgucgacgaguccggcgccucccgcuucaccguccucuuccccuccggcaccccccuccccgcccgccgccagcacacccuccaggcccccggcuccaucuccuccgucugccucgagcucuacgaguccgacggcaagaacuccgccaaggaggagaccaaguucgcccaggucguccuccaggaccucgacaagaaggagaacggccuccgcgacauccucgccguccucaccaugaagcgcgacggcucccuccacgucaccugcaccgaccaggagaccggcaagugcgaggccaucuccaucgagaucgccuccuga

SEQ ID NO: 372 - RNA, 2577 nt, Artificial Sequence
  derived and/or modified CDS sequence (opt2) from Homo sapiens__NP_006635.2 __HsHSPH1
auguccgucgucggccucgacgucggcucccaguccugcuacaucgccgucgcccgcgccggcggcaucgagaccaucgccaacgaguucuccgaccgcugcacccccuccgucaucuccuucggcuccaagaaccgcaccaucggcgucgccgccaagaaccagcagaucacccacgccaacaacaccgucuccaacuucaagcgcuuccacggccgcgccuucaacgaccccuucauccagaaggagaaggagaaccucuccuacgaccucgucccccucaagaacggcggcgucggcaucaaggucauguacaugggcgaggagcaccucuucuccgucgagcagaucaccgccaugcuccucaccaagcucaaggagaccgccgagaacucccucaagaagcccgucaccgacugcgucaucuccguccccuccuucuucaccgacgccgagcgccgcuccguccucgacgccgcccagaucgucggccucaacugccuccgccucaugaacgacaugaccgccgucgcccucaacuacggcaucuacaagcaggaccuccccucccucgacgagaagccccgcaucgucgucuucgucgacaugggccacuccgccuuccaggucuccgccugcgccuucaacaagggcaagcucaagguccucggcaccgccuucgaccccuuccucggcggcaagaacuucgacgagaagcucgucgagcacuucugcgccgaguucaagaccaaguacaagcucgacgccaaguccaagauccgcgcccuccuccgccucuaccaggagugcgagaagcucaagaagcucauguccuccaacuccaccgaccucccccucaacaucgagugcuucaugaacgacaaggacgucuccggcaagaugaaccgcucccaguucgaggagcucugcgccgagcuccuccagaagaucgaggucccccucuacucccuccucgagcagacccaccucaaggucgaggacgucuccgccgucgagaucgucggcggcgccacccgcauccccgccgucaaggagcgcaucgccaaguucuucggcaaggacaucuccaccacccucaacgccgacgaggccgucgcccgcggcugcgcccuccagugcgccauccucucccccgccuucaagguccgcgaguucuccgucaccgacgccguccccuuccccaucucccucaucuggaaccacgacuccgaggacaccgagggcguccacgaggucuucucccgcaaccacgccgcccccuucuccaagguccucaccuuccuccgccgcggccccuucgagcucgaggccuucuacuccgacccccagggcguccccuaccccgaggccaagaucggccgcuucgucguccagaacgucuccgcccagaaggacggcgagaagucccgcgucaaggucaagguccgcgucaacacccacggcaucuucaccaucuccaccgccuccauggucgagaagguccccaccgaggagaacgagauguccuccgaggccgacauggagugccucaaccagcgcccccccgagaaccccgacaccgacaagaacguccagcaggacaacuccgaggccggcacccagccccagguccagaccgacgcccagcagaccucccaguccccccccucccccgagcucaccuccgaggagaacaagauccccgacgccgacaaggccaacgagaagaaggucgaccagccccccgaggccaagaagcccaagaucaaggucgucaacgucgagcuccccaucgaggccaaccucgucuggcagcucggcaaggaccuccucaacauguacaucgagaccgagggcaagaugaucaugcaggacaagcucgagaaggagcgcaacgacgccaagaacgccgucgaggaguacgucuacgaguuccgcgacaagcucugcggccccuacgagaaguucaucugcgagcaggaccaccagaacuuccuccgccuccucaccgagaccgaggacuggcucuacgaggagggcgaggaccaggccaagcaggccuacgucgacaagcucgaggagcucaugaagaucggcacccccgucaagguccgcuuccaggaggccgaggagcgccccaagauguucgaggagcucggccagcgccuccagcacuacgccaagaucgccgccgacuuccgcaacaaggacgagaaguacaaccacaucgacgaguccgagaugaagaaggucgagaaguccgucaacgaggucauggaguggaugaacaacgucaugaacgcccaggccaagaagucccucgaccaggaccccgucguccgcgcccaggagaucaagaccaagaucaaggagcucaacaacaccugcgagcccgucgucacccagcccaagcccaagaucgagucccccaagcucgagcgcacccccaacggccccaacaucgacaagaaggaggaggaccucgaggacaagaacaacuucggcgccgagcccccccaccagaacggcgagugcuaccccaacgagaagaacuccgucaacauggaccucgacuga

SEQ ID NO: 373 - RNA, 3000 nt, Artificial Sequence
  derived and/or modified CDS sequence (opt2) from Homo sapiens__NP_006380.1 __HsHYOU1
auggccgacaagguccgccgccagcgcccccgccgccgcgucugcugggcccucgucgccguccuccucgccgaccuccucgcccucuccgacacccucgccgucauguccgucgaccucggcuccgaguccaugaaggucgccaucgucaagcccggcguccccauggagaucguccucaacaaggagucccgccgcaagacccccgucaucgucacccucaaggagaacgagcgcuucuucggcgacuccgccgccuccauggccaucaagaaccccaaggccacccuccgcuacuuccagcaccuccucggcaagcaggccgacaacccccacgucgcccucuaccaggcccgcuuccccgagcacgagcucaccuucgacccccagcgccagaccguccacuuccagaucuccucccagcuccaguucucccccgaggagguccucggcaugguccucaacuacucccgcucccucgccgaggacuucgccgagcagcccaucaaggacgccgucaucaccguccccgucuucuucaaccaggccgagcgccgcgccguccuccaggccgcccgcauggccggccucaagguccuccagcucaucaacgacaacaccgccaccgcccucuccuacggcgucuuccgccgcaaggacaucaacaccaccgcccagaacaucauguucuacgacaugggcuccggcuccaccgucugcaccaucgucaccuaccagauggucaagaccaaggaggccggcaugcagccccagcuccagauccgcggcgucggcuucgaccgcacccucggcggccucgagauggagcuccgccuccgcgagcgccucgccggccucuucaacgagcagcgcaagggccagcgcgccaaggacguccgcgagaacccccgcgccauggccaagcuccuccgcgaggccaaccgccucaagaccguccucuccgccaacgccgaccacauggcccagaucgagggccucauggacgacgucgacuucaaggccaaggucacccgcgucgaguucgaggagcucugcgccgaccucuucgagcgcguccccggccccguccagcaggcccuccaguccgccgagaugucccucgacgagaucgagcaggucauccucgucggcggcgccacccgcgucccccgcguccaggagguccuccucaaggccgucggcaaggaggagcucggcaagaacaucaacgccgacgaggccgccgccaugggcgccgucuaccaggccgccgcccucuccaaggccuucaaggucaagcccuucgucguccgcgacgccgucgucuaccccauccucgucgaguucacccgcgaggucgaggaggagcccggcauccacucccucaagcacaacaagcgcguccucuucucccgcaugggccccuacccccagcgcaaggucaucaccuucaaccgcuacucccacgacuucaacuuccacaucaacuacggcgaccucggcuuccucggccccgaggaccuccgcgucuucggcucccagaaccucaccaccgucaagcucaagggcgucggcgacuccuucaagaaguaccccgacuacgaguccaagggcaucaaggcccacuucaaccucgacgaguccggcguccucucccucgaccgcgucgaguccgucuucgagacccucgucgaggacuccgccgaggaggaguccacccucaccaagcucggcaacaccaucuccucccucuucggcggcggcaccacccccgacgccaaggagaacggcaccgacaccguccaggaggaggaggagucccccgccgagggcuccaaggacgagcccggcgagcaggucgagcucaaggaggaggccgaggcccccgucgaggacggcucccagccccccccccccgagcccaagggcgacgccacccccgagggcgagaaggccaccgagaaggagaacggcgacaaguccgaggcccagaagcccuccgagaaggccgaggccggccccgagggcgucgcccccgcccccgagggcgagaagaagcagaagcccgcccgcaagcgccgcauggucgaggagaucggcgucgagcucgucguccucgaccuccccgaccuccccgaggacaagcucgcccaguccguccagaagcuccaggaccucacccuccgcgaccucgagaagcaggagcgcgagaaggccgccaacucccucgaggccuucaucuucgagacccaggacaagcucuaccagcccgaguaccaggaggucuccaccgaggagcagcgcgaggagaucuccggcaagcucuccgccgccuccaccuggcucgaggacgagggcgucggcgccaccaccgucaugcucaaggagaagcucgccgagcuccgcaagcucugccagggccucuucuuccgcgucgaggagcgcaagaaguggcccgagcgccucuccgcccucgacaaccuccucaaccacuccuccauguuccucaagggcgcccgccucauccccgagauggaccagaucuucaccgaggucgagaugaccacccucgagaaggucaucaacgagaccugggccuggaagaacgccacccucgccgagcaggccaagcuccccgccaccgagaagcccguccuccucuccaaggacaucgaggccaagaugauggcccucgaccgcgagguccaguaccuccucaacaaggccaaguucaccaagccccgcccccgccccaaggacaagaacggcacccgcgccgagcccccccucaacgccuccgccuccgaccagggcgagaaggucaucccccccgccggccagaccgaggacgccgagcccaucuccgagcccgagaaggucgagaccggcuccgagcccggcgacaccgagccccucgagcucggcggccccggcgccgagcccgagcagaaggagcaguccaccggccagaagcgcccccucaagaacgacgagcucuga

SEQ ID NO: 374 - RNA, 2199 nt, Artificial Sequence
  derived and/or modified CDS sequence (opt2) from Homo sapiens__NP_005339.3 __HsHSP90AA1
augcccgaggagacccagacccaggaccagcccauggaggaggaggaggucgagaccuucgccuuccaggccgagaucgcccagcucaugucccucaucaucaacaccuucuacuccaacaaggagaucuuccuccgcgagcucaucuccaacuccuccgacgcccucgacaagauccgcuacgagucccucaccgaccccuccaagcucgacuccggcaaggagcuccacaucaaccucauccccaacaagcaggaccgcacccucaccaucgucgacaccggcaucggcaugaccaaggccgaccucaucaacaaccucggcaccaucgccaaguccggcaccaaggccuucauggaggcccuccaggccggcgccgacaucuccaugaucggccaguucggcgucggcuucuacuccgccuaccucgucgccgagaaggucaccgucaucaccaagcacaacgacgacgagcaguacgccugggaguccuccgccggcggcuccuucaccguccgcaccgacaccggcgagcccaugggccgcggcaccaaggucauccuccaccucaaggaggaccagaccgaguaccucgaggagcgccgcaucaaggagaucgucaagaagcacucccaguucaucggcuaccccaucacccucuucgucgagaaggagcgcgacaaggaggucuccgacgacgaggccgaggagaaggaggacaaggaggaggagaaggagaaggaggagaaggaguccgaggacaagcccgagaucgaggacgucggcuccgacgaggaggaggagaagaaggacggcgacaagaagaagaagaagaagaucaaggagaaguacaucgaccaggaggagcucaacaagaccaagcccaucuggacccgcaaccccgacgacaucaccaacgaggaguacggcgaguucuacaagucccucaccaacgacugggaggaccaccucgccgucaagcacuucuccgucgagggccagcucgaguuccgcgcccuccucuucgucccccgccgcgcccccuucgaccucuucgagaaccgcaagaagaagaacaacaucaagcucuacguccgccgcgucuucaucauggacaacugcgaggagcucauccccgaguaccucaacuucauccgcggcgucgucgacuccgaggaccucccccucaacaucucccgcgagaugcuccagcaguccaagauccucaaggucauccgcaagaaccucgucaagaagugccucgagcucuucaccgagcucgccgaggacaaggagaacuacaagaaguucuacgagcaguucuccaagaacaucaagcucggcauccacgaggacucccagaaccgcaagaagcucuccgagcuccuccgcuacuacaccuccgccuccggcgacgagauggucucccucaaggacuacugcacccgcaugaaggagaaccagaagcacaucuacuacaucaccggcgagaccaaggaccaggucgccaacuccgccuucgucgagcgccuccgcaagcacggccucgaggucaucuacaugaucgagcccaucgacgaguacugcguccagcagcucaaggaguucgagggcaagacccucgucuccgucaccaaggagggccucgagcuccccgaggacgaggaggagaagaagaagcaggaggagaagaagaccaaguucgagaaccucugcaagaucaugaaggacauccucgagaagaaggucgagaaggucgucgucuccaaccgccucgucaccucccccugcugcaucgucaccuccaccuacggcuggaccgccaacauggagcgcaucaugaaggcccaggcccuccgcgacaacuccaccaugggcuacauggccgccaagaagcaccucgagaucaaccccgaccacuccaucaucgagacccuccgccagaaggccgaggccgacaagaacgacaaguccgucaaggaccucgucauccuccucuacgagaccgcccuccucuccuccggcuucucccucgaggacccccagacccacgccaaccgcaucuaccgcaugaucaagcucggccucggcaucgacgaggacgaccccaccgccgacgacaccuccgccgccgucaccgaggagaugcccccccucgagggcgacgacgacaccucccgcauggaggaggucgacuga

SEQ ID NO: 375 - RNA, 339 nt, Artificial Sequence
  derived and/or modified CDS sequence (opt2) from Homo sapiens__NG_005218__HsHSP90AA3P
auggacuccuccaagcucgacuccggcaagggccuccacaucaaccucguccccaacaagcagaaccagacccucaccaucgucgacacccgcaucggcaugaccaagaccgaccucaucaacaaccucggcaccgucaccaaguccggcaccaaggccuucauggaggcccuccaggccgacgccgacaucuccaugaucggccacuucggcgucggcuucuacuccgccuaccucgucgccaagaaggucaccgucaucuccaagcacaacaacgacgagcaguacaccugggaguccuccgccggcggcuccuucaccguccgcaccgacgaguga

SEQ ID NO: 376 - RNA, 2175 nt, Artificial Sequence
  derived and/or modified CDS sequence (opt2) from Homo sapiens__NP_031381.2__HsHSP90AB1
augcccgaggagguccaccacggcgaggaggaggucgagaccuucgccuuccaggccgagaucgcccagcucaugucccucaucaucaacaccuucuacuccaacaaggagaucuuccuccgcgagcucaucuccaacgccuccgacgcccucgacaagauccgcuacgagucccucaccgaccccuccaagcucgacuccggcaaggagcucaagaucgacaucauccccaacccccaggagcgcacccucacccucgucgacaccggcaucggcaugaccaaggccgaccucaucaacaaccucggcaccaucgccaaguccggcaccaaggccuucauggaggcccuccaggccggcgccgacaucuccaugaucggccaguucggcgucggcuucuacuccgccuaccucgucgccgagaaggucgucgucaucaccaagcacaacgacgacgagcaguacgccugggaguccuccgccggcggcuccuucaccguccgcgccgaccacggcgagcccaucggccgcggcaccaaggucauccuccaccucaaggaggaccagaccgaguaccucgaggagcgccgcgucaaggaggucgucaagaagcacucccaguucaucggcuaccccaucacccucuaccucgagaaggagcgcgagaaggagaucuccgacgacgaggccgaggaggagaagggcgagaaggaggaggaggacaaggacgacgaggagaagcccaagaucgaggacgucggcuccgacgaggaggacgacuccggcaaggacaagaagaagaagaccaagaagaucaaggagaaguacaucgaccaggaggagcucaacaagaccaagcccaucuggacccgcaaccccgacgacaucacccaggaggaguacggcgaguucuacaagucccucaccaacgacugggaggaccaccucgccgucaagcacuucuccgucgagggccagcucgaguuccgcgcccuccucuucaucccccgccgcgcccccuucgaccucuucgagaacaagaagaagaagaacaacaucaagcucuacguccgccgcgucuucaucauggacuccugcgacgagcucauccccgaguaccucaacuucauccgcggcgucgucgacuccgaggaccucccccucaacaucucccgcgagaugcuccagcaguccaagauccucaaggucauccgcaagaacaucgucaagaagugccucgagcucuucuccgagcucgccgaggacaaggagaacuacaagaaguucuacgaggccuucuccaagaaccucaagcucggcauccacgaggacuccaccaaccgccgccgccucuccgagcuccuccgcuaccacaccucccaguccggcgacgagaugaccucccucuccgaguacgucucccgcaugaaggagacccagaaguccaucuacuacaucaccggcgaguccaaggagcaggucgccaacuccgccuucgucgagcgcguccgcaagcgcggcuucgaggucgucuacaugaccgagcccaucgacgaguacugcguccagcagcucaaggaguucgacggcaagucccucgucuccgucaccaaggagggccucgagcuccccgaggacgaggaggagaagaagaagauggaggaguccaaggccaaguucgagaaccucugcaagcucaugaaggagauccucgacaagaaggucgagaaggucaccaucuccaaccgccucgucuccucccccugcugcaucgucaccuccaccuacggcuggaccgccaacauggagcgcaucaugaaggcccaggcccuccgcgacaacuccaccaugggcuacaugauggccaagaagcaccucgagaucaaccccgaccaccccaucgucgagacccuccgccagaaggccgaggccgacaagaacgacaaggccgucaaggaccucgucguccuccucuucgagaccgcccuccucuccuccggcuucucccucgaggacccccagacccacuccaaccgcaucuaccgcaugaucaagcucggccucggcaucgacgaggacgaggucgccgccgaggagcccaacgccgccguccccgacgagauccccccccucgagggcgacgaggacgccucccgcauggaggaggucgacuga

SEQ ID NO: 377 - RNA, 2412 nt, Artificial Sequence
  derived and/or modified CDS sequence (opt2) from Homo sapiens__NP_003290.1__HsHSP90B1
augcgcgcccucuggguccucggccucugcugcguccuccucaccuucggcuccguccgcgccgacgacgaggucgacgucgacggcaccgucgaggaggaccucggcaagucccgcgagggcucccgcaccgacgacgaggucguccagcgcgaggaggaggccauccagcucgacggccucaacgccucccagauccgcgagcuccgcgagaaguccgagaaguucgccuuccaggccgaggucaaccgcaugaugaagcucaucaucaacucccucuacaagaacaaggagaucuuccuccgcgagcucaucuccaacgccuccgacgcccucgacaagauccgccucaucucccucaccgacgagaacgcccucuccggcaacgaggagcucaccgucaagaucaagugcgacaaggagaagaaccuccuccacgucaccgacaccggcgucggcaugacccgcgaggagcucgucaagaaccucggcaccaucgccaaguccggcaccuccgaguuccucaacaagaugaccgaggcccaggaggacggccaguccaccuccgagcucaucggccaguucggcgucggcuucuacuccgccuuccucgucgccgacaaggucaucgucaccuccaagcacaacaacgacacccagcacaucugggaguccgacuccaacgaguucuccgucaucgccgacccccgcggcaacacccucggccgcggcaccaccaucacccucguccucaaggaggaggccuccgacuaccucgagcucgacaccaucaagaaccucgucaagaaguacucccaguucaucaacuuccccaucuacgucugguccuccaagaccgagaccgucgaggagcccauggaggaggaggaggccgccaaggaggagaaggaggaguccgacgacgaggccgccgucgaggaggaggaggaggagaagaagcccaagaccaagaaggucgagaagaccgucugggacugggagcucaugaacgacaucaagcccaucuggcagcgccccuccaaggaggucgaggaggacgaguacaaggccuucuacaaguccuucuccaaggaguccgacgaccccauggccuacauccacuucaccgccgagggcgaggucaccuucaaguccauccucuucguccccaccuccgccccccgcggccucuucgacgaguacggcuccaagaaguccgacuacaucaagcucuacguccgccgcgucuucaucaccgacgacuuccacgacaugaugcccaaguaccucaacuucgucaagggcgucgucgacuccgacgaccucccccucaacgucucccgcgagacccuccagcagcacaagcuccucaaggucauccgcaagaagcucguccgcaagacccucgacaugaucaagaagaucgccgacgacaaguacaacgacaccuucuggaaggaguucggcaccaacaucaagcucggcgucaucgaggaccacuccaaccgcacccgccucgccaagcuccuccgcuuccaguccucccaccaccccaccgacaucaccucccucgaccaguacgucgagcgcaugaaggagaagcaggacaagaucuacuucauggccggcuccucccgcaaggaggccgaguccucccccuucgucgagcgccuccucaagaagggcuacgaggucaucuaccucaccgagcccgucgacgaguacugcauccaggcccuccccgaguucgacggcaagcgcuuccagaacgucgccaaggagggcgucaaguucgacgaguccgagaagaccaaggagucccgcgaggccgucgagaaggaguucgagccccuccucaacuggaugaaggacaaggcccucaaggacaagaucgagaaggccgucgucucccagcgccucaccgagucccccugcgcccucgucgccucccaguacggcugguccggcaacauggagcgcaucaugaaggcccaggccuaccagaccggcaaggacaucuccaccaacuacuacgccucccagaagaagaccuucgagaucaacccccgccacccccucauccgcgacaugcuccgccgcaucaaggaggacgaggacgacaagaccguccucgaccucgccgucguccucuucgagaccgccacccuccgcuccggcuaccuccuccccgacaccaaggccuacggcgaccgcaucgagcgcaugcuccgccucucccucaacaucgaccccgacgccaaggucgaggaggagcccgaggaggagcccgaggagaccgccgaggacaccaccgaggacaccgagcaggacgaggacgaggagauggacgucggcaccgacgaggaggaggagaccgccaaggaguccaccgccgagaaggacgagcucuga

SEQ ID NO: 378 - RNA, 2115 nt, Artificial Sequence
  derived and/or modified CDS sequence (opt2) from Homo sapiens__NP_057376.2__HsTRAP1
auggcccgcgagcuccgcgcccuccuccucuggggccgccgccuccgcccccuccuccgcgcccccgcccucgccgccguccccggcggcaagcccauccucugcccccgccgcaccaccgcccagcucggcccccgccgcaaccccgccuggucccuccaggccggccgccucuucuccacccagaccgccgaggacaaggaggagccccuccacuccaucaucuccuccaccgaguccguccagggcuccaccuccaagcacgaguuccaggccgagaccaagaagcuccucgacaucgucgcccgcucccucuacuccgagaaggaggucuucauccgcgagcucaucuccaacgccuccgacgcccucgagaagcuccgccacaagcucgucuccgacggccaggcccuccccgagauggagauccaccuccagaccaacgccgagaagggcaccaucaccauccaggacaccggcaucggcaugacccaggaggagcucgucuccaaccucggcaccaucgcccgcuccggcuccaaggccuuccucgacgcccuccagaaccaggccgaggccuccuccaagaucaucggccaguucggcgucggcuucuacuccgccuucauggucgccgaccgcgucgaggucuacucccgcuccgccgcccccggcucccucggcuaccaguggcucuccgacggcuccggcgucuucgagaucgccgaggccuccggcguccgcaccggcaccaagaucaucauccaccucaaguccgacugcaaggaguucuccuccgaggcccgcguccgcgacgucgucaccaaguacuccaacuucgucuccuucccccucuaccucaacggccgccgcaugaacacccuccaggccaucuggaugauggaccccaaggacguccgcgaguggcagcacgaggaguucuaccgcuacgucgcccaggcccacgacaagccccgcuacacccuccacuacaagaccgacgccccccucaacauccgcuccaucuucuacguccccgacaugaagcccuccauguucgacgucucccgcgagcucggcuccuccgucgcccucuacucccgcaagguccucauccagaccaaggccaccgacauccuccccaaguggcuccgcuucauccgcggcgucgucgacuccgaggacaucccccucaaccucucccgcgagcuccuccaggaguccgcccucauccgcaagcuccgcgacguccuccagcagcgccucaucaaguucuucaucgaccaguccaagaaggacgccgagaaguacgccaaguucuucgaggacuacggccucuucaugcgcgagggcaucgucaccgccaccgagcaggaggucaaggaggacaucgccaagcuccuccgcuacgaguccuccgcccuccccuccggccagcucaccucccucuccgaguacgccucccgcaugcgcgccggcacccgcaacaucuacuaccucugcgcccccaaccgccaccucgccgagcacucccccuacuacgaggccaugaagaagaaggacaccgagguccucuucugcuucgagcaguucgacgagcucacccuccuccaccuccgcgaguucgacaagaagaagcucaucuccgucgagaccgacaucgucgucgaccacuacaaggaggagaaguucgaggaccgcucccccgccgccgagugccucuccgagaaggagaccgaggagcucauggccuggaugcgcaacguccucggcucccgcgucaccaacgucaaggucacccuccgccucgacacccaccccgccauggucaccguccucgagaugggcgccgcccgccacuuccuccgcaugcagcagcucgccaagacccaggaggagcgcgcccagcuccuccagcccacccucgagaucaacccccgccacgcccucaucaagaagcucaaccagcuccgcgccuccgagcccggccucgcccagcuccucgucgaccagaucuacgagaacgccaugaucgccgccggccucgucgacgacccccgcgccauggucggccgccucaacgagcuccucgucaaggcccucgagcgccacuga

SEQ ID NO: 379 - RNA, 462 nt, Artificial Sequence
  derived and/or modified CDS sequence (opt2) from Homo sapiens__NP_000609.1__HsIGF1
augggcaagaucuccucccuccccacccagcucuucaagugcugcuucugcgacuuccucaaggucaagaugcacaccauguccuccucccaccucuucuaccucgcccucugccuccucaccuucaccuccuccgccaccgccggccccgagacccucugcggcgccgagcucgucgacgcccuccaguucgucugcggcgaccgcggcuucuacuucaacaagcccaccggcuacggcuccuccucccgccgcgccccccagaccggcaucgucgacgagugcugcuuccgcuccugcgaccuccgccgccucgagauguacugcgccccccucaagcccgccaaguccgcccgcuccguccgcgcccagcgccacaccgacaugcccaagacccagaaggagguccaccucaagaacgccucccgcggcuccgccggcaacaagaacuaccgcauguga

SEQ ID NO: 380 - RNA, 543 nt, Artificial Sequence
  derived and/or modified CDS sequence (opt2) from Homo sapiens__NP_000603.1__HsIGF2
augggcauccccaugggcaaguccaugcucguccuccucaccuuccucgccuucgccuccugcugcaucgccgccuaccgccccuccgagacccucugcggcggcgagcucgucgacacccuccaguucgucugcggcgaccgcggcuucuacuucucccgccccgccucccgcgucucccgccgcucccgcggcaucgucgaggagugcugcuuccgcuccugcgaccucgcccuccucgagaccuacugcgccacccccgccaaguccgagcgcgacgucuccaccccccccaccguccuccccgacaacuucccccgcuaccccgucggcaaguucuuccaguacgacaccuggaagcaguccacccagcgccuccgccgcggccuccccgcccuccuccgcgcccgccgcggccacguccucgccaaggagcucgaggccuuccgcgaggccaagcgccaccgcccccucaucgcccuccccacccaggaccccgcccacggcggcgccccccccgagauggccuccaaccgcaaguga

SEQ ID NO: 381 - RNA, 639 nt, Artificial Sequence
  derived and/or modified CDS sequence (opt2) from Homo sapiens__NP_000591.1__HsIL6
augaacuccuucuccaccuccgccuucggccccgucgccuucucccucggccuccuccucguccuccccgccgccuuccccgcccccgucccccccggcgaggacuccaaggacgucgccgccccccaccgccagccccucaccuccuccgagcgcaucgacaagcagauccgcuacauccucgacggcaucuccgcccuccgcaaggagaccugcaacaaguccaacaugugcgaguccuccaaggaggcccucgccgagaacaaccucaaccuccccaagauggccgagaaggacggcugcuuccaguccggcuucaacgaggagaccugccucgucaagaucaucaccggccuccucgaguucgaggucuaccucgaguaccuccagaaccgcuucgaguccuccgaggagcaggcccgcgccguccagauguccaccaagguccucauccaguuccuccagaagaaggccaagaaccucgacgccaucaccacccccgaccccaccaccaacgccucccuccucaccaagcuccaggcccagaaccaguggcuccaggacaugaccacccaccucauccuccgcuccuucaaggaguuccuccaguccucccuccgcgcccuccgccagauguga

SEQ ID NO: 382 - RNA, 1281 nt, Artificial Sequence
  derived and/or modified CDS sequence (opt2) from Homo sapiens__NP_002183.1__HsINHBA
augccccuccucuggcuccgcggcuuccuccucgccuccugcuggaucaucguccgcuccucccccacccccggcuccgagggccacuccgccgcccccgacugccccuccugcgcccucgccgcccuccccaaggacguccccaacucccagcccgagauggucgaggccgucaagaagcacauccucaacaugcuccaccucaagaagcgccccgacgucacccagcccguccccaaggccgcccuccucaacgccauccgcaagcuccacgucggcaaggucggcgagaacggcuacgucgagaucgaggacgacaucggccgccgcgccgagaugaacgagcucauggagcagaccuccgagaucaucaccuucgccgaguccggcaccgcccgcaagacccuccacuucgagaucuccaaggagggcuccgaccucuccgucgucgagcgcgccgaggucuggcucuuccucaagguccccaaggccaaccgcacccgcaccaaggucaccauccgccucuuccagcagcagaagcacccccagggcucccucgacaccggcgaggaggccgaggaggucggccucaagggcgagcgcuccgagcuccuccucuccgagaaggucgucgacgcccgcaaguccaccuggcacgucuuccccgucuccuccuccauccagcgccuccucgaccagggcaaguccucccucgacguccgcaucgccugcgagcagugccaggaguccggcgccucccucguccuccucggcaagaagaagaagaaggaggaggagggcgagggcaagaagaagggcggcggcgagggcggcgccggcgccgacgaggagaaggagcagucccaccgccccuuccucaugcuccaggcccgccaguccgaggaccacccccaccgccgccgccgccgcggccucgagugcgacggcaaggucaacaucugcugcaagaagcaguucuucgucuccuucaaggacaucggcuggaacgacuggaucaucgcccccuccggcuaccacgccaacuacugcgagggcgagugccccucccacaucgccggcaccuccggcuccucccucuccuuccacuccaccgucaucaaccacuaccgcaugcgcggccacucccccuucgccaaccucaaguccugcugcguccccaccaagcuccgccccauguccaugcucuacuacgacgacggccagaacaucaucaagaaggacauccagaacaugaucgucgaggagugcggcugcuccuga

SEQ ID NO: 383 - RNA, 1224 nt, Artificial Sequence
  derived and/or modified CDS sequence (opt2) from Homo sapiens__NP_002184.2__HsINHBB
auggacggccuccccggccgcgcccucggcgccgccugccuccuccuccucgccgccggcuggcucggccccgaggccuggggcucccccacccccccccccacccccgccgcccccccccccccccccccccccggcucccccggcggcucccaggacaccugcaccuccugcggcggcuuccgccgccccgaggagcucggccgcgucgacggcgacuuccucgaggccgucaagcgccacauccucucccgccuccagaugcgcggccgccccaacaucacccacgccguccccaaggccgccauggucaccgcccuccgcaagcuccacgccggcaagguccgcgaggacggccgcgucgagaucccccaccucgacggccacgccucccccggcgccgacggccaggagcgcgucuccgagaucaucuccuucgccgagaccgacggccucgccuccucccgcguccgccucuacuucuucaucuccaacgagggcaaccagaaccucuucgucguccaggccucccucuggcucuaccucaagcuccuccccuacguccucgagaagggcucccgccgcaagguccgcgucaaggucuacuuccaggagcagggccacggcgaccgcuggaacauggucgagaagcgcgucgaccucaagcgcuccggcuggcacaccuucccccucaccgaggccauccaggcccucuucgagcgcggcgagcgccgccucaaccucgacguccagugcgacuccugccaggagcucgccgucguccccgucuucgucgaccccggcgaggagucccaccgccccuucgucgucguccaggcccgccucggcgacucccgccaccgcauccgcaagcgcggccucgagugcgacggccgcaccaaccucugcugccgccagcaguucuucaucgacuuccgccucaucggcuggaacgacuggaucaucgcccccaccggcuacuacggcaacuacugcgagggcuccugccccgccuaccucgccggcguccccggcuccgccuccuccuuccacaccgccgucgucaaccaguaccgcaugcgcggccucaaccccggcaccgucaacuccugcugcauccccaccaagcucuccaccauguccaugcucuacuucgacgacgaguacaacaucgucaagcgcgacguccccaacaugaucgucgaggagugcggcugcgccuga

SEQ ID NO: 384 - RNA, 3459 nt, Artificial Sequence
  derived and/or modified CDS sequence (opt2) from Homo sapiens__NP_000623.2__HsITGAM
auggcccuccgcguccuccuccucaccgcccucacccucugccacggcuucaaccucgacaccgagaacgccaugaccuuccaggagaacgcccgcggcuucggccaguccgucguccagcuccagggcucccgcgucgucgucggcgccccccaggagaucgucgccgccaaccagcgcggcucccucuaccagugcgacuacuccaccggcuccugcgagcccauccgccuccagguccccgucgaggccgucaacaugucccucggccucucccucgccgccaccaccucccccccccagcuccucgccugcggccccaccguccaccagaccugcuccgagaacaccuacgucaagggccucugcuuccucuucggcuccaaccuccgccagcagccccagaaguuccccgaggcccuccgcggcugcccccaggaggacuccgacaucgccuuccucaucgacggcuccggcuccaucaucccccacgacuuccgccgcaugaaggaguucgucuccaccgucauggagcagcucaagaaguccaagacccucuucucccucaugcaguacuccgaggaguuccgcauccacuucaccuucaaggaguuccagaacaaccccaacccccgcucccucgucaagcccaucacccagcuccucggccgcacccacaccgccaccggcauccgcaaggucguccgcgagcucuucaacaucaccaacggcgcccgcaagaacgccuucaagauccucgucgucaucaccgacggcgagaaguucggcgacccccucggcuacgaggacgucauccccgaggccgaccgcgagggcgucauccgcuacgucaucggcgucggcgacgccuuccgcuccgagaagucccgccaggagcucaacaccaucgccuccaagcccccccgcgaccacgucuuccaggucaacaacuucgaggcccucaagaccauccagaaccagcuccgcgagaagaucuucgccaucgagggcacccagaccggcuccuccuccuccuucgagcacgagaugucccaggagggcuucuccgccgccaucaccuccaacggcccccuccucuccaccgucggcuccuacgacugggccggcggcgucuuccucuacaccuccaaggagaaguccaccuucaucaacaugacccgcgucgacuccgacaugaacgacgccuaccucggcuacgccgccgccaucauccuccgcaaccgcguccagucccucguccucggcgccccccgcuaccagcacaucggccucgucgccauguuccgccagaacaccggcaugugggaguccaacgccaacgucaagggcacccagaucggcgccuacuucggcgccucccucugcuccgucgacgucgacuccaacggcuccaccgaccucguccucaucggcgccccccacuacuacgagcagacccgcggcggccaggucuccgucugcccccucccccgcggccgcgcccgcuggcagugcgacgccguccucuacggcgagcagggccagcccuggggccgcuucggcgccgcccucaccguccucggcgacgucaacggcgacaagcucaccgacgucgccaucggcgcccccggcgaggaggacaaccgcggcgccgucuaccucuuccacggcaccuccggcuccggcaucucccccucccacucccagcgcaucgccggcuccaagcucuccccccgccuccaguacuucggccagucccucuccggcggccaggaccucaccauggacggccucgucgaccucaccgucggcgcccagggccacguccuccuccuccgcucccagcccguccuccgcgucaaggccaucauggaguucaacccccgcgaggucgcccgcaacgucuucgagugcaacgaccaggucgucaagggcaaggaggccggcgagguccgcgucugccuccacguccagaaguccacccgcgaccgccuccgcgagggccagauccaguccgucgucaccuacgaccucgcccucgacuccggccgcccccacucccgcgccgucuucaacgagaccaagaacuccacccgccgccagacccagguccucggccucacccagaccugcgagacccucaagcuccagcuccccaacugcaucgaggaccccgucucccccaucguccuccgccucaacuucucccucgucggcaccccccucuccgccuucggcaaccuccgccccguccucgccgaggacgcccagcgccucuucaccgcccucuuccccuucgagaagaacugcggcaacgacaacaucugccaggacgaccucuccaucaccuucuccuucaugucccucgacugccucgucgucggcggcccccgcgaguucaacgucaccgucaccguccgcaacgacggcgaggacuccuaccgcacccaggucaccuucuucuucccccucgaccucuccuaccgcaaggucuccacccuccagaaccagcgcucccagcgcuccuggcgccucgccugcgaguccgccuccuccaccgaggucuccggcgcccucaaguccaccuccugcuccaucaaccaccccaucuuccccgagaacuccgaggucaccuucaacaucaccuucgacgucgacuccaaggccucccucggcaacaagcuccuccucaaggccaacgucaccuccgagaacaacaugccccgcaccaacaagaccgaguuccagcucgagcuccccgucaaguacgccgucuacauggucgucaccucccacggcgucuccaccaaguaccucaacuucaccgccuccgagaacaccucccgcgucaugcagcaccaguaccaggucuccaaccucggccagcgcucccuccccaucucccucgucuuccucguccccguccgccucaaccagaccgucaucugggaccgcccccaggucaccuucuccgagaaccucuccuccaccugccacaccaaggagcgccuccccucccacuccgacuuccucgccgagcuccgcaaggcccccgucgucaacugcuccaucgccgucugccagcgcauccagugcgacauccccuucuucggcauccaggaggaguucaacgccacccucaagggcaaccucuccuucgacugguacaucaagaccucccacaaccaccuccucaucgucuccaccgccgagauccucuucaacgacuccgucuucacccuccuccccggccagggcgccuucguccgcucccagaccgagaccaaggucgagcccuucgagguccccaacccccucccccucaucgucggcuccuccgucggcggccuccuccuccucgcccucaucaccgccgcccucuacaagcucggcuucuucaagcgccaguacaaggacaugauguccgagggcggcccccccggcgccgagccccaguga

SEQ ID NO: 385 - RNA, 1404 nt, Artificial Sequence
  derived and/or modified CDS sequence (opt2) from Homo sapiens__NP_002415.1__HsMMP8
auguucucccucaagacccuccccuuccuccuccuccuccacguccagaucuccaaggccuuccccgucuccuccaaggagaagaacaccaagaccguccaggacuaccucgagaaguucuaccagcuccccuccaaccaguaccaguccacccgcaagaacggcaccaacgucaucgucgagaagcucaaggagaugcagcgcuucuucggccucaacgucaccggcaagcccaacgaggagacccucgacaugaugaagaagccccgcugcggcguccccgacuccggcggcuucaugcucacccccggcaaccccaagugggagcgcaccaaccucaccuaccgcauccgcaacuacaccccccagcucuccgaggccgaggucgagcgcgccaucaaggacgccuucgagcucugguccgucgccuccccccucaucuucacccgcaucucccagggcgaggccgacaucaacaucgccuucuaccagcgcgaccacggcgacaacucccccuucgacggccccaacggcauccucgcccacgccuuccagcccggccagggcaucggcggcgacgcccacuucgacgccgaggagaccuggaccaacaccuccgccaacuacaaccucuuccucgucgccgcccacgaguucggccacucccucggccucgcccacuccuccgaccccggcgcccucauguaccccaacuacgccuuccgcgagaccuccaacuacucccucccccaggacgacaucgacggcauccaggccaucuacggccucuccuccaaccccauccagcccaccggccccuccacccccaagcccugcgaccccucccucaccuucgacgccaucaccacccuccgcggcgagauccucuucuucaaggaccgcuacuucuggcgccgccacccccagcuccagcgcgucgagaugaacuucaucucccucuucuggcccucccuccccaccggcauccaggccgccuacgaggacuucgaccgcgaccucaucuuccucuucaagggcaaccaguacugggcccucuccggcuacgacauccuccagggcuaccccaaggacaucuccaacuacggcuuccccuccuccguccaggccaucgacgccgccgucuucuaccgcuccaagaccuacuucuucgucaacgaccaguucuggcgcuacgacaaccagcgccaguucauggagcccggcuaccccaaguccaucuccggcgccuuccccggcaucgaguccaaggucgacgccgucuuccagcaggagcacuucuuccacgucuucuccggcccccgcuacuacgccuucgaccucaucgcccagcgcgucacccgcgucgcccgcggcaacaaguggcucaacugccgcuacggcuga

SEQ ID NO: 386 - RNA, 2124 nt, Artificial Sequence
  derived and/or modified CDS sequence (opt2) from Homo sapiens__NP_004985.2__HsMMP9
augucccucuggcagccccucguccucguccuccucguccucggcugcugcuucgccgccccccgccagcgccaguccacccucguccucuuccccggcgaccuccgcaccaaccucaccgaccgccagcucgccgaggaguaccucuaccgcuacggcuacacccgcgucgccgagaugcgcggcgaguccaagucccucggccccgcccuccuccuccuccagaagcagcucucccuccccgagaccggcgagcucgacuccgccacccucaaggccaugcgcaccccccgcugcggcguccccgaccucggccgcuuccagaccuucgagggcgaccucaaguggcaccaccacaacaucaccuacuggauccagaacuacuccgaggaccucccccgcgccgucaucgacgacgccuucgcccgcgccuucgcccucugguccgccgucaccccccucaccuucacccgcgucuacucccgcgacgccgacaucgucauccaguucggcgucgccgagcacggcgacggcuaccccuucgacggcaaggacggccuccucgcccacgccuucccccccggccccggcauccagggcgacgcccacuucgacgacgacgagcucuggucccucggcaagggcgucgucguccccacccgcuucggcaacgccgacggcgccgccugccacuuccccuucaucuucgagggccgcuccuacuccgccugcaccaccgacggccgcuccgacggccuccccuggugcuccaccaccgccaacuacgacaccgacgaccgcuucggcuucugccccuccgagcgccucuacacccaggacggcaacgccgacggcaagcccugccaguuccccuucaucuuccagggccaguccuacuccgccugcaccaccgacggccgcuccgacggcuaccgcuggugcgccaccaccgccaacuacgaccgcgacaagcucuucggcuucugccccacccgcgccgacuccaccgucaugggcggcaacuccgccggcgagcucugcgucuuccccuucaccuuccucggcaaggaguacuccaccugcaccuccgagggccgcggcgacggccgccucuggugcgccaccaccuccaacuucgacuccgacaagaaguggggcuucugccccgaccagggcuacucccucuuccucgucgccgcccacgaguucggccacgcccucggccucgaccacuccuccguccccgaggcccucauguaccccauguaccgcuucaccgagggccccccccuccacaaggacgacgucaacggcauccgccaccucuacggcccccgccccgagcccgagccccgcccccccaccaccaccaccccccagcccaccgccccccccaccgucugccccaccggcccccccaccguccaccccuccgagcgccccaccgccggccccaccggcccccccuccgccggccccaccggcccccccaccgccggccccuccaccgccaccaccgucccccucucccccgucgacgacgccugcaacgucaacaucuucgacgccaucgccgagaucggcaaccagcucuaccucuucaaggacggcaaguacuggcgcuucuccgagggccgcggcucccgcccccagggccccuuccucaucgccgacaaguggcccgcccucccccgcaagcucgacuccgucuucgaggagcgccucuccaagaagcucuucuucuucuccggccgccaggucugggucuacaccggcgccuccguccucggcccccgccgccucgacaagcucggccucggcgccgacgucgcccaggucaccggcgcccuccgcuccggccgcggcaagaugcuccucuucuccggccgccgccucuggcgcuucgacgucaaggcccagauggucgacccccgcuccgccuccgaggucgaccgcauguuccccggcgucccccucgacacccacgacgucuuccaguaccgcgagaaggccuacuucugccaggaccgcuucuacuggcgcgucuccucccgcuccgagcucaaccaggucgaccaggucggcuacgucaccuacgacauccuccagugccccgaggacuga

SEQ ID NO: 387 - RNA, 1416 nt, Artificial Sequence
  derived and/or modified CDS sequence (opt2) from Homo sapiens__NP_002418.1__HsMMP13
augcaccccggcguccucgccgccuuccucuuccucuccuggacccacugccgcgcccucccccuccccuccggcggcgacgaggacgaccucuccgaggaggaccuccaguucgccgagcgcuaccuccgcuccuacuaccaccccaccaaccucgccggcauccucaaggagaacgccgccuccuccaugaccgagcgccuccgcgagaugcaguccuucuucggccucgaggucaccggcaagcucgacgacaacacccucgacgucaugaagaagccccgcugcggcguccccgacgucggcgaguacaacgucuucccccgcacccucaagugguccaagaugaaccucaccuaccgcaucgucaacuacacccccgacaugacccacuccgaggucgagaaggccuucaagaaggccuucaaggucugguccgacgucaccccccucaacuucacccgccuccacgacggcaucgccgacaucaugaucuccuucggcaucaaggagcacggcgacuucuaccccuucgacggccccuccggccuccucgcccacgccuucccccccggccccaacuacggcggcgacgcccacuucgacgacgacgagaccuggaccuccuccuccaagggcuacaaccucuuccucgucgccgcccacgaguucggccacucccucggccucgaccacuccaaggaccccggcgcccucauguuccccaucuacaccuacaccggcaagucccacuucaugcuccccgacgacgacguccagggcauccagucccucuacggccccggcgacgaggaccccaaccccaagcaccccaagacccccgacaagugcgaccccucccucucccucgacgccaucaccucccuccgcggcgagaccaugaucuucaaggaccgcuucuucuggcgccuccacccccagcaggucgacgccgagcucuuccucaccaaguccuucuggcccgagcuccccaaccgcaucgacgccgccuacgagcaccccucccacgaccucaucuucaucuuccgcggccgcaaguucugggcccucaacggcuacgacauccucgagggcuaccccaagaagaucuccgagcucggccuccccaaggaggucaagaagaucuccgccgccguccacuucgaggacaccggcaagacccuccucuucuccggcaaccaggucuggcgcuacgacgacaccaaccacaucauggacaaggacuacccccgccucaucgaggaggacuuccccggcaucggcgacaaggucgacgccgucuacgagaagaacggcuacaucuacuucuucaacggccccauccaguucgaguacuccaucugguccaaccgcaucguccgcgucaugcccgccaacuccauccucuggugcuga

SEQ ID NO: 388 - RNA, 1068 nt, Artificial Sequence
  derived and/or modified CDS sequence (opt2) from Homo sapiens__NP_001286.1__HsCCR1
auggagacccccaacaccaccgaggacuacgacaccaccaccgaguucgacuacggcgacgccacccccugccagaaggucaacgagcgcgccuucggcgcccagcuccuccccccccucuacucccucgucuucgucaucggccucgucggcaacauccucgucguccucguccucguccaguacaagcgccucaagaacaugaccuccaucuaccuccucaaccucgccaucuccgaccuccucuuccucuucacccuccccuucuggaucgacuacaagcucaaggacgacugggucuucggcgacgccaugugcaagauccucuccggcuucuacuacaccggccucuacuccgagaucuucuucaucauccuccucaccaucgaccgcuaccucgccaucguccacgccgucuucgcccuccgcgcccgcaccgucaccuucggcgucaucaccuccaucaucaucugggcccucgccauccucgccuccaugcccggccucuacuucuccaagacccagugggaguucacccaccacaccugcucccuccacuucccccacgagucccuccgcgaguggaagcucuuccaggcccucaagcucaaccucuucggccucguccucccccuccucgucaugaucaucugcuacaccggcaucaucaagauccuccuccgccgccccaacgagaagaaguccaaggccguccgccucaucuucgucaucaugaucaucuucuuccucuucuggacccccuacaaccucaccauccucaucuccgucuuccaggacuuccucuucacccacgagugcgagcagucccgccaccucgaccucgccguccaggucaccgaggucaucgccuacacccacugcugcgucaaccccgucaucuacgccuucgucggcgagcgcuuccgcaaguaccuccgccagcucuuccaccgccgcgucgccguccaccucgucaaguggcuccccuuccucuccgucgaccgccucgagcgcgucuccuccaccucccccuccaccggcgagcacgagcucuccgccggcuucuga

SEQ ID NO: 389 - RNA, 636 nt, Artificial Sequence
  derived and/or modified CDS sequence (opt2) from Homo sapiens__NP_002598.4__HsPDGFA
augcgcacccucgccugccuccuccuccucggcugcggcuaccucgcccacguccucgccgaggaggccgagaucccccgcgaggucaucgagcgccucgcccgcucccagauccacuccauccgcgaccuccagcgccuccucgagaucgacuccgucggcuccgaggacucccucgacaccucccuccgcgcccacggcguccacgccaccaagcacguccccgagaagcgcccccuccccauccgccgcaagcgcuccaucgaggaggccguccccgccgucugcaagacccgcaccgucaucuacgagaucccccgcucccaggucgaccccaccuccgccaacuuccucaucuggccccccugcgucgaggucaagcgcugcaccggcugcugcaacaccuccuccgucaagugccagcccucccgcguccaccaccgcuccgucaaggucgccaaggucgaguacguccgcaagaagcccaagcucaaggagguccagguccgccucgaggagcaccucgagugcgccugcgccaccaccucccucaaccccgacuaccgcgaggaggacaccggccgcccccgcgaguccggcaagaagcgcaagcgcaagcgccucaagcccaccuga

SEQ ID NO: 390 - RNA, 726 nt, Artificial Sequence
  derived and/or modified CDS sequence (opt2) from Homo sapiens__NP_002599.1__HsPDGFB
augaaccgcugcugggcccucuuccucucccucugcugcuaccuccgccucgucuccgccgagggcgaccccauccccgaggagcucuacgagaugcucuccgaccacuccauccgcuccuucgacgaccuccagcgccuccuccacggcgaccccggcgaggaggacggcgccgagcucgaccucaacaugacccgcucccacuccggcggcgagcucgagucccucgcccgcggccgccgcucccucggcucccucaccaucgccgagcccgccaugaucgccgagugcaagacccgcaccgaggucuucgagaucucccgccgccucaucgaccgcaccaacgccaacuuccucgucuggccccccugcgucgagguccagcgcugcuccggcugcugcaacaaccgcaacguccagugccgccccacccagguccagcuccgccccguccagguccgcaagaucgagaucguccgcaagaagcccaucuucaagaaggccaccgucacccucgaggaccaccucgccugcaagugcgagaccgucgccgccgcccgccccgucacccgcucccccggcggcucccaggagcagcgcgccaagaccccccagacccgcgucaccauccgcaccguccgcguccgccgcccccccaagggcaagcaccgcaaguucaagcacacccacgacaagaccgcccucaaggagacccucggcgccuga

SEQ ID NO: 391 - RNA, 1038 nt, Artificial Sequence
  derived and/or modified CDS sequence (opt2) from Homo sapiens__NP_057289.1__HsPDGFC
augucccucuucggccuccuccuccucaccuccgcccucgccggccagcgccagggcacccaggccgaguccaaccucuccuccaaguuccaguucuccuccaacaaggagcagaacggcguccaggacccccagcacgagcgcaucaucaccgucuccaccaacggcuccauccacuccccccgcuucccccacaccuacccccgcaacaccguccucgucuggcgccucgucgccgucgaggagaacgucuggauccagcucaccuucgacgagcgcuucggccucgaggaccccgaggacgacaucugcaaguacgacuucgucgaggucgaggagcccuccgacggcaccauccucggccgcuggugcggcuccggcaccguccccggcaagcagaucuccaagggcaaccagauccgcauccgcuucgucuccgacgaguacuuccccuccgagcccggcuucugcauccacuacaacaucgucaugccccaguucaccgaggccgucucccccuccguccucccccccuccgcccucccccucgaccuccucaacaacgccaucaccgccuucuccacccucgaggaccucauccgcuaccucgagcccgagcgcuggcagcucgaccucgaggaccucuaccgccccaccuggcagcuccucggcaaggccuucgucuucggccgcaagucccgcgucgucgaccucaaccuccucaccgaggagguccgccucuacuccugcaccccccgcaacuucuccgucuccauccgcgaggagcucaagcgcaccgacaccaucuucuggcccggcugccuccucgucaagcgcugcggcggcaacugcgccugcugccuccacaacugcaacgagugccagugcguccccuccaaggucaccaagaaguaccacgagguccuccagcuccgccccaagaccggcguccgcggccuccacaagucccucaccgacgucgcccucgagcaccacgaggagugcgacugcgucugccgcggcuccaccggcggcuga

SEQ ID NO: 392 - RNA, 1095 nt, Artificial Sequence
  derived and/or modified CDS sequence (opt2) from Homo sapiens__NP_149126.1__HsPDGFD
augcaccgccucaucuucgucuacacccucaucugcgccaacuucugcuccugccgcgacaccuccgccaccccccaguccgccuccaucaaggcccuccgcaacgccaaccuccgccgcgacgaccucuaccgccgcgacgagaccauccaggucaagggcaacggcuacguccaguccccccgcuuccccaacuccuacccccgcaaccuccuccucaccuggcgccuccacucccaggagaacacccgcauccagcucgucuucgacaaccaguucggccucgaggaggccgagaacgacaucugccgcuacgacuucgucgaggucgaggacaucuccgagaccuccaccaucauccgcggccgcuggugcggccacaaggagguccccccccgcaucaagucccgcaccaaccagaucaagaucaccuucaaguccgacgacuacuucgucgccaagcccggcuucaagaucuacuacucccuccucgaggacuuccagcccgccgccgccuccgagaccaacugggaguccgucaccuccuccaucuccggcgucuccuacaacucccccuccgucaccgaccccacccucaucgccgacgcccucgacaagaagaucgccgaguucgacaccgucgaggaccuccucaaguacuucaaccccgaguccuggcaggaggaccucgagaacauguaccucgacaccccccgcuaccgcggccgcuccuaccacgaccgcaaguccaaggucgaccucgaccgccucaacgacgacgccaagcgcuacuccugcaccccccgcaacuacuccgucaacauccgcgaggagcucaagcucgccaacgucgucuucuucccccgcugccuccucguccagcgcugcggcggcaacugcggcugcggcaccgucaacuggcgcuccugcaccugcaacuccggcaagaccgucaagaaguaccacgagguccuccaguucgagcccggccacaucaagcgccgcggccgcgccaagaccauggcccucgucgacauccagcucgaccaccacgagcgcugcgacugcaucugcuccucccgccccccccgcuga

SEQ ID NO: 393 - RNA, 678 nt, Artificial Sequence
  derived and/or modified CDS sequence (opt2) from Homo sapiens__NP_003946.3__HsSOCS3
auggucacccacuccaaguuccccgccgccggcaugucccgcccccucgacaccucccuccgccucaagaccuucuccuccaaguccgaguaccagcucgucgucaacgccguccgcaagcuccaggaguccggcuucuacugguccgccgucaccggcggcgaggccaaccuccuccucuccgccgagcccgccggcaccuuccucauccgcgacuccuccgaccagcgccacuucuucacccucuccgucaagacccaguccggcaccaagaaccuccgcauccagugcgagggcggcuccuucucccuccaguccgacccccgcuccacccagcccgucccccgcuucgacugcguccucaagcucguccaccacuacaugcccccccccggcgcccccuccuuccccuccccccccaccgagcccuccuccgagguccccgagcagcccuccgcccagccccuccccggcucccccccccgccgcgccuacuacaucuacuccggcggcgagaagaucccccucguccucucccgcccccucuccuccaacgucgccacccuccagcaccucugccgcaagaccgucaacggccaccucgacuccuacgagaaggucacccagcuccccggccccauccgcgaguuccucgaccaguacgacgccccccucuga

SEQ ID NO: 394 - RNA, 483 nt, Artificial Sequence
  derived and/or modified CDS sequence (opt2) from Homo sapiens__NP_003227.1__HsTGFA
augguccccuccgccggccagcucgcccucuucgcccucggcaucguccucgccgccugccaggcccucgagaacuccaccuccccccucuccgccgacccccccgucgccgccgccgucgucucccacuucaacgacugccccgacucccacacccaguucugcuuccacggcaccugccgcuuccucguccaggaggacaagcccgccugcgucugccacuccggcuacgucggcgcccgcugcgagcacgccgaccuccucgccgucgucgccgccucccagaagaagcaggccaucaccgcccucgucgucgucuccaucgucgcccucgccguccucaucaucaccugcguccucauccacugcugccagguccgcaagcacugcgaguggugccgcgcccucaucugccgccacgagaagcccuccgcccuccucaagggccgcaccgccugcugccacuccgagaccgucgucuga

SEQ ID NO: 395 - RNA, 1173 nt, Artificial Sequence
  derived and/or modified CDS sequence (opt2) from Homo sapiens__NP_000651.3__HsTGFB1
augccccccuccggccuccgccuccucccccuccuccucccccuccucuggcuccucguccucacccccggccgccccgccgccggccucuccaccugcaagaccaucgacauggagcucgucaagcgcaagcgcaucgaggccauccgcggccagauccucuccaagcuccgccucgccuccccccccucccagggcgaggucccccccggcccccuccccgaggccguccucgcccucuacaacuccacccgcgaccgcgucgccggcgaguccgccgagcccgagcccgagcccgaggccgacuacuacgccaaggaggucacccgcguccucauggucgagacccacaacgagaucuacgacaaguucaagcaguccacccacuccaucuacauguucuucaacaccuccgagcuccgcgaggccguccccgagcccguccuccucucccgcgccgagcuccgccuccuccgccucaagcucaaggucgagcagcacgucgagcucuaccagaaguacuccaacaacuccuggcgcuaccucuccaaccgccuccucgcccccuccgacucccccgaguggcucuccuucgacgucaccggcgucguccgccaguggcucucccgcggcggcgagaucgagggcuuccgccucuccgcccacugcuccugcgacucccgcgacaacacccuccaggucgacaucaacggcuucaccaccggccgccgcggcgaccucgccaccauccacggcaugaaccgccccuuccuccuccucauggccaccccccucgagcgcgcccagcaccuccaguccucccgccaccgccgcgcccucgacaccaacuacugcuucuccuccaccgagaagaacugcugcguccgccagcucuacaucgacuuccgcaaggaccucggcuggaaguggauccacgagcccaagggcuaccacgccaacuucugccucggccccugccccuacaucuggucccucgacacccaguacuccaagguccucgcccucuacaaccagcacaaccccggcgccuccgccgcccccugcugcgucccccaggcccucgagccccuccccaucgucuacuacgucggccgcaagcccaaggucgagcagcucuccaacaugaucguccgcuccugcaagugcuccuga

SEQ ID NO: 396 - RNA, 1245 nt, Artificial Sequence
  derived and/or modified CDS sequence (opt2) from Homo sapiens__NP_003229.1__HsTGFB2
augcacuacugcguccucuccgccuuccucauccuccaccucgucaccgucgcccucucccucuccaccugcuccacccucgacauggaccaguucaugcgcaagcgcaucgaggccauccgcggccagauccucuccaagcucaagcucaccuccccccccgaggacuaccccgagcccgaggaggucccccccgaggucaucuccaucuacaacuccacccgcgaccuccuccaggagaaggccucccgccgcgccgccgccugcgagcgcgagcgcuccgacgaggaguacuacgccaaggaggucuacaagaucgacaugccccccuucuuccccuccgagaacgccaucccccccaccuucuaccgccccuacuuccgcaucguccgcuucgacgucuccgccauggagaagaacgccuccaaccucgucaaggccgaguuccgcgucuuccgccuccagaaccccaaggcccgcguccccgagcagcgcaucgagcucuaccagauccucaaguccaaggaccucaccucccccacccagcgcuacaucgacuccaaggucgucaagacccgcgccgagggcgaguggcucuccuucgacgucaccgacgccguccacgaguggcuccaccacaaggaccgcaaccucggcuucaagaucucccuccacugccccugcugcaccuucguccccuccaacaacuacaucauccccaacaaguccgaggagcucgaggcccgcuucgccggcaucgacggcaccuccaccuacaccuccggcgaccagaagaccaucaaguccacccgcaagaagaacuccggcaagaccccccaccuccuccucaugcuccuccccuccuaccgccucgagucccagcagaccaaccgccgcaagaagcgcgcccucgacgccgccuacugcuuccgcaacguccaggacaacugcugccuccgcccccucuacaucgacuucaagcgcgaccucggcuggaaguggauccacgagcccaagggcuacaacgccaacuucugcgccggcgccugccccuaccucugguccuccgacacccagcacucccgcguccucucccucuacaacaccaucaaccccgaggccuccgccucccccugcugcgucucccaggaccucgagccccucaccauccucuacuacaucggcaagacccccaagaucgagcagcucuccaacaugaucgucaaguccugcaagugcuccuga

SEQ ID NO: 397 - RNA, 1239 nt, Artificial Sequence
  derived and/or modified CDS sequence (opt2) from Homo sapiens__NP_003230.1__HsTGFB3
augaagaugcaccuccagcgcgcccucgucguccucgcccuccucaacuucgccaccgucucccucucccucuccaccugcaccacccucgacuucggccacaucaagaagaagcgcgucgaggccauccgcggccagauccucuccaagcuccgccucaccuccccccccgagcccaccgucaugacccacguccccuaccagguccucgcccucuacaacuccacccgcgagcuccucgaggagaugcacggcgagcgcgaggagggcugcacccaggagaacaccgaguccgaguacuacgccaaggagauccacaaguucgacaugauccagggccucgccgagcacaacgagcucgccgucugccccaagggcaucaccuccaaggucuuccgcuucaacgucuccuccgucgagaagaaccgcaccaaccucuuccgcgccgaguuccgcguccuccgcguccccaaccccuccuccaagcgcaacgagcagcgcaucgagcucuuccagauccuccgccccgacgagcacaucgccaagcagcgcuacaucggcggcaagaaccuccccacccgcggcaccgccgaguggcucuccuucgacgucaccgacaccguccgcgaguggcuccuccgccgcgaguccaaccucggccucgagaucuccauccacugccccugccacaccuuccagcccaacggcgacauccucgagaacauccacgaggucauggagaucaaguucaagggcgucgacaacgaggacgaccacggccgcggcgaccucggccgccucaagaagcagaaggaccaccacaacccccaccucauccucaugaugauccccccccaccgccucgacaaccccggccagggcggccagcgcaagaagcgcgcccucgacaccaacuacugcuuccgcaaccucgaggagaacugcugcguccgcccccucuacaucgacuuccgccaggaccucggcuggaaguggguccacgagcccaagggcuacuacgccaacuucugcuccggccccugccccuaccuccgcuccgccgacaccacccacuccaccguccucggccucuacaacacccucaaccccgaggccuccgccucccccugcugcgucccccaggaccucgagccccucaccauccucuacuacgucggccgcacccccaaggucgagcagcucuccaacauggucgucaaguccugcaagugcuccuga

SEQ ID NO: 398 - RNA, 1386 nt, Artificial Sequence
  derived and/or modified CDS sequence (opt2) from Homo sapiens__NP_001057.1__HsTNFRSF1B
auggcccccgucgccgucugggccgcccucgccgucggccucgagcucugggccgccgcccacgcccuccccgcccaggucgccuucacccccuacgcccccgagcccggcuccaccugccgccuccgcgaguacuacgaccagaccgcccagaugugcugcuccaagugcucccccggccagcacgccaaggucuucugcaccaagaccuccgacaccgucugcgacuccugcgaggacuccaccuacacccagcucuggaacuggguccccgagugccucuccugcggcucccgcugcuccuccgaccaggucgagacccaggccugcacccgcgagcagaaccgcaucugcaccugccgccccggcugguacugcgcccucuccaagcaggagggcugccgccucugcgccccccuccgcaagugccgccccggcuucggcgucgcccgccccggcaccgagaccuccgacgucgucugcaagcccugcgcccccggcaccuucuccaacaccaccuccuccaccgacaucugccgcccccaccagaucugcaacgucgucgccauccccggcaacgccuccauggacgccgucugcaccuccaccucccccacccgcuccauggcccccggcgccguccaccucccccagcccgucuccacccgcucccagcacacccagcccacccccgagcccuccaccgcccccuccaccuccuuccuccuccccaugggccccuccccccccgccgagggcuccaccggcgacuucgcccuccccgucggccucaucgucggcgucaccgcccucggccuccucaucaucggcgucgucaacugcgucaucaugacccaggucaagaagaagccccucugccuccagcgcgaggccaaggucccccaccuccccgccgacaaggcccgcggcacccagggccccgagcagcagcaccuccucaucaccgcccccuccuccuccuccuccucccucgaguccuccgccuccgcccucgaccgccgcgcccccacccgcaaccagccccaggcccccggcgucgaggccuccggcgccggcgaggcccgcgccuccaccggcuccuccgacuccucccccggcggccacggcacccaggucaacgucaccugcaucgucaacgucugcuccuccuccgaccacuccucccagugcuccucccaggccuccuccaccaugggcgacaccgacuccucccccuccgagucccccaaggacgagcagguccccuucuccaaggaggagugcgccuuccgcucccagcucgagacccccgagacccuccucggcuccaccgaggagaagccccucccccucggcguccccgacgccggcaugaagcccuccuga

SEQ ID NO: 399 - RNA, 513 nt, Artificial Sequence
  derived and/or modified CDS sequence (opt2) from Homo sapiens__NP_002623.2__HsPGF
augcccgucaugcgccucuuccccugcuuccuccagcuccucgccggccucgcccuccccgccguccccccccagcagugggcccucuccgccggcaacggcuccuccgaggucgaggucguccccuuccaggaggucuggggccgcuccuacugccgcgcccucgagcgccucgucgacgucgucuccgaguaccccuccgaggucgagcacauguucucccccuccugcgucucccuccuccgcugcaccggcugcugcggcgacgagaaccuccacugcguccccgucgagaccgccaacgucaccaugcagcuccucaagauccgcuccggcgaccgccccuccuacgucgagcucaccuucucccagcacguccgcugcgagugccgcccccuccgcgagaagaugaagcccgagcgccgccgccccaagggccgcggcaagcgccgccgcgagaagcagcgccccaccgacugccaccucugcggcgacgccgucccccgccgcuga

SEQ ID NO: 400 - RNA, 1239 nt, Artificial Sequence
  derived and/or modified CDS sequence (opt2) from Homo sapiens__NP_001020537.2__HsVEGFA
augaccgaccgccagaccgacaccgcccccucccccuccuaccaccuccuccccggccgccgccgcaccgucgacgccgccgccucccgcggccagggccccgagcccgcccccggcggcggcgucgagggcgucggcgcccgcggcgucgcccucaagcucuucguccagcuccucggcugcucccgcuucggcggcgccgucguccgcgccggcgaggccgagcccuccggcgccgcccgcuccgccuccuccggccgcgaggagccccagcccgaggagggcgaggaggaggaggagaaggaggaggagcgcggcccccaguggcgccucggcgcccgcaagcccggcuccuggaccggcgaggccgccgucugcgccgacuccgcccccgccgcccgcgccccccaggcccucgcccgcgccuccggccgcggcggccgcgucgcccgccgcggcgccgaggaguccggccccccccacucccccucccgccgcggcuccgccucccgcgccggccccggccgcgccuccgagaccaugaacuuccuccucuccuggguccacuggucccucgcccuccuccucuaccuccaccacgccaaguggucccaggccgcccccauggccgagggcggcggccagaaccaccacgaggucgucaaguucauggacgucuaccagcgcuccuacugccaccccaucgagacccucgucgacaucuuccaggaguaccccgacgagaucgaguacaucuucaagcccuccugcgucccccucaugcgcugcggcggcugcugcaacgacgagggccucgagugcguccccaccgaggaguccaacaucaccaugcagaucaugcgcaucaagccccaccagggccagcacaucggcgagauguccuuccuccagcacaacaagugcgagugccgccccaagaaggaccgcgcccgccaggagaagaaguccguccgcggcaagggcaagggccagaagcgcaagcgcaagaagucccgcuacaaguccugguccgucuacgucggcgcccgcugcugccucaugcccuggucccuccccggcccccaccccugcggccccugcuccgagcgccgcaagcaccucuucguccaggacccccagaccugcaagugcuccugcaagaacaccgacucccgcugcaaggcccgccagcucgagcucaacgagcgcaccugccgcugcgacaagccccgccgcuga

SEQ ID NO: 401 - RNA, 699 nt, Artificial Sequence
  derived and/or modified CDS sequence (opt2) from Homo sapiens__NP_001165094.1__HsVEGFA
augaacuuccuccucuccuggguccacuggucccucgcccuccuccucuaccuccaccacgccaaguggucccaggccgcccccauggccgagggcggcggccagaaccaccacgaggucgucaaguucauggacgucuaccagcgcuccuacugccaccccaucgagacccucgucgacaucuuccaggaguaccccgacgagaucgaguacaucuucaagcccuccugcgucccccucaugcgcugcggcggcugcugcaacgacgagggccucgagugcguccccaccgaggaguccaacaucaccaugcagaucaugcgcaucaagccccaccagggccagcacaucggcgagauguccuuccuccagcacaacaagugcgagugccgccccaagaaggaccgcgcccgccaggagaagaaguccguccgcggcaagggcaagggccagaagcgcaagcgcaagaagucccgcuacaaguccugguccgucuacgucggcgcccgcugcugccucaugcccuggucccuccccggcccccaccccugcggccccugcuccgagcgccgcaagcaccucuucguccaggacccccagaccugcaagugcuccugcaagaacaccgacucccgcugcaaggcccgccagcucgagcucaacgagcgcaccugccgcugcgacaagccccgccgcuga

SEQ ID NO: 402 - RNA, 624 nt, Artificial Sequence
  derived and/or modified CDS sequence (opt2) from Homo sapiens__NP_003368.1__HsVEGFB
auguccccccuccuccgccgccuccuccucgccgcccuccuccagcucgcccccgcccaggcccccgucucccagcccgacgcccccggccaccagcgcaaggucgucuccuggaucgacgucuacacccgcgccaccugccagccccgcgaggucgucgucccccucaccgucgagcucaugggcaccgucgccaagcagcucguccccuccugcgucaccguccagcgcugcggcggcugcugccccgacgacggccucgagugcguccccaccggccagcaccagguccgcaugcagauccucaugauccgcuaccccuccucccagcucggcgagaugucccucgaggagcacucccagugcgagugccgccccaagaagaaggacuccgccgucaagcccgaccgcgccgccaccccccaccaccgcccccagccccgcuccguccccggcugggacuccgcccccggcgcccccucccccgccgacaucacccaccccacccccgcccccggccccuccgcccacgccgcccccuccaccaccuccgcccucacccccggccccgccgccgccgccgccgacgccgccgccuccuccgucgccaagggcggcgccuga

SEQ ID NO: 403 - RNA, 1260 nt, Artificial Sequence
  derived and/or modified CDS sequence (opt2) from Homo sapiens__NP_005420.1__HsVEGFC
augcaccuccucggcuucuucuccgucgccugcucccuccucgccgccgcccuccuccccggcccccgcgaggcccccgccgccgccgccgccuucgaguccggccucgaccucuccgacgccgagcccgacgccggcgaggccaccgccuacgccuccaaggaccucgaggagcagcuccgcuccgucuccuccgucgacgagcucaugaccguccucuaccccgaguacuggaagauguacaagugccagcuccgcaagggcggcuggcagcacaaccgcgagcaggccaaccucaacucccgcaccgaggagaccaucaaguucgccgccgcccacuacaacaccgagauccucaaguccaucgacaacgaguggcgcaagacccagugcaugccccgcgaggucugcaucgacgucggcaaggaguucggcgucgccaccaacaccuucuucaagccccccugcgucuccgucuaccgcugcggcggcugcugcaacuccgagggccuccagugcaugaacaccuccaccuccuaccucuccaagacccucuucgagaucaccgucccccucucccagggccccaagcccgucaccaucuccuucgccaaccacaccuccugccgcugcauguccaagcucgacgucuaccgccagguccacuccaucauccgccgcucccuccccgccacccucccccagugccaggccgccaacaagaccugccccaccaacuacauguggaacaaccacaucugccgcugccucgcccaggaggacuucauguucuccuccgacgccggcgacgacuccaccgacggcuuccacgacaucugcggccccaacaaggagcucgacgaggagaccugccagugcgucugccgcgccggccuccgccccgccuccugcggcccccacaaggagcucgaccgcaacuccugccagugcgucugcaagaacaagcucuuccccucccagugcggcgccaaccgcgaguucgacgagaacaccugccagugcgucugcaagcgcaccugcccccgcaaccagccccucaaccccggcaagugcgccugcgagugcaccgaguccccccagaagugccuccucaagggcaagaaguuccaccaccagaccugcuccugcuaccgccgccccugcaccaaccgccagaaggccugcgagcccggcuucuccuacuccgaggaggucugccgcugcguccccuccuacuggaagcgcccccagauguccuga

SEQ ID NO: 404 - RNA, 1065 nt, Artificial Sequence
  derived and/or modified CDS sequence (opt2) from Homo sapiens__NP_004460.1__HsVEGFD
auguaccgcgagugggucgucgucaacgucuucaugaugcucuacguccagcucguccagggcuccuccaacgagcacggccccgucaagcgcuccucccaguccacccucgagcgcuccgagcagcagauccgcgccgccuccucccucgaggagcuccuccgcaucacccacuccgaggacuggaagcucuggcgcugccgccuccgccucaaguccuucaccuccauggacucccgcuccgccucccaccgcuccacccgcuucgccgccaccuucuacgacaucgagacccucaaggucaucgacgaggaguggcagcgcacccagugcuccccccgcgagaccugcgucgaggucgccuccgagcucggcaaguccaccaacaccuucuucaagccccccugcgucaacgucuuccgcugcggcggcugcugcaacgaggagucccucaucugcaugaacaccuccaccuccuacaucuccaagcagcucuucgagaucuccgucccccucaccuccguccccgagcucguccccgucaaggucgccaaccacaccggcugcaagugccuccccaccgccccccgccaccccuacuccaucauccgccgcuccauccagauccccgaggaggaccgcugcucccacuccaagaagcucugccccaucgacaugcucugggacuccaacaagugcaagugcguccuccaggaggagaacccccucgccggcaccgaggaccacucccaccuccaggagcccgcccucugcggcccccacaugauguucgacgaggaccgcugcgagugcgucugcaagacccccugccccaaggaccucauccagcaccccaagaacugcuccugcuucgagugcaaggagucccucgagaccugcugccagaagcacaagcucuuccaccccgacaccugcuccugcgaggaccgcugccccuuccacacccgccccugcgccuccggcaagaccgccugcgccaagcacugccgcuuccccaaggagaagcgcgccgcccagggcccccacucccgcaagaaccccuga

SEQ ID NO: 405 - RNA, 72 nt, Artificial Sequence
  derived and/or modified CDS sequence (opt3) from Homo sapiens__AAA59606.1__signal peptide-HLA-A2-SP
auggccgugauggcucccagaacccugguccuccuucugagcggcgcauuggccuuaacacagacuugggcg

SEQ ID NO: 406 - RNA, 69 nt, Artificial Sequence
  derived and/or modified CDS sequence (opt3) from Homo sapiens__AAA61213.1__signal peptide-HsPLAT
auggacgccaugaagagaggccugugcugugugcuccuucugugcggggcugucuucguuagccccucc

SEQ ID NO: 407 - RNA, 81 nt, Artificial Sequence
  derived and/or modified CDS sequence (opt3) from Homo sapiens__NP_000790.2__signal peptide-HsEPO
augggcgugcacgagugccccgccuggcuguggcuccuucugagcuuguuaucccugccucuagggcucccaguccuggga

SEQ ID NO: 408 - RNA, 54 nt, Artificial Sequence
  derived and/or modified CDS sequence (opt3) from Homo sapiens__NP_000468.1__signal peptide-HsALB
augaagugggugaccuucaucagccugcucuuucuuuucuccucugccuacuca

SEQ ID NO: 409 - RNA, 18 nt, Artificial Sequence
  derived and/or modified CDS sequence (opt3) from Artificial____cleavage site-Furin
agaaggcggcgcaagcga

SEQ ID NO: 410 - RNA, 630 nt, Artificial Sequence
  derived and/or modified CDS sequence (opt3) from Homo sapiens__NP_061986.1__HsFGF21
auggacagcgaugagaccggcuucgaacacuccgggcugugggugucuguccucgccggacuucuguugggugcuugccaggcacaucccaucccugacucaaguccauuacugcaauuuggcgggcagguuagacagagguaccuauauacagaugacgcccagcaaacugaggcgcaccucgaaauucgggaggauggaacggugggcggugcugccgaccagagcccggaaucccugcuucagcugaaggcauugaaacccgggguaauacagauccucggagugaagaccucucgcuuccugugucaacgaccugauggcgcccuguacggcucgcuccauuuugacccagaggcuugcucauuccgugaguuacugcuugaagauggguauaacgucuaccagagcgaggcacacggauugccccugcaucuaccugguaauaaaaguccacacagagaccccgccccuaggggcccagcucgguuucucccgcugcccgggcuuccuccagcccugcccgaaccuccaggaauuuuggcgccccagccgccugaugugggcuccucugacccccucagcaugguugguccaucccaggggcgcucaccuaguuaugcaagcuga

SEQ ID NO: 411 - RNA, 1410 nt, Artificial Sequence
  derived and/or modified CDS sequence (opt3) from Homo sapiens__NP_002412.1__HsMMP1
augcacagcuuucccccucugcuccuucuguuguucuggggcguggucucccauucuuucccagccaccuuagagacacaggaacaagacguugaucuggugcagaaguaccuagagaaauauuacaaccucaagaaugacgggagacagguagagaaaaggcggaacucaggaccgguggucgaaaagcugaaacagaugcaagaauuuuucggucuuaaggugacuggcaagcccgaugcugagacgcugaaaguuaugaagcagccucgcugcggggugccagacgucgcacaguuuguguugaccgagggaaauccccgaugggaacagacacaccucacuuaucguaucgagaacuacaccccugaucugccaagagccgacguagaucaugcgauugaaaaggcuuuccaacuguggaguaauguuacaccccucaccuuuacuaaagugagcgagggccaggccgacauaaugaucuccuucgucaggggugaucaccgggacaacucuccuuuugaugggccaggaggcaauuuagcacaugccuuccagccgggccccgggauuggaggugacgcucacuuugaugaggacgaacgcuggacaaacaauuucagagaguauaaccugcacaggguggcagcccaugaacuuggccacucguuggggcugucacauagcaccgacaucggagcucuaauguacccuaguuauacguuuuccggcgaugugcagcucgcccaagacgauauugacgguauccaggcgauauacgggcggucucagaauccaguccaacccaucggaccucagacuccaaaagcaugugauagcaagcugaccuucgacgccauuacaacuauccgcggcgagguuauguucuuuaaggaucgauucuacaugagaaccaaccccuuuuauccggaaguggagcuuaauuucauuuccguauuuuggccucagcugcccaacggcuuggaggcugccuacgaguucgcagacagggaugaagugcgguuuuucaaagggaauaaguauugggcuguccagggacaaaacgugcuccacgguuacccaaaagacaucuauucaaguuuuggcuucccucguacaguuaagcacauagaugccgcgcugagcgaagagaacaccgggaaaacguacuuuuucguggccaauaaguauuggcgcuacgacgaauacaaaagaucuauggaccccggauauccaaagaugauugcacaugauuuucccggcaucggucacaaggucgacgcuguguucaugaaagauggguucuuuuacuucuuucauggcacuaggcaguauaaguucgacccuaaaacaaagcggauuuuaacccugcagaaagccaacuccugguuuaauugccgaaagaacuga

SEQ ID NO: 412 - RNA, 1170 nt, Artificial Sequence
  derived and/or modified CDS sequence (opt3) from Homo sapiens__NP_002412.1__HsMMP1(1-19,100-469)
augcacagcuuucccccucugcuccuucuguuguucuggggcguggucucccauucuuucguuuuaaccgaggggaacccaagaugggaacagacacaccugacuuacaggaucgagaauuauacgccggaccuaccccgggccgauguggaccaugcuauugaaaaggcauuucaacucuggucaaacguaaccccucugacauucacuaaagugagugagggacaggccgauauaaugaucagcuuuguccgcggugaccaccgagauaauuccccauucgacggccccgggggaaaccuugcgcaugcuuuucagccuggcccagguauugggggagaugcccacuucgacgaagaugagcguuggaccaauaacuuuagagaguacaaucugcacaggguggcagcccaugaauugggccacucucucggccugucgcauucaacagacaucggggcucugauguaucccagcuacaccuucaguggagauguucagcucgcacaagacgauauugacgguauccaggccauauauggccggucccagaacccugugcagccaaucgggccgcaaacucccaaggcuugcgacucuaaauuaacauuugaugccauuaccacgauccgcggagaggucauguucuuuaaggacagauucuacaugaggacuaauccuuucuauccagaaguggagcugaacuuuauuagcguauucuggccccagcuuccuaauggcuuggaggcggcauacgaauuugccgaucgggacgagguucgcuucuuuaaagguaacaaguacugggcugugcaggggcagaauguccugcacggauauccaaaggauaucuacuccucauucggcuuuccccgaaccgugaaacacauagacgccgcacuaagugaagagaacacaggcaagacuuauuucuuuguggcuaauaaauacuggagauaugaugaauacaagaggagcauggacccgggguauccuaaaaugauugcccaugauuuccccggaaucggucacaaggucgacgcgguuuuuaugaaggauggcuucuuuuacuucuuccaugggacccggcaauacaaauuugacccaaagacaaaacguauucucacccugcagaaggccaacucuugguucaacugucgcaaaaauuga

SEQ ID NO: 413 - RNA, 3357 nt, Artificial Sequence
  derived and/or modified CDS sequence (opt3) from Clostridium histolyticum__BAA77453.1__ColG
augaagaaaaacauccugaagauucucauggacagcuacuccaaagagucuaagauacagaccgugagaagggucacaucaguuagucuucuggccguguauuugacuaugaauacgagcuccuuaguacuggcuaaacccaucgaaaacaccaaugauacaucuauuaagaacguggagaagcuacggaaugcaccuaacgaagaaaauucgaaaaaggucgaagacucaaagaacgauaagguggagcacguuaaaaauaucgaggaagccaagguggagcaagucgcgccagaaguaaagagcaaaaguacucuccgcuccgcuucuauugccaacaccaauagcgagaaguacgacuucgaguaucugaacggccuuuccuacacagaacugaccaauuugaucaaaaacauaaaguggaaucagaucaacgggcucuuuaacuauucaacuggaagucagaaauucuuuggugauaagaaucgagugcaggcaauuaucaacgcccugcaagagagcggccguacauacaccgcuaaugacaugaaagggauugaaacguucacugagguucugagagcaggauuuuaucucggcuacuacaacgaugguuuaucuuaucugaaugacaggaacuuccaggauaagugcaucccggccaugauagcuauucagaagaaucccaacuuuaaacuugggaccgccgugcaggacgaagucaucacauccuugggaaagcugauuggcaaugcgucagcaaacgccgagguggugaauaacugugucccuguucuaaaacaauuccgggagaaucucaaccaguacgcuccagauuaugugaagggcacugccguaaaugaacugaucaaagggaucgaguuugacuucagcggagcagcuuacgaaaaggaugugaagaccaugcccugguaugguaaaauugacccuuuuauaaacgagcuuaaggcccugggcuuguacgggaacaucacaagugcgaccgaaugggccucugacgucggaauuuauuaccucuccaaauucggccuguacagcacgaaucgcaacgauaucgugcagucguuagagaaggcaguugacauguauaaauacgguaagauagcuuuuguggccauggagagaauuacuugggauuaugacgggaucggaucuaauggcaagaaagucgaucaugacaaguuccuggaugacgcugaaaaacacuaccucccaaagacauauaccuucgauaacggcacuuuuaucauuagggccggggacaaaguguccgaggaaaagaucaagcggcuuuacugggcaucacgcgagguaaaaagucaguuccaucgaguugugggaaaugauaaggcccuggaagucgguaacgcugacgacguguugacaaugaaaauuuuuaauagccccgaggaguauaaguucaacaccaauauaaacggcgucuccacggauaaugggggacuauacaucgaaccuagaggcaccuuuuacacauaugagaggacuccacaacagucuauuuucagccuggaggagcucuuucggcacgaguacacccauuaucugcaggcgcguuaccuuguggacggucugugggggcaaggcccguucuaugaaaagaaccgcuugacaugguuugaugagggaacugcagaguucuuugccggcucaaccagaacaagugggguucuccccaggaaguccauccugggauacuuagcuaaagacaagguggaucaccgguauagccugaagaaaacccuaaauucugguuacgacgauucagacuggauguucuacaacuauggcuuugccguagcacacuaccucuaugaaaaggauaugccuacuuucaucaaaaugaauaaggccauucugaacacggacgucaaaaguuacgaugaaauaaucaagaaacuuagcgacgaugcuaacaaaaauacagaguaucagaaccauauucaggaguuggccgacaaguaccagggggcaggaaucccacugguguccgacgauuaucucaaagaccacggcuacaagaaagcgucugaaguuuacucggagauuagcaaggcugccucccugaccaauacuucagugaccgcagaaaagagucaauauuucaacacauuuacccuucgagguacuuacacaggggagacgucuaaaggcgaguucaaggauugggacgaaaugagcaaaaagcuggauggaaccuuggagucccucgccaaaaauucauggagcggcuauaagacucugacagcuuacuuuaccaacuaucgcgucacaucugacaauaaggugcaguacgauguaguguuccaugggguuuuaacugacaacgccgauaucuccaauaacaaagcacccauagcuaaggucaccggaccuaguacgggugccgugggcagaaauaucgaauuuagcgggaaagacucuaaggaugaggacggaaaaauuguguccuaugauugggacuucggcgacggugcgaccucaagggggaagaacaguguccacgccuacaaaaaggcuggcacauacaauguuacucugaaggugaccgaugacaaaggagcaacagccacugagagcuuuaccaucgaaauuaagaacgaagauacgacaaccccaaucacuaaagagauggagcccaaugacgauauaaaggaagcuaacggcccgauuguggaggggguaacagucaaaggagaccuaaacggcucggaugacgccgauaccuucuauuuugacgugaaggaagauggugacguuacuaucgagcucccuuacuccgggucuagcaauuucaccuggcugguguauaaggagggagacgaucagaaccacauugcaucaggcaucgacaaaaauaacaguaaggucgguacauuuaaauccacgaagggccggcauuacguguucauauauaaacacgauucugcgagcaauaucuccuacucacuuaacauuaagggguugggaaaugaaaagcugaaagagaaggaaaacaaugacagcagugauaaagccaccguuauccccaacuuuaauacuacaaugcagggcucucuccugggggacgauucccgcgacuauuacagcuucgaggugaaggaagagggagagguaaacauugaauuagauaaaaaggacgaguucggcgucaccuggacacugcauccagaaucgaauaucaacgauagaauaacuuacggucaaguggacgggaauaaggugucaaacaaagucaaacuuaggccuggaaaauauuacuugcucguuuauaaguacucuggcagugguaauuaugagcugcgugugaacaaauga

SEQ ID NO: 414 - RNA, 3081 nt, Artificial Sequence
  derived and/or modified CDS sequence (opt3) from Clostridium histolyticum__BAA77453.1__HsALB(1-18)_ColG(111-1118)
augaagugggugaccuucaucagccugcucuuucuuuucuccucugccuacucaauugcuaacacaaauagugagaaauaugacuuugaauaccugaacggcuugagcuauacugaguuaacgaaucugauaaagaacaucaaauggaaucagauuaacgggcuauucaauuacuccaccggaucucaaaaguuuuucggugauaaaaacagaguccaggcaaucauuaaugcccuccaggaaucgggcaggacauauacugcgaacgacaugaaggggaucgagaccuuuacagaaguucugcgggcuggauucuaccuuggcuauuacaaugauggucugucauacuugaacgaccgcaauuuucaggauaagugcauacccgccaugaucgcaauucagaaaaacccuaauuucaagcucgggaccgccgugcaagacgagguaaucacuagccugggaaaacugauuggcaacgcuagugcaaacgccgagguggucaauaacugugugccaguucucaagcaguuucgagaaaauuuaaaccaguaugcuccggauuacgugaaaggcacagccgucaaugagcugaucaaggggauagaauuugacuuuuccggagcggcauaugagaaggaugugaaaaccaugcccugguacgguaagauugacccuuucaucaacgagcuuaaagccuugggccuguaugggaauauuacgucugcuacugaaugggccagcgauguaggaaucuacuaucuauccaaguucggccucuacucaaccaaccguaaugacaucguucaaagucuggagaaagcaguggauauguacaaguaugguaaaauugcuuuugucgccauggaaagaauaacaugggacuacgacgggaucggaagcaacggcaagaagguggaucacgacaaauuccuugaugacgcggagaagcauuaucugccaaaaacuuacaccuuugauaauggcacauucauuaucagggccggggacaaggugucugaagagaaaauaaagcgguuguauugggcaucccgcgaggucaagucacaguuucacagaguugugggaaacgauaaagcucucgaaguagguaaugccgacgaugugcugaccaugaagauuuucaacagccccgaggaauacaaauuuaauacgaacaucaacggcgucaguacugacaaugggggauuauauaucgagccuaggggcacauucuacaccuacgaacggacuccacagcagucuauuuucucccuggaggagcuguuccgccaugaauauacacacuaccuucaagcucgauaucugguggaugguuugugggggcagggccccuuuuacgagaagaacagacuaaccugguucgacgaaggaacggccgaguuuuucgcaggcagcaccaggacaucggggguucugccucggaaaucuauccucggauaucuggccaaggacaagguggaucaucguuacucccuuaaaaagacucucaauucagguuaugacgauagugacuggauguucuacaacuacggcuuugcugucgcgcacuauuuguacgaaaaagauaugccaaccuucauuaagaugaauaaagcaauacucaacacagacguaaagagcuaugaugagaucauuaagaaacuguccgacgaugccaauaagaacacugaguaccagaaucacauccaagaauuagcugacaaauaucagggggccggaaucccgcuggugucugaugacuaccuaaaggaucauggcuauaaaaaggcaagcgagguuuacucagaaauuaguaaagccgcuucccucaccaacacaagcgugaccgccgagaagucucaguacuuuaauacuuucacgcugcgcgguacauauaccggggagacuucaaagggcgaauuuaaagacugggacgagaugaguaagaaacuugauggaaccuuggaaagccuggcaaagaacuccuggucuggcuacaaaacacucaccgcguauuucacuaauuacagagucacaucggacaacaaggugcaguaugaugucguguuucacgggguucugacggacaaugcugauauaagcaacaacaaggcccccaucgcaaaagugaccggaccuuccacuggugccguaggcaggaauauugaguucucagggaaggacaguaaagaugaagacggaaagaucgucucuuacgauugggacuuuggcgauggugcuacaagccgggggaaaaacuccgugcaugccuauaagaaggcaggcaccuacaauguuacacuuaaagugacugacgauaagggagcuaccgccacggagucauucaccauugagaucaaaaacgaagacacaacuaccccaauaacaaaggagauggaacccaaugacgauaucaaagaggcgaacggcccuauugucgaaggggugacuguaaagggagaccugaauggcagcgaugacgccgauaccuuuuacuucgacgugaaggaggauggugacguuacgaucgaguugccauauucuggguccaguaacuuuacauggcucgucuacaaagaaggagaugaccaaaaucacauugcuagcggcaucgauaagaacaauucuaaaguggguaccuucaaguccacuaaaggccgacacuauguguucauauacaagcaugacucagcaaguaacauuagcuauucgcugaauaucaaaggguuaggaaacgagaagcugaaggaaaaagagaauaacgacuccucugauaaggccacagucauucccaacuuuaauaccacuaugcagggcagccuacucggggacgauucacgcgacuacuauaguuucgaaguuaaagaggagggagaagugaacaucgagcuggauaagaaagacgaauuuggcgugaccuggacacuucacccggaguccaauauaaacgauagaaucacguacggucagguagacgggaauaaggucucuaacaaggugaaauugaggccuggaaaguacuaucugcucguuuacaaauauagcggcuccgguaauuacgagcugcgggugaacaaguga

SEQ ID NO: 415 - RNA, 3429 nt, Artificial Sequence
  derived and/or modified CDS sequence (opt3) from Clostridium histolyticum__BAA77453.1__HsALB(1-18)_ColG(1-110)_CS-F_ColG(111-1 118)
augaagugggugaccuucaucagccugcucuuucuuuucuccucugccuacucaaugaaaaagaacauucugaaaauauugauggacaguuauagcaaggaguccaaaauccagacagucagaaggguuacuucugugucguuacuggcuguauaccuaacgaugaauaccucaagccucgugcuggcaaagcccauugaaaacacaaaugauacuagcaucaagaacgucgagaaacuucggaaugccccuaacgaagaaaauuccaagaaaguggaagacucuaagaacgauaaaguugagcacgugaagaauauugaggaagcgaaggucgagcaaguggcuccagaaguaaaaagcaaguccacccugcgcucagccagucgacguagaaggaaacggaucgcaaacacaaauagcgagaaguaugacuuugaguacuugaacggccucucuuauaccgaacugacuaaucugaucaaaaacauaaaguggaaucagauuaacggacucuucaacuacuccacaggaucacagaaauuuuucggugauaagaaucgcguucaggccaucauuaacgcuuuacaagagagcggcagaaccuauacggcaaaugacaugaaggggaucgaaacuuuuaccgaggugcugagggccggauucuaccuuggcuacuauaacgaugguuugaguuaccugaaugaccggaacuuucaggauaaaugcauaccggcuaugauugccauccagaagaaucccaacuucaaacuagggacagcgguccaggacgaagugauuacuucucucggaaagcugaucggcaaugcauccgccaacgcugagguggucaauaacuguguuccugugcuuaaacaauuucgcgagaaucugaaccaguaugccccagauuacguaaagggcaccgcagugaaugaauugaucaaggggauugaguucgacuuuagcggagcugccuaugaaaaagaugucaagacaaugcccugguacgguaaaauagacccuuucaucaacgagcucaaggcgcugggcuuauaugggaacauuaccucggccacggaaugggcaucugacgugggaaucuacuaccuguccaaauucggccucuauucaacuaaucgaaacgauauaguucagagucuugagaaggcuguggacauguacaaguaugguaaaauugccuuugucgcuauggagagaaucacaugggauuacgacgggaucggaagcaauggcaagaaaguggaucaugacaaguuccuggaugacgccgaaaaacacuauuugccaaagaccuacacuuuugauaacggcacauucauuaucagggcaggggacaagguauccgaggagaaaauuaagcggcuauauugggccucucgugagguuaaaagccaguuucaucgcguggucggaaaugauaaggcucuggaaguggguaacgcggacgacguccucaccaugaaaauauucaauucacccgaggaguacaaguuuaacacgaauaucaacggcgugaguaccgauaaugggggacuguacauugaaccuagaggcacauucuauacuuacgagaggaccccacaacaguccaucuuuagccuugaggaacuguuccggcacgaguauacacauuacuugcaggcacgauaucucguugacggucugugggggcaaggcccguuuuacgagaaaaaccgcuuaacuugguucgaugaaggaaccgccgaauuuuucgcuggcucuacaagaaccucaggggugcugcccaggaagaguauccuaggauaucucgccaaggacaaaguagaucaccgguacagccugaagaaaacucuuaauuccgguuacgacgauucugacuggauguucuauaacuacggcuuugcagucgcccacuauuuguacgagaaggauaugccuacguucauuaaaaugaauaaggcuauacugaacacagacgugaagucguaugaugaaaucauuaaaaagcucagcgacgaugccaacaaaaauaccgaguaccagaaccauauccaggagcuggcagacaaguaucagggggcggggauuccacuuguuuccgacgauuaccugaaagaccacggcuacaagaaggcuucagaaguguauagugagaucucuaaagccgcaaguuugacuaauaccuccgucacagccgaaaagucacaauacuuuaacaccuucacucuccgcgguacauauacgggggagaccagcaaaggcgaauuuaaggauugggacgagaugucuaaaaagcuggauggaacuuuagagucccuggcuaagaauaguuggagcggcuacaaaacacuaaccgccuauuucacaaacuacagagugacuucugacaauaagguacaguaugaugugguuuuucaugggguccucaccgacaacgcagauauauccaauaacaaagcucccaucgccaaggugacgggaccuucaaccggugcggugggcaggaauauugaguucagugggaaagacagcaaggaugaagacggaaaaaucgucucguacgauugggacuuuggcgacggugccacaucccgugggaagaacucuguucacgcuuacaagaaagcaggcacuuauaaugugacccugaaggugacagaugacaaaggagccacugcuaccgagagcuucacgauugaaaucaagaacgaagauacaaccacuccaauaacaaaagagauggagcccaaugacgauauuaaggaagccaacggcccgaucguagagggggucaccgugaagggagaccuuaacggcucagaugacgcagauacuuuuuacuucgacguuaaagaagauggugacgugaccauugaguugccuuauaguggguccucuaauuuuacauggcuggucuacaaggagggagacgaucagaaccacaucgcgagcggcauagacaaaaauaacuccaagguggguacguucaaaucaaccaagggccggcauuauguuuucaucuacaagcacgauagcgccaguaauauuucuuauucccucaacaucaaagggcugggaaaugaaaaguuaaaagagaaggaaaacaaugacagcucggauaaagcuacugugauucccaacuuuaauacaaccaugcagggcucacugcuuggggacgauucucgagacuacuacaguuucgagguaaaggaagagggagaggucaacaucgaauuggauaagaaagacgaguuuggcgugacauggacucuccauccagaauccaauauaaacgauagaauuaccuauggucaaguggacgggaauaaggucagcaacaaaguuaagcugaggccuggaaaauacuaucuacugguguacaaguauucuggcagcgguaauuacgagcuccgcguaaacaaguga

SEQ ID NO: 416 - RNA, 3105 nt, Artificial Sequence
  derived and/or modified CDS sequence (opt3) from Clostridium histolyticum__BAA34542.1__ColH
augaacuuccugaagaucauucucaauagaggcaaaaccaugaagaggaaaugccuuagcaagcggcugauguuggccauaacaauggcuacuaucuuuacggugaacuccaccuuacccauuuacgcagccgucgacaaaaauaacgcgacagcugccguucagaaugagucuaagcgcuauacugugucauaccugaagacccuaaacuauuacgaucucguagaccugcuugugaaaacagaaaucgagaaucugccugauuuguuccaauauaguagcgacgcaaaggaauuuuacgggaacaaaacccgaauguccuucauuauggaugagaucggacguagagccccacaguauacugaaauagaccacaaggguaucccgacacucgucgaggugguuagggcuggcuuuuaccugggguuccauaauaaagagcugaacgaaauuaauaagcggucuuuuaaggagcgcgugauccccucgauucucgcaauccagaaaaacccuaauuucaaguuaggaaccgaaguccaggauaaaauagugucagccacgggccugcuugcugguaacgagacugccccacccgagguaguuaauaacuuuaccccuauuuugcaagacuguaucaagaacauugauagauacgcgcuggacgaucuaaaaagcaaggcacucuucaaugugcuggccgcuccaacauaugacaucacugaauaccuuagggccaccaaagagaagcccgaaaacacaccuugguaugggaagaucgauggauuuauuaaugagcugaaaaaguuggcacucuacggcaaaauaaacgacaauaacaguuggaucauugacaauggcaucuaucacauagcuccacuggggaaguuacauuccaacaauaaaauuggaaucgaaacccugacggaggucaugaagguguacccguaucucucuaugcagcaccuucagagcgccgaucagaucaagcggcauuacgacuccaaagaugcggaggguaacaagauuccccuggacaaauucaagaaagaaggcaaggagaaguacugcccuaaaacuuauacauuugaugacgggaaggugaucauuaaagccggagcacgcgucgaagaggaaaagguuaaacgauuguacugggcuucaaaggaggugaauagucaauucuucagaguauauggcauagauaagccacuagaggaagguaaccccgacgauauccugaccauggugauuuacaauagcccugaggaauauaaacucaacucuguccuguacggguaugacacuaauaacggaggcauguacaucgagccagaaggcacauuuuucaccuacgagagggaggcccaggaauccacguauacccuugaggaacuguuucggcacgaguacacacacuauuugcaggggcguuacgcugugcccggacaguggggucgcacuaagcucuaugauaacgacagacugaccugguacgaggaaggcggggccgaguuauucgcaggaucaacaaggacuagcggcauccugccgcggaaaaguauuguuucuaauauacauaacaccacacgaaauaaccgcuauaagcuauccgacaccgugcacagcaaauacggugccucguuugaguucuacaauuaugcuuguauguuuauggauuacauguauaacaaggacauggggauccucaauaaacugaacgaucuugcgaagaauaacgacgucgauggcuacgacaauuauauuagagauuugucuuccaacuacgcacugaaugacaaguaucaagaucauaugcaggaaaggaucgacaacuacgaaaaucucacugugccuuucguagccgaugacuaccugguucggcacgcuuauaaaaaccccaacgagauuuacucagagaucagugaaguggccaaacuuaaggaugcaaagagcgaggucaaaaagucccaguauuuuucuacguucacacugcgcggaagcuacaccggcggggccucaaagggaaaauuggaagaccaaaaggcuaugaauaaauuuauagacgauagucucaagaaacuggacacuuauuccuggagcgguuacaagaccuuaacagccuauuucaccaacuacaagguggauucuucaaauagagucacuuacgacgugguuuuucacggcuaucugccaaacgagggggauaguaaaaauagccuaccuuacggaaagaucaacggcacauauaaagguacggaaaaggagaaaauuaaguucuccucugaggggucguucgaccccgauggcaagaucgugagcuacgaaugggacuuuggagauggcaauaaauccaacgaggaaaauccagagcauucauaugacaagguagggaccuacacugucaaacucaaggugacagaugacaaaggagaaaguucuguuagcaccacaacugcagagauuaaggaucuguccgagaacaaacuucccgugaucuauaugcacgucccuaagucaggugcguugaaucagaaggugguauucuacggcaaagggaccuacgacccagacggaagcauagcuggcuaucagugggauuuuggugacgggucugauuucuccagugaacagaacccgagccauguguacacgaagaaaggcgaguauaccguuacacugagggucauggacucuuccggacaaaugucagaaaagacuaugaaaauuaagaucaccgaucccguguacccuauuggcacagagaaggagccaaauaacaguaaagaaacugccagcgggcccaucgugccuggaauaccagucucgggcaccaucgagaauacguccgaccaggauuauuuuuacuucgacguuauuacacccggugaagugaagaucgauauuaacaaacucggguauggaggcgcaaccugggugguauacgacgagaacaauaacgccgucucuuacgcuacugaugacggucagaaucugagcggcaaguuuaaagccgacaagccggggcguuauuacauccacuuauauauguucaacggaucauacaugccuuaucggauaaauauugaaggcaguguggggcgauga

SEQ ID NO: 417 - RNA, 3066 nt, Artificial Sequence
  derived and/or modified CDS sequence (opt3) from Clostridium histolyticum__BAA34542.1__ColH
augaagagaaaaugccugagcaagaggcucaugcuugccaucaccauggcuacaauuuucacugugaacuccacgcugcccauauacgcagccgucgacaaaaauaacgcgaccgcugccguucagaaugagucuaagcgguauacagugucauacuugaaaacuuuaaacuauuacgaucugguagaccuacucgugaagaccgaaaucgagaaucugccugaucuuuuucaauauaguagcgacgcaaaggaguucuacggcaacaaaacacgcauguccuuuauuauggaugaaaucgggcgacgugccccacaguauaccgaaauugaccacaagggaaucccgacucuggucgaggugguuagagcugguuucuacuugggcuuucauaauaaagagcucaacgaaauaaauaagaggucuuucaaagagcgggugauccccucgauucuggcaauccagaagaacccuaauuuuaagcuggggacagaaguccaggauaaaauugugucagccaccggacucuuagcuggcaacgagacggccccacccgagguaguuaauaacuucacuccuauccugcaagacuguauaaagaauauugaucgcuacgcgcuugacgauuugaaaagcaaggcacuguuuaacgugcuagccgcuccaaccuaugacaucacagaauaccucagagccacuaaagagaagcccgaaaacaccccuugguaugguaaaauugauggguucaucaaugagcugaagaagcuggcacuguacggaaaaaucaacgacaauaacaguuggauuauagacaauggcaucuaucacauugcuccauugggcaagcuccauuccaacaauaaaaucgggauagaaacacugaccgaggucaugaagguguacccguauuuaucuaugcagcaccuucagagcgccgaucagauuaaaaggcauuacgacuccaaggaugcggagggaaacaagaucccccucgacaaauuuaagaaagaagguaaggagaaauacugcccuaagacguauacuuucgaugacggcaaggugaucauuaaagccggggcacgggucgaagaggaaaagguuaaacgccuuuacugggcuucaaaggaggugaauagucaauuuuuccgaguauauggaaucgauaaaccacuggaggaaggcaaccccgacgauauuuugacaauggugauauacaauagcccugaggaauauaagcuaaacucuguccuguacgguuaugacaccaauaacgggggaauguacaucgagccagaaggcacuuucuuuacauacgagagagaggcccaggaauccaccuauacgcucgaggaacuguucaggcacgaguacacccacuaucuucagggccgguacgcugugcccgggcaguggggacguacaaagcuguaugauaaugaccgcuugacuugguacgaggaagguggcgccgagcucuuugcagggucaaccagaacaagcggcauucugccgaggaaaaguaucguuucuaacauccauaacacuacccggaauaaccgauauaaguuauccgacacagugcacagcaaauacggagccucguucgaauuuuacaauuaugcuuguauguucauggauuacauguauaacaaggacauggguauucugaauaaacuaaacgaucucgcgaagaauaacgacgucgauggguacgacaauuauauacgcgaucugucuuccaacuacgcacuuaaugacaaauaucaagaucauaugcaggagagaaucgacaacuacgaaaauuugaccgugccuuuuguagccgaugacuaccugguuaggcacgcuuauaagaaccccaaugagauuuacucagagaucagugaaguggccaagcucaaagaugcaaagagcgaggucaaaaagucccaguauuucucuacuuuuacgcugcggggcagcuacacaggaggcgccucaaaagggaaacuugaagaccaaaaggcuaugaacaaguucauugacgauagucugaagaaauuggacaccuauuccuggagcggauacaagacucucaccgccuauuuuacaaacuacaaaguggauucuucaaaucgcgucaccuacgacgugguuuuccacgguuaucugccaaacgagggcgauaguaagaauagcuuaccuuacgggaagaucaacggaacuuauaaaggcacagaaaaggagaaaauaaaguuuuccucugaggguucguucgaccccgaugggaaaaucgugagcuacgaaugggacuucggcgauggaaauaaguccaacgaggaaaauccagagcauucauaugacaagguaggcacguacaccgucaaacugaaggugacugaugacaaaggggaaaguucuguuagcacaaccacagcagagauuaaggaucuauccgagaacaaacuccccgugaucuauaugcacgucccuaagucaggagcgcugaaucagaaagugguauuuuacgguaagggcacuuacgacccagacgggagcauugcuggauaucagugggauuucggcgacgguucugauuuuuccagugaacagaacccgagccauguguacaccaagaaaggggaguauacgguuacccuuagagucauggacucuuccggccaaaugucagaaaagacaaugaaaaucaagauaacugaucccguguacccuauuggaaccgagaaagagccaaauaacaguaaggaaacagccagcggccccaucgugccugggauuccagucucgggaacuaucgagaauaccuccgaccaggauuauuucuacuuugacguuauaacgcccggcgaagugaagaucgauauuaacaaauuggguuaugggggagcaacaugggugguauacgacgagaauaacaacgccgucucuuacgcuaccgaugacggccagaaucugagcgguaaguucaaagccgacaagccgggcagguauuacauccaccucuauauguuuaacgggucauacaugccuuaucguauuaauaucgaaggaagugugggccgguga

SEQ ID NO: 418 - RNA, 3000 nt, Artificial Sequence
  derived and/or modified CDS sequence (opt3) from Clostridium histolyticum__BAA34542.1__HsALB(1-18)_ColH(41-1021)
augaagugggugaccuucaucagccugcucuuucuuuucuccucugccuacucaguccagaacgagaguaaaagauauacaguuagcuaccugaagacuuugaauuauuacgacuuaguggaucugcuaguaaaaacggaaauugagaaccuccccgaccuguuucaauauuccucugaugcuaaggaguucuacggcaauaaaaccaggaugucguuuauaauggacgaaaucggccggcgcgcaccucaguauacagaaauugaucacaagggaaucccaacucuuguggaggucgugcgagccgguuucuaccugggcuuucauaacaaggaguugaaugaaauuaacaaacguucauucaaggagagaguuaucccgagcauacucgcgauccagaaaaaucccaacuuuaagcuggggaccgaagugcaggacaaaauugucagugcuacaggacugcucgccggcaaugagaccgcaccuccagaggugguaaacaauuucacucccaucuuacaagauugcauuaagaacaucgacagguacgcccuggaugaccuuaaguccaaggcuuuguuuaauguucuggcagccccuacauaugauauaaccgaauaccuacgggcuacgaaggagaaaccagaaaacacucccugguaugguaagauugacggguucaucaaugagcucaaaaagcuggcccuuuacggaaaaauuaacgauaacaauucuuggaucaucgacaacggcauuuaucacauagcgccucugggcaaguugcauagcaauaacaagaucgggauugaaacccucacagaggugaugaaagucuacccauaucuguccaugcagcacuuacagucagcagaccagaucaagcgccauuacgauaguaaagacgccgagggaaauaagauaccgcuggauaaauuuaagaaggaagguaaagagaaguacugucccaaaacuuauaccuucgacgauggcaaggugauuaucaaagcuggggccagaguggaagaggaaaaggucaagaggcucuacugggcaagcaaagagguuaacucucaauucuuucggguguauggaaucgacaagccucuugaggaaggcaauccagaugacauucugacaaugguaaucuacaacucccccgaggaauauaaacuaaauucaguguuguacgguuaugauaccaacaaugggggaauguacauugagccugaaggcacguucuuuacuuacgagcgcgaggcucaggaaagcacauauacccuggaggaacucuuccgacacgaguacacucacuaucugcagggcagauacgccgucccagggcaguggggaaggacaaaacuuuaugacaacgaucggcugaccugguacgaggaagguggcgcggaguuguuugccgggaguacgcguaccucuggaauacucccccgcaaauccaucgugagcaauauucauaacacaacuagaaauaacagguauaagcugucggacaccguucacucuaaguacggcgcauccuucgaauuuuacaacuaugcuugcauguucauggacuacauguauaauaaagauauggguaucuuaaacaagcugaaugaccuagccaaaaacaaugauguggacggguacgauaacuauauccgggaccucucaaguaauuacgcucugaacgauaaguaucaagaccauaugcaggagcgaauugauaauuacgaaaaccuuacagucccguuuguggccgacgauuacuugguacgccacgcauauaaaaauccuaacgagauauacagcgagaucuccgaaguugccaagcugaaagacgcuaagucugaggugaagaaaagccaguauuucucaacuuuuacccucagaggcaguuacacaggaggcgcguccaaggggaaacuggaagaucaaaaggcaaugaauaaauucauugacgacagccuuaagaagcuggauaccuauucuuggucaggauacaaaacuuugacggccuauuuuacaaacuacaaggucgacaguagcaauagggugaccuacgaugucguguuccacgguuaucuccccaacgagggcgacuccaaaaacucucugccauacgggaagaucaauggaacuuauaaaggcaccgaaaaggagaagauuaaauucucgagcgaggguuccuuugauccugacgggaagaucguuucauacgaaugggauuucggcgacggaaacaaaaguaaugaggaaaaccccgagcauucuuaugauaaggugggcacauacaccguaaaauuaaaggucacugacgauaagggggaaagcuccgugucaacaacgaccgcugagauaaaagaccugagcgagaauaagcuaccaguuaucuauaugcacgugcccaaaucuggagcccucaaccagaaggucguguuuuacgguaaaggcacuuacgauccugacggguccauugcaggauaucagugggacuucggcgaugguagugacuuuagcucugaacagaauccaucccauguauacacaaagaaaggggaguauaccgugacacugcggguuauggauucaaguggccaaaugagcgaaaagacuaugaagaucaaaauuaccgacccggucuaccccaucggaacggagaaggagccuaacaauucgaaagaaaccgccuccggcccaauagugcccgggauuccugugucuggaacaaucgagaacacuagcgaucaggacuauuucuacuuugaugucauuaccccaggcgaaguuaagaucgacauaaauaaacuugguuaugggggagcuacaugggugguguacgaugagaacaauaacgccguaucauacgcaacugacgauggccagaauuugagugguaaguucaaggcggacaaacccggccgcuauuacauccaccuguauauguuuaacggguccuacaugccguauagaauuaacaucgaaggaucugucgggagguga

SEQ ID NO: 419 - RNA, 3138 nt, Artificial Sequence
  derived and/or modified CDS sequence (opt3) from Clostridium histolyticum__BAA34542.1__HsALB(1-18)_ColH(1-40)_CS-F_ColH(41-102 1)
augaagugggugaccuucaucagccugcucuuucuuuucuccucugccuacucaaugaaaagaaagugccugaguaaaagguugauguuagcuauuacaauggcaacuauauuuacggucaacagcacccugcccaucuaugccgcgguugacaagaauaacgcuacagccgcacggcgccgacguaaaagagugcagaaugaguccaagagguacacuguaucuuaucuaaagacccucaacuacuaugaucugguggaccuucuggucaaaacagaaauugagaauuugccugaucucuuccaauacucgucagacgccaaggaauuuuauggcaacaaaacccggaugagcuucaucauggaugagauugggcgcagagcuccacaguacacugaaaucgaccacaagggaauaccgacacugguggagguugugagggcagguuuuuaccugggcuuccauaauaaagagcucaacgaaaucaauaagcggaguuuuaaggagcgcgucauucccuccaucuuagccauucagaaaaacccuaauuucaagcuggggaccgaagugcaggauaaaaucguaucugcuacgggacuuuuggccggcaacgagacugcgccacccgagguugugaauaacuuuaccccuauacugcaagacuguauuaagaauaucgaucgauaugcacuagacgaucucaaaagcaaggcccuguucaacguccuugcugccccaacauacgacauuacugaauaucugagagcaaccaaagagaagcccgaaaacacaccuugguacgguaagaucgauggguuuaucaaugaguugaaaaagcucgcucuguauggaaaaauuaacgacaauaacuccuggauaaucgacaauggcauuuaccacaucgccccauuaggcaagcugcauucaaacaauaaaauagggauugaaacccucacggaggugaugaagguguauccguaccuuaguaugcagcaucugcagagcgcggaucagaucaagaggcacuacgacucuaaagaugccgagggaaacaagauccccuuggacaaauucaagaaagaagguaaggagaaguauugcccuaaaacuuacacauucgaugacggcaaggucauuaucaaagcaggggcucggguugaagaggaaaaggugaaacgucuauauugggccuccaaggagguaaauucacaauuuuuccgcguguacggaauugauaagccacuggaggaaggcaaccccgacgauauacucaccauggucaucuauaauagcccugaggaauacaaacugaacagugugcuuuaugguuacgacacuaauaacgggggaauguacauugagccagaaggcacauuuuucaccuaugagagagaggcucaggaaucuacguacacccuggaggaauuguuuaggcacgaguauacacacuaccuccagggccgguaugccguucccgggcaguggggacgaacuaagcuguacgauaaugaccgcuuaaccugguaugaggaagguggcgcagagcuguucgccggguccacaagaacuagcggaauccuaccgaggaaaucgaucgugucuaacauucauaacaccacacggaauaaccgcuacaagcucuccgacaccguccacucaaaauacggcgcuaguuuugaguucuauaauuacgcguguauguuuauggauuauauguacaacaaggacauggguauacugaauaaacuuaacgauuuggcaaagaauaacgacguggauggguaugacaauuacaucagagaucugagcuccaacuaugcccucaaugacaaguaccaagaucauaugcaggaaaggauugacaacuacgaaaaucugacuguaccuuucguugcugaugacuaucuugugcgucacgccuacaaaaaccccaaugagaucuauucugagauuagcgaagucgcaaagcugaaagaugccaagucagaggugaaaaagagucaguacuuuuccacguucacauugcggggcagcuauaccggaggcgcuucuaaggggaaacucgaagaccaaaaggccaugaacaaauuuaucgacgauucacugaagaaauuagacacuuacaguuggagcggauauaagacccugacagcauacuucaccaacuacaaggucgauuccucuaaucgagugacuuaugacguuguguuccacgguuaccuaccaaacgagggcgauucgaaaaauagccucccuuaugggaagauaaacggaacauacaaaggcacggaaaaggagaaaaucaaguuuuccucagaggguaguuucgaccccgaugggaagauuguaucuuaugaaugggacuuuggcgauggaaauaaaagcaacgaggaaaauccagagcauuccuacgacaaggucggcaccuauacugugaaacugaagguuacagaugacaaaggggaaucaagcgugucuaccacaacugcggagaucaaggaucuuuccgagaacaaauugcccgucauuuacaugcacgugccuaagaguggagcucugaaucagaagguaguguucuacgguaaaggcaccuaugacccagacgggagcaucgccggauaccagugggauuuuggcgacgguucugauuucuccucagaacagaacccgagucauguuuauacgaagaaaggggaguacaccgucacacucagagugauggacagcucgggccaaauguccgaaaagacuaugaaaauaaagauuaccgaucccguguauccuaucggaacagagaaggagccaaauaacucuaaagaaacugcaagcggccccauugucccugggaucccaguuucaggaaccauagagaauacgagugaccaggauuacuuuuauuucgacgugaucacacccggcgaagugaagauugauaucaacaaacuggguuacgggggagccaccuggguagucuacgacgagaauaacaacgcuguguccuaugccacugaugacggccagaauuuaucugguaaguuuaaagcagacaagccgggcagguacuauauucaccuguacauguucaacgggagcuauaugccuuaccgcaucaauauagaaggauccguuggccgguga

SEQ ID NO: 420 - RNA, 576 nt, Artificial Sequence
  derived and/or modified CDS sequence (opt3) from Homo sapiens__NP_001133.1__HsAMELX
augggcaccuggauccuguucgccugccuccuuggggcugcauuugccaugccccugccuccacacccgggacaucccgguuacauuaacuucagcuaugagguguugacaccuuuaaagugguaccaguccauaagaccacccuauccuucuuacggcuaugaaccaaugggaggguggcugcaccaucaaaucauucccguccuaucacagcagcacccuccaacucauacgcuccagccgcaccaccauauccccguugugccugcgcaacagccaguaauuccccagcagccuaugaugccagugcccggccaacacaguaugaccccgauccagcaucaccagccuaaucugcccccuccagcucagcaacccuaccagccacagcccguccaaccucagccacaccagccgaugcagccccaaccuccagugcaucccaugcagccucuuccaccccagccgccucugccacccauguuuccuaugcagcccuugccaccuaugcuccccgaccugacacuggaggccuggccaagcacugauaaaaccaagagggaagagguugacuga

SEQ ID NO: 421 - RNA, 135 nt, Artificial Sequence
  derived and/or modified CDS sequence (opt3) from Homo sapiens__NP_001133.1__HsAMELX-TRAP
augccccugccuccacacccgggccaucccggguacaucaacuucagcuaugaggugcucaccccucuuaagugguaccaguccauuagaccacccuauccuucuuacggauaugaaccaauggguggcugguga

SEQ ID NO: 422 - RNA, 168 nt, Artificial Sequence
  derived and/or modified CDS sequence (opt3) from Homo sapiens__NP_001133.1__HsAMELX-LRAP
augccccugccuccacacccgggccaucccggguacaucaacuucagcuaugaggugcucaccccucuuaagugguaccaguccauuagaccacccccuaugcugccagacuugacauuagaagccuggcccucuacugauaaaacgaagagggaggaagucgacuga

SEQ ID NO: 423 - RNA, 207 nt, Artificial Sequence
  derived and/or modified CDS sequence (opt3) from Homo sapiens__NP_001133.1__HLA-A2-SP_HsAMELX(17-60)
auggccgugauggcucccagaacccugguccuccuucugagcggcgcauuggccuuaacacagacuugggcgaugccucugccaccgcaccccgggcauccuggauacaucaacuucuccuaugagguucuaacgccacucaagugguaccaaucuauuaggcccccuuauccaucauacgguuaugaacccaugggcgggugguga

SEQ ID NO: 424 - RNA, 240 nt, Artificial Sequence
  derived and/or modified CDS sequence (opt3) from Homo sapiens__NP_001133.1__HLA-A2-SP_HsAMELX(17-47,168-191)
auggccgugauggcucccagaacccugguccuccuucugagcggcgcauuggccuuaacacagacuugggcgaugccucugccaccgcaccccgggcauccuggauacaucaacuucuccuaugagguucuaacgccacucaagugguaccaaucuauuaggcccccuccaaugcugcccgaccuuacccuggaggcuuggccuucaacagauaaaacuaagcgggaagaaguggacuga

SEQ ID NO: 425 - RNA, 579 nt, Artificial Sequence
  derived and/or modified CDS sequence (opt3) from Homo sapiens__NP_001134.1__HsAMELY
augggcaccuggauccuguucgccugccucgugggggcugcauuugccaugccccuuccuccacacccgggacaucccgguuacauuaacuucagcuaugagguccugacaccuuugaagugguaccaguccaugauaagaccacccuauucuucauacggcuaugaaccuaugggagggugguuacaccaucaaaucauuccaguugugagucagcagcacccccugacucauacgcuacagagccaccaccauaucccuguagugccagcgcaacagccgaggguccggcagcaggcucucaugcccgugccuggccaacaguccaugaccccaacacagcaccaucagcccaaucugccucuuccagcccaacagcccuuucagccgcaaccuguucagccccagccacaccagccuaugcaaccccagccacccgugcagccuaugcagccacuguugccgcaacccccucucccacccauguucccucugcgcccacugcccccgauucucccugacuuacaccuggaggcauggccagccacugauaaaaccaagcaggaagaggucgacuga

SEQ ID NO: 426 - RNA, 138 nt, Artificial Sequence
  derived and/or modified CDS sequence (opt3) from Homo sapiens__NP_001134.1__HsAMELY-TRAP
augccccugccuccacacccgggccaucccggguacaucaacuucagcuaugaggugcucaccccucuuaagugguaccaguccaugauuagaccacccuauucuucauacggauaugaaccuauggguggcugguga

SEQ ID NO: 427 - RNA, 171 nt, Artificial Sequence
  derived and/or modified CDS sequence (opt3) from Homo sapiens__NP_001134.1__HsAMELY-LRAP
augccccugccuccacacccgggccaucccggguacaucaacuucagcuaugaggugcucaccccucuuaagugguaccaguccaugauuagaccacccccuauacugccagacuugcacuuagaagccuggcccgcuacagauaaaacuaagcaagaggaagucgacuga

SEQ ID NO: 428 - RNA, 210 nt, Artificial Sequence
  derived and/or modified CDS sequence (opt3) from Homo sapiens__NP_001134.1__HLA-A2-SP_HsAMELY(17-61)
auggccgugauggcucccagaacccugguccuccuucugagcggcgcauuggccuuaacacagacuugggcgaugccucugccaccgcaccccgggcauccuggauacaucaacuucuccuaugagguucuaacgccacucaagugguaccaaucuaugauuaggcccccuuauucaaguuacgguuaugaaccaaugggcgggugguga

SEQ ID NO: 429 - RNA, 243 nt, Artificial Sequence
  derived and/or modified CDS sequence (opt3) from Homo sapiens__NP_001134.1__HLA-A2-SP_HsAMELY(17-48,169-192)
auggccgugauggcucccagaacccugguccuccuucugagcggcgcauuggccuuaacacagacuugggcgaugccucugccaccgcaccccgggcauccuggauacaucaacuucuccuaugagguucuaacgccacucaagugguaccaaucuaugauuaggcccccuccaauacugcccgaccuucaccuggaggcuuggccugccaccgauaaaacaaagcaggaagaaguggacuga

SEQ ID NO: 430 - RNA, 570 nt, Artificial Sequence
  derived and/or modified CDS sequence (opt3) from Sus scrofa__NP_999071.1__SsAMELX-001-1
augggcaccuggauccuguucgccugccuccuuggggcugcauuuagcaugccccugccuccacacccgggacaucccgguuacauuaacuucuccuaugagguguugacaccuuuaaagugguaccagaauaugauaagacacccauauacuucuuacggcuaugaacccaugggaggguggcugcaucaccaaaucauuccugucguuucacagcagacgccacagagucaugcccuacaaccccaccaccauaucccuauggugccagcgcagcagccgggcauuccccagcaaccuaugaugccacuccccggucagcacagcaugaccccuacacagcaucaccagccaaaccugccccuuccggcucaacagccuuuucagccccaaccaguacagccucagccccaccagccacugcaaccccaguccccuaugcauccaauccagccguugcucccccagccuccacugcccccuauguucucuaugcaaucgcugcucccagacuuaccccuggaggccuggccggcaacugauaaaaccaagagggaagagguggacuga

SEQ ID NO: 431 - RNA, 138 nt, Artificial Sequence
  derived and/or modified CDS sequence (opt3) from Sus scrofa__NP_999071.1__SsAMELX-TRAP
augccccugccuccacacccgggccaucccggguacaucaacuucagcuaugaggugcucaccccucuuaagugguaccagaauaugauuagacacccauauacauccuacggauaugaacccauggguggcugguga

SEQ ID NO: 432 - RNA, 171 nt, Artificial Sequence
  derived and/or modified CDS sequence (opt3) from Sus scrofa__NP_999071.1__SsAMELX-LRAP
augccccugccuccacacccgggccaucccggguacaucaacuucagcuaugaggugcucaccccucuuaagugguaccagaauaugauuagacacccaucccuguugcccgacuuaccucuggaagccuggccagcuacagauaaaacuaagagggaggaagucgacuga

SEQ ID NO: 433 - RNA, 210 nt, Artificial Sequence
  derived and/or modified CDS sequence (opt3) from Sus scrofa__NP_999071.1__HLA-A2-SP_SsAMEL(17-61)
auggccgugauggcucccagaacccugguccuccuucugagcggcgcauuggccuuaacacagacuugggcgaugccucugccaccgcaccccgggcauccuggauacaucaacuucuccuaugagguucuaacgccacucaagugguaccaaaauaugauuaggcaccccuauaccucuuacgguuaugaaccuaugggcgggugguga

SEQ ID NO: 434 - RNA, 243 nt, Artificial Sequence
  derived and/or modified CDS sequence (opt3) from Sus scrofa__NP_999071.1__HLA-A2-SP_SsAMEL(17-49,167-189)
auggccgugauggcucccagaacccugguccuccuucugagcggcgcauuggccuuaacacagacuugggcgaugccucugccaccgcaccccgggcauccuggauacaucaacuucuccuaugagguucuaacgccacucaagugguaccaaaauaugauuaggcaccccucucugcuuccugaccugccauuggaggcuuggcccgccaccgauaaaacaaagcgggaagaaguggacuga

SEQ ID NO: 435 - RNA, 534 nt, Artificial Sequence
  derived and/or modified CDS sequence (opt3) from Sus scrofa__P45561-2__SsAMELX-001-2
augggcaccuggauccuguucgccugccuccuuggggcugcauuuagcaugccccugccuccacacccgggacaucccgguuacauuaacuucuccuauauaagacacccuuacacaucuuauggcuacgagccaaugggagggugguugcaucaccagaucauucccguggucucacaacagacuccucagagucaugccuuacagccacaccaccauauccccaugguuccugcgcaacagccaggcauuccgcagcagcccaugaugccucugccaggucaacacagcaugacgcccacccagcaucaccagccuaaucuaccacuccccgcucagcaaccguuucagccucagcccgugcaaccacagccucaccagccccugcagccacaaucccccaugcauccuauccagccacuucugccgcagcccccuuugccacccauguucucuaugcagucgcuccugccugaccugccacucgaagccuggcccgcaacagauaagacuaaaagggaggaaguagacuga

SEQ ID NO: 436 - RNA, 570 nt, Artificial Sequence
  derived and/or modified CDS sequence (opt3) from Sus scrofa__NP_998965.1__SsAMELX-001-3
augggcaccuggaucuucuuugccugccugcucggggcuagccuugcaaugccccugccuccacacccgggacaucccgguuacauuaacuucuccuaugagguguugacaccuuuaaagugguaccagaauaugauaagacacccauauacuucuuacggcuaugaacccaugggaggguggcugcaucaccaaaucauuccugucguuucacagcagacgccacagagucaugcccuacaaccccaccaccauaucccuauggugccagcgcagcagccgggcauuccccagcaaccuaugaugccacuccccggucagcacagcaugaccccuacacagcaucaccagccaaaccugccccuuccggcucaacagccuuuucagccccaaccaguacagccucagccccaccagccacugcaaccccaguccccuaugcauccaauccagccguugcucccccagccuccacugcccccuauguucucuaugcaaucgcugcucccagacuuaccccuggaggccuggccggcaacugauaaaaccaagagggaagagguggacuga

SEQ ID NO: 437 - RNA, 219 nt, Artificial Sequence
  derived and/or modified CDS sequence (opt3) from Sus scrofa__K7GPB2__SsAMELX-002
augggcaccuggauccuguucgccugccuccuuggggcugcauuuagcaugccccugccuccacacccgggacaucccgguuacauuaacuucuccuaugagguguugacaccuuuaaagugguaccagaauaugauaagacacccaucucugcuacccgaccucccucuggaagccuggccagcgacugauaaaacgaagagggaggaagucgacuga

SEQ ID NO: 438 - RNA, 612 nt, Artificial Sequence
  derived and/or modified CDS sequence (opt3) from Sus scrofa__K7GLD0__SsAMELX-003
augggcaccuggauccuguucgccugccuccuuggggcugcauuuagcaugccccugccuccacacccgggacaucccgguuacauuaacuucuccuaugaggacuuguacuuagaagccauaagaaucgauaggacagcguuugugcugacuccucuaaagugguaucagaauaugauucggcacccauacacgucuuauggcuacgagcccaugggaggguggcuccaucaccaaaucauuccugucguuucacagcagaccccacagagucaugcucugcaaccccaccaccauaucccuauggugccagcccagcagccgggcauaccccagcaaccuaugaugccacuucccggucagcacagcaugacaccuacucagcaucaccagccaaaccugcccuugccggcacaacagccuuuccagccccaaccaguacagccucagccccaccagccacuccaaccccaguccccuaugcauccaauccagccgcugcugccccagccuccauuacccccuauguuuucuaugcaaucgcuccugccagaccuucccuuggaagccuggccggcuaccgauaaaacaaagcgcgaggaaguggacuga

SEQ ID NO: 439 - RNA, 498 nt, Artificial Sequence
  derived and/or modified CDS sequence (opt3) from Sus scrofa__K7GPE9__SsAMELX-004
augggcaccuggauccuguucgccugccuccuuggggcugcauuuagcaugccccugccuccacacccgggacaucccgguuacauuaacuucuccuaugagguguugacaccuuuaaagugguaccagaauaugauaagacacccaacuccccaaucucaugcccugcagccucaccaucacaucccaaugguccccgcgcagcagccuggcauuccacaacagccgaugaugccccuaccugggcagcacucaaugacgccaacccagcaucaccaacccaaccucccucugccagcucagcagcccuuucagccgcaaccuguucagccccagccacaucaaccucuucagccccagaguccaaugcaccccauccagccucuguugccacaaccgccccucccuccaauguucagcaugcagucccugcugcccgaccucccuuuagaagccuggccagcaacagauaaaacuaagagggaggaaguggacuga

SEQ ID NO: 440 - RNA, 522 nt, Artificial Sequence
  derived and/or modified CDS sequence (opt3) from Sus scrofa__J9JIM4__SsAMELX-201
augccccugccuccacacccgggccaucccggguacaucaacuucagcuaugaggugcucaccccucuuaagugguaccagaauaugauuagacacccauauacauccuacggauaugaacccauggguggcuggcugcaucaccaaauaaucccugucguuucucagcagacuccacagucacaugccuugcaaccccaccaccauauuccuauggugccagcucagcagccggggaucccccagcaaccuaugaugccauuacccggacagcacaguaugacgccuacccagcaucaccagccaaaccugccccuaccggcacaacagccuuuucagccccaaccaguacagccucagccccaccagccacuccaaccccagagcccuaugcauccaauucagccgcugcuuccccagccuccacugcccccuauguucuccaugcaaucuuugcucccagaccugccccuggaggccuggccggcgacagauaaaacuaagagggaagagguggacuga

SEQ ID NO: 441 - RNA, 2961 nt, Artificial Sequence
  derived and/or modified CDS sequence (opt3) from Homo sapiens__NP_006120.1__HsBMP1
augcccggcguggccagacugccucuccuucugggguuguuacugcuaccaaggccgggacggccccucgaccuggcugauuacaccuaugaccuugcagaggaagaugacagcgagccucugaacuacaaggauccaugcaaagccgcggcuuucuugggugacaucgcccucgaugaagaggaccugcgcgcauuucagguccaacaggccguugaucugcgacgucacacagcuagaaaguccucuauuaaagcagccgugcccggcaauacuucaacgccuaguugucagagcaccaacgggcagccacaaaggggagcuugcggccgguggcgcgguagauccaggucucggcgcgccgcgacaucgcgacccgaaagaguauggccugacggggugauaccauucgucaucggaggcaauuuuacuggcucacagagggcaguguuccggcaggccaugcgucauugggagaagcacaccuguguuacauuucucgagcgcaccgaugaagacagcuauauuguguucacuuacagaccgugcggguguugcaguuaugucggaaggcgggguggcgggccccaggcuaucuccauuggaaagaacugugauaaguuuggcaucgugguacaugaguuaggucacguugugggguucuggcaugaacacacacgaccugaccgcgacagacacgucucuauagugagggagaauauccaaccaggacaggaguacaacuuucugaagauggaaccccaggagguggaaagccuuggcgagaccuaugauuucgacuccauuaugcauuacgcccggaauacguuuucacgcggcaucuucuuggauacuauugucccuaaauacgaaguuaacggggugaagccacccaucggacagagaaccaggcugaguaaaggugacauagcacaagcucguaagcuauauaaaugcccggccuguggcgagacacuccaggauagcacugggaauuuuucuuccccugaguaccccaacggauauucagcgcacaugcauugcguauggcggauuagcgugaccccaggcgaaaagaucauucugaauuucacaagucuugaccuguaccgaucuagauuguguugguaugauuacgucgaggugagggacgguuucuggcgcaaggccccucuccgggggagauuuugcggcuccaaacugcccgaaccaaucguuagcaccgauucgagguuauggguggaguuccgaucuuccucaaacugggucggaaagggcuuuuucgcaguguaugaagcuaucugcgggggagacguuaaaaaggauuacggucacauucagagucccaauuacccugacgacuaucgcccaagcaaaguauguauauggcggauccaaguguccgagggcuuucacgucgggcugacguuccagucuuuugagauugaacgucaugauagcugcgccuacgacuaucucgaggugagagauggacacucagaaaguuccacucuuaucggcagguacugugguuaugagaagccggacgauauaaaaagcacaucuucacgccugugguugaaguucgucagugacgggagcauuaacaaggcuggcuuugccgugaauuucuuuaaagaaguugaugagugcucccggcccaacagaggaggcugugagcagaggugccuaaacacccuggggucuuacaaguguucgugcgacccuggauaugaacucgcaccagauaaacgacgcugugaggccgcuugcgguggcuuccugacuaaacuuaaugggagcaucacaucccccggauggccuaaagaauacccacccaacaagaauuguaucuggcagcugguggcgccgacccaauaccggauuucauugcaguuugacuucuucgagacggagggcaacgauguaugcaaguaugacuuugucgaagugagaaguggucucaccgcagauucuaaacugcaugggaaguucugcggcagcgagaaaccugaaguuaucacaucccaguacaauaacaugaggguggaguuuaagucagacaauacugucagcaaaaagggauucaaggcccacuuuuucucugacaaagaugaauguuccaaggacaacggcgggugccagcaagauugugugaauaccuuuggaaguuaugagugccagugucguagcggcuucguauuacaugacaacaaacacgauugcaaggaggcugguugugaccacaaagugacaucuacuuccgggaccauuacaucaccaaauuggcccgauaaguacccuaguaagaaagaaugcaccugggccauaagcucgacucccggacaucgcguuaagcugacguuuauggagauggacaucgaaucccagccagagugugcauaugaucaccuagaagucuucgacggccgggaugccaaagcuccugugcucgguagauuuugcggcucuaagaaacccgagccagugcuggccacagggagcaggauguuccuucgauuuuacucagacaacaguguccagcggaagggauuccaagcaucccaugcgaccgaguguggcgggcagguucgcgcugaugugaaaacuaaggacuuguauucucacgcccaguucggagacaauaacuacccgggcgguguggauugcgaauggguaauugucgcagaggaaggguacggaguggagcugguuuuucagaccuucgaaguggaggaggaaacagacugcggcuaugauuacauggagcucuuugacgguuaugauagcaccgccccuagacugggcagguacuguggguccggacccccagaagaggucuauucagcuggcgacagcgugcuuguuaaguuccacagugaugacacuaucacgaaaaagggguuucaucugcgguacacaucuaccaaauuccaagauacuuugcacucccgaaaguga

SEQ ID NO: 442 - RNA, 1191 nt, Artificial Sequence
  derived and/or modified CDS sequence (opt3) from Homo sapiens__NP_001191.1__HsBMP2
augguggccggcaccagaugccugcucgcuuugcuguugccccaggucuuacugggaggggcagccggucuaguuccugagcucggcaggcggaaguucgcggcugccagcuccgggcgcccaucuucacaaccgagugacgaagugcugagcgaguuugaacuucgacuguuguccauguucggacucaaacagcgucccacaccuucuagagaugcaguagugccacccuacaugcuggaccuguauaggcggcacucgggccagccugguucaccagcccccgaucaucgccucgagagagcugcaagcagggccaacacuguccggaguuuucaccaugaagaguccuuagaggaacugccugagacgucugggaagaccacacgccgauucuuuuucaaucuuagcuccaucccaacugaagaguuuauuaccucagcugagcuucagguguucagagaacaaaugcaggacgcccugggaaacaauaguagcuuucaccauaggauaaacaucuacgagauuaucaaaccggcgacagcaaauucuaaguuccccguuacccggcuacucgauacucgucuggugaaccagaaugccucccgcugggaaucauuugacgucaccccugcugugaugagauggacagcccagggccacgcaaaccacggcuucguaguugagguggcucaucuugaagagaaacaaggggucagcaagaggcacgugcggauuagucgaucucugcaucaggaugagcacuccuggagccagauccgcccauugcucgugacguuuggacacgacgguaagggccauccccugcacaaaagagaaaagaggcaggccaaacauaagcaacggaaacgcuuaaagucgucuuguaagagacacccucuguaugucgauuucuccgacguuggguggaaugauuggauaguggcgccacccggauaccaugccuucuauugccacggcgaguguccguuuccucucgcagaccaccuuaacucaacuaaucaugcuaucguacagacccuggugaacagugucaauagcaaaauucccaaggccugcugugugccaacagaauuguccgcuaucucuaugcuauaccuggaugagaacgaaaaaguugugcucaagaauuaucaggacauggucguggaggguugcggguguagguga

SEQ ID NO: 443 - RNA, 1227 nt, Artificial Sequence
  derived and/or modified CDS sequence (opt3) from Homo sapiens__NP_001193.2__HsBMP4
augauccccggcaacagaaugcugauggugguccuccuuugccagguucuguuagggggagccagccacgcuuccuugauuccugagaccgguaagaaaaagguggcagaaauacaaggccaugccgggggaaggcggucuggccagucacacgagcugcuacgcgacuucgaagcgacacuccugcagauguuuggucuucgacguagaccacagccgaguaaaagcgcuguaauccccgauuacaugagggaccuguaucgguugcaauccggggaggaagaggaggaacagauucauucuacuggacucgaguacccugaacgcccagccucgagagcaaauacggugaggucauuccaccaugaggagcaccuggaaaacauccccggcaccagcgagaauagugccuuucgguuccuguuuaaccucuccucuauuccugaaaaugaggucaucagcuccgcugaauuacgccuguuccgagaacagguggaucagggcccagacugggagagaggguuucacaggauaaacaucuaugagguuaugaagcccccugcagagguggucccaggacaucuuauuacacgguugcuggauacucgucuagugcaccauaauguaacccgcugggaaacauucgacguuucaccggccgugcucagauggaccagggagaaacaacccaacuacggucuggcuaucgaagucacucaccuucaccagacacggacccaucagggccagcacgugcgaauuagucgcagccugccucaagggucuggaaauugggcccaguugagaccacuccuggugacguuuggccaugaugguagggggcacgcguuaacucggcgcagaagggcaaagcguucccccaagcaucacucacagcgggcccgaaagaaaaacaaaaauuguagaaggcacagccuguaugucgacuucagugauguuggauggaacgacuggaucguggcuccuccaggcuaccaagccuuuuauugccauggcgauugucccuucccgcucgcagaccaccuuaauucuaccaaccaugcuauaguacagacacuggucaauuccgugaacagcucgauuccuaaggccugcugugugcccacugaguugucugcgaucuccaugcuauaccuggaugaguacgacaaaguugugcucaagaacuaucaggaaauggucguggaggggugcggaugucgcuga

SEQ ID NO: 444 - RNA, 1542 nt, Artificial Sequence
  derived and/or modified CDS sequence (opt3) from Homo sapiens__NP_001709.1__HsBMP6
augcccggccuagggagaagggcccaguggcucugcuggugguggggacuucuguguagcugcugugguccuccaccguugcggcccccuuuaccagcugcagccgcggcugccgcaggcgggcaacugcuaggagacggcgguucccccgggcgcaccgagcagccuccacccucuccucagucaaguagcggauuccucuaccgacgucugaagacacaggagaaaagagaaaugcaaaaggaaauccuuuccgugcugggcuugccacacaggccgcggccccuccauggccugcagcagccucagccacccgcccugcgccaacaggaggaacagcagcaacagcagcaacucccuagaggggagccacccccgggaagguuaaaaucugcuccucuguuuaugcuugauuuguauaacgcacugucggccgacaaugaugaggacggugcuucagaaggcgagcggcagcagagcuggccccacgaagccgcgaguuccucucagcgccgacaaccaccucccggggcagcccauccacuaaacagaaagagccuccuggcucccggauccggcucagguggggccaguccucuuacuagcgcacaggauucugcuuuccugaaugacgccgauauggucauguccuuuguuaacuugguggaguacgacaaagaguucucaccaaggcagcggcaccauaaggaauuuaaguucaaucucagccagauuccggagggagaaguagugacggcggccgaguuucguauauauaaagauugcgucaugggcaguuucaagaaccaaaccuuucugaucucuauuuaccagguguuacaggaacaccagcaccgcgacuccgaucuguuccuccuugacacaagaguugugugggcaagcgaggagggcuggcuggaauuugauaucacugcuaccucgaauuugugggucgugacaccccaacauaacauggggcuacagcugucuguaguuaccagggacggagugcacguccauccucgggccgcuggucucgugggccgagacgggccauaugauaaacagcccuucaugguggccuuuuucaaggucuccgagguucacgugcgcacuacaagaucagcaaguagcaggcggcgccagcaauccagaaauaggucuacccagagccaggacguagcccgugugucaagugcuuccgauuacaacagcucugaacugaaaacggcgugucggaagcacgagcuuuaugucucauuccaagaccugggauggcaggauuggauuaucgcaccuaagggcuacgccgcuaauuacugcgacggugaauguaguuuuccauugaacgcccauaugaaugcaacuaaccacgccauagugcagacccucguucaucugaugaaucccgaguaugugccgaaaccuugcugugcuccaacaaaguuaaacgccaucagcguccuguacuucgaugacaacuccaaugugauucugaaaaaguaucgaaacaugguaguuagagcaugcgggugucacuga

SEQ ID NO: 445 - RNA, 1296 nt, Artificial Sequence
  derived and/or modified CDS sequence (opt3) from Homo sapiens__NP_001710.1__HsBMP7
augcacgugagaagccugagggccgcugcaccccauuccuucgucgcccucugggcgccucuuuuucuguugcggucugcuuuagccgacuucucacuggauaacgagguucacaguagcuuuauccaucgccgacuacguucccaggaaagaagggagaugcaacgggaaauucucucuauacugggccuuccacaccgcccgagaccccaucugcaggggaagcacaauucggcaccuauguucauguuggaccucuacaacgccauggcuguggaggaaggagguggcccagggggacagggcuuuucauaucccuacaaagcaguauucagcacccaggguccuccacuggccagucugcaagauucccacuuucucacagacgcugauauggugaugucuuucgucaauuuaguggagcaugacaaggaguuuuuccaccccagguaucaucaccgggaauuucgcuucgaucugagcaaaaucccugagggggaagccguuacugcggcagaguuucgaauuuacaaggacuauaucagagagagguucgauaacgaaacguuccggauuuccguguaccagguccuucaggagcacuugggacgugaaucagaccuguuucuacucgauagucgcacccugugggccagcgaggaaggcuggcuuguguucgacaucacagcuacuucuaaucauuggguaguuaacccaagacacaaucugggcuugcagcucuccguggagacccuggaugggcaaucaauaaacccgaaauuagccggacugaucgguaggcauggcccccagaauaagcagccuuuuauggucgcauucuuuaaggcuacagaggugcacuuccggagcauucgaaguaccgggucuaaacagcgcucccaaaacagaagcaagacucccaaaaaucaggaagcccucaggauggcgaacguggccgaaaauucgucuuccgaccagcggcaagcaugcaagaaacaugagcuuuaugucucauuucgcgaccugggauggcaggauuggaucauugcuccagagggcuacgccgcuuacuauugugaaggugagugcgccuucccuuugaacaguuacaugaaugcaacaaaccacgccaucguucagacccuagugcacuuuauaaacccagagacgguacccaagccguguugcgcuccuacucagcugaaugcgauuagcgugcucuauuucgacgauuccucuaacgucauccugaagaaauacagaaauauggugguuagggcaugugggugccauuga

SEQ ID NO: 446 - RNA, 300 nt, Artificial Sequence
  derived and/or modified CDS sequence (opt3) from Homo sapiens__NP_006264.2__HsCCL7
augaaggccagcgcugcacugcucugccuucuguugaccgccgcggcuuucucuccccagggcuuagcccaaccuguggggaucaacacauccacuacguguugcuacagauuuauuaauaaaaagauaccaaaacagaggcuggagucauaucggcgcaccacaaguagccacuguccgcgagaagcagucaucuucaagacuaaacuagacaaggagauuugcgccgaucccacccagaaguggguucaggacuuuaugaaacaucucgauaagaaaacacaaaccccuaagcuguga

SEQ ID NO: 447 - RNA, 3624 nt, Artificial Sequence
  derived and/or modified CDS sequence (opt3) from Homo sapiens__NP_001954.2__HsEGF
augcugcucacccuuaucauucuguugcccguggucagcaaguucuccuuuguuucuuuaucagccccucagcacuggaguugcccagagggcacacuggcugggaacggaaauagcacuuguguggguccggcacccuuccuaauauuuucccauggcaacucuaucuucagaauugacacggaagggaccaauuacgagcaacucguaguggacgccggagucucggugaucauggacuuucacuauaacgaaaagaggauuuacuggguugaucuggagcggcagcuucugcagcgcguguucuugaauggcucacgacaggaacgugucugcaacaucgagaagaaugugagcgguauggcgauaaacuggaucaaugaggaaguaauuuggaguaaccaacaggaggggaucauuacaguuacugacaugaaaggaaauaacucccauauccuccugucugcucugaaguauccugccaauguggcagucgauccaguggaaagauuuauauucuggagcuccgagguggccggcucacucuacagggcugacuuagauggcgucgggguuaaagcacugcuugagaccagugaaaagauuacagccgugagcuuggacguacuggauaagcggcuauuuuggauccaguauaaccgcgagggaucuaauucccucauuuguucaugcgacuacgaugguggcagcgugcacaucaguaaacaucccacccagcacaaccuguucgcuaugucucuuuuuggggacagaaucuucuauuccacuuggaagaugaaaacaauuuggauagccaacaagcacaccggaaaagauauggucaggaucaaucugcauagcucguuugugccuuugggcgaacucaagguugugcacccacuggcgcaacccaaggcagaggacgacacgugggaaccugagcagaaauuauguaagcugcggaaagguaacugcucauccacugucugugggcaggaucuccagucacaucuuugcaugugugccgagggauacgcucugagucgcgaccgaaaguacugcgaagaugugaaugagugugccuucuggaaccacggcugcaccuugggcugcaaaaauacaccagggagcuauuacuguacuugcccgguaggauucguucuacugcccgacgguaagagaugucaccaacucguguccugcccuaggaacgucucugaauguagccaugauugcgugcugaccucagagggcccacuuuguuuuugccccgaagggaguguccuggagcgggacggaaaaacauguuccggcugcagcucuccugauaaugguggguguucacaguugugcgugccacucagucccguuagcugggagugcgacuguuucccgggcuaugaucugcaguuagacgaaaaguccugcgcagcuucuggaccucaacccuuucugcuauucgccaacucgcaggauauucgucacaugcauuuugacggcaccgacuacgggacgcuccugagccagcagaugggaaugguguaugcgcuugaucacgacccaguagagaauaagaucuacuucgcccauacugcauugaaauggauagaacgcgcuaacauggaugguucccaaagagagaggcugauugaagagggcgucgacgugccugaggggcucgccguugauuggaucggacggcgauuuuauuggacagaccgcggcaagucacugaucgguagaagugaucuuaaugggaaaaggucuaagauuaucaccaaagaaaacauuagccagccccggggcauagcugugcacccaauggccaagcgccuguucuggacugacacaggaaucaaucccagaauugaguccucuagcuugcagggccucgggaggcuggucaucgcaucuuccgauuuaaucuggccuaguggaauuaccauagacuuucugacggauaagcuauacuggugugacgccaaacagagcgugaucgaaauggcuaaccucgaugguucuaagcgucggcgacugacccaaaaugacguaggccacccauucgcgguggcaguuuuugaggacuacgucugguucuccgauugggccaugccgucagugaugagagugaacaaaaggacagggaaggaccgcguccggcuucagggaaguauguugaaacccagcucgcugguuguggugcauccucucgcuaagccaggcgccgaucccugccuguaucagaacggugggugugagcacauuugcaagaaaagauuaggcacugcaugguguuccugcagggaaggauuuaugaaggccucugacggcaaaaccugucuggcucuugaugggcaucaguugcucgccggaggcgagguagaccugaagaaucaagucacaccucuagauauccugagcaaaacucgcgugucagaagacaacauuaccgagagucagcacaugcucguugcagaaaucaugguguccgaucaggacgauugcgcgccagucgguuguucuauguacgcucgaugcauaagcgagggggaggacgccacaugccagugucugaagggauucgcaggcgaugguaaacuuugcuccgacaucgacgaaugugagaugggcgugcccguuugcccgccugccucaagcaaauguauuaauaccgaagggggauaugugugccgguguagugagggcuaccaaggggauggaauccacugcuuggacauugaugaaugucagcugggcgagcauucuugcggugagaacgcuuccuguacuaauacggaagggggauauacaugcaugugcgccggccguuuaagcgagccaggucucaucugucccgacucgaccccucccccacaccugagagaagaugaccaucacuacucaguaaggaacucugauagugagugcccucuuucccaugacggcuauugucugcacgauggggucugcauguacauagaagcauuggacaaguacgcuuguaauugcguggugggauauauuggcgagcgcugucaguaccgggaucucaaauggugggagcugagacacgccgggcauggacaacagcagaaggucaucguuguggcgguaugcguggucgugcuaguuaugcugcuccugcuuagcuuguggggcgcccacuauuacaggacucagaaacuguuaucuaagaaccccaaaaauccauaugaagagagcucccgagacgugcgcucacggagaccggcugacaccgaagaugguaugaguagcuguccucaacccugguucgucgugauuaaggagcaucaggaccucaagaacgggggacagccaguugcaggcgaggauggucaggccgcugacggcucuaugcaacccacauccuggaggcaggaaccucagcugugcgggaugggaaccgagcagggcuguuggaucccagugucaagugauaaagggagcugcccccaagucauggaacguuccuuucacaugccuucuuacggaacucagacacuugagggcgguguagaaaagccgcauucgcugcuaagcgccaauccacucuggcagcaacgcgcacuggaucccccucaccagauggaguugacgcaguga

SEQ ID NO: 448 - RNA, 510 nt, Artificial Sequence
  derived and/or modified CDS sequence (opt3) from Homo sapiens__NP_001423.1__HsEREG
augaccgccggcagaaggauggagaugcugugcgcugggcgggugcccgcacuccuucuguguuugggauuccacuuacugcaggccguccuaagcacaacuguuaucccuuccugcauuccaggugaaucuucagacaacuguacggcgcucgugcaaaccgaggauaauccgcgcguagcucaggugaguauaacaaagugcagcuccgacaugaacggcuacugucugcaugggcagugcaucuaucuugucgauaugucucagaauuacugucgaugcgaagugggauauacuggcguucguugugagcacuuuuuccugaccgugcaucaacccuugucgaaagaauacgucgcccucacagugauucugaucauucuguuucucaucaccguaguugguucaacuuauuacuucugcagaugguauaggaaccgcaagagcaaagagccuaagaaagaguacgaacgggugacaaguggggacccagaguuaccccaggucuga

SEQ ID NO: 449 - RNA, 468 nt, Artificial Sequence
  derived and/or modified CDS sequence (opt3) from Homo sapiens__NP_000791.1__HsFGF1
auggccgagggcgaaaucaccacauucacugcucugacggagaaguuuaaccuucccccugggaauuacaaaaagccaaaacuccuguauugcagcaacggaggucacuucuugagaauuuuaccggacggcaccguggaugggacaagggaccgguccgaucagcauauacaacugcagcuaucugcagaaucagucggagagguuuacaucaagaguacugaaaccggccaguaucucgccauggacacagauggucugcuuuacgggagccagacccccaaugaggagugucuguuuuuggaacgccucgaggaaaaccacuauaauacuuacauuuccaaaaagcaugcggagaagaacugguucgugggacugaaaaagaauggcucuugcaaacgaggcccucguacacacuaugggcaaaaggcuauccuguuucucccauuacccguaucgucagacuga

SEQ ID NO: 450 - RNA, 867 nt, Artificial Sequence
  derived and/or modified CDS sequence (opt3) from Homo sapiens__NP_001997.5__HsFGF2
auggugggcgucgggggaggugacguugaggaugugacccccagaccuggcgggugccagaucagcggaaggggcgcccgggguuguaacgggauuccaggagcugcagccugggaagcggcucugccgcgccgacgucccagaaggcacccuuccguaaauccacggucucgcgccgcaggcucacccagaacaaggggccggcgcacugaggaacgaccuagugggagcagacucggagacaggggucggggccgugcccuuccagggggacgccugggcgguagagggaggggacgggcucccgagcgagugggcggccgcgggagaggaagggguacggcagccccucgggcugccccagcggcacgcggcuccagaccggggcccgccggaaccauggcugccggcucuauaacaacuuugccugcauuaccagaagauggugggucgggcgcuuuucccccuggacauuucaaggacccaaaaaggcuguacugcaagaacggcggguucuuucuacguauccaccccgauggacgggucgacggugugcgagagaaaucagauccgcauauuaagcuccaacugcaggccgaggaaagaggcguugugagcaucaaaggggucugugcgaauagguaucuugccaugaaggaggacggacgccuguuggcaaguaagugcgugaccgaugaauguuucuuuuucgagcggcucgaguccaacaauuacaacacauauagaucuaggaaauacaccagcugguauguagcucugaagcgcacuggccaguacaaacuggguuccaagacagggccuggccagaaagccauucucuuuuuacccaugucagcuaagaguuga

SEQ ID NO: 451 - RNA, 585 nt, Artificial Sequence
  derived and/or modified CDS sequence (opt3) from Homo sapiens__NP_002000.1__HsFGF7
augcacaaguggauccugaccuggauucuccccacacuucuguacagaagcugcuuccauauaaucuguuuggugggcacuauuuccuuagccugcaacgacaugacgccugagcagauggcuaccaaugucaacuguucuucaccagaaaggcacacacggaguuaugauuacauggagggaggagacauccgcguucgacgucuguuuugcagaacucaaugguaucuaaggauugauaaacgggguaaggugaaaggcacccaggaaaugaagaauaacuacaauaucauggagauacgcacaguagcaguggggaucgucgccauuaaaggaguggaaagcgaguucuaucucgcgaugaacaaggagggcaagcuguacgcuaaaaaggaauguaaugaggacugcaacuuuaaagaacuuauccuggagaaucauuauaacaccuacgccuccgcaaaguggacucacaaugguggggagauguucguugccuugaaccagaaagggauuccggugagaggcaagaagaccaaaaaggaacagaaaacagcucauuuucuccccauggcaaucacguga

SEQ ID NO: 452 - RNA, 627 nt, Artificial Sequence
  derived and/or modified CDS sequence (opt3) from Homo sapiens__NP_001936.1__HsHBEGF
augaagcugcuccccagcgugguccuuaaacuguucuuggccgcuguuuuauccgcacuggugaccggcgagucucuagaaagacucaggcgggggcuggccgcgggaacaucaaacccugacccaccgacuguaaguacggaucagcuucugcccuuggguggcgggcgcgaccgaaaggugcgugaucuccaagaggcugaccuggaucugcucagagucaccuuaagcuccaaaccucaggcccuggcaacaccaaauaaggaggaacacggaaaaaggaagaagaaaggcaagggucuugggaaaaagcgggaccccugcuugcgcaaauacaaggauuuuuguauccauggagaaugcaaguaugugaaagagcugagagccccuucuuguauuugccacccaggcuaccauggcgagaggugucacgggcuaucgcuccccguugaaaaccggcuguauacuuacgaccauaccacaauacuugcuguggucgcagugguacugucaagcguuugcuugcucgugaucgucggacuguuaauguuccgcuaucaccgaagagguggcuacgauguggagaaugaagagaaggugaaacuggggaugaccaacagucacuga

SEQ ID NO: 453 - RNA, 2187 nt, Artificial Sequence
  derived and/or modified CDS sequence (opt3) from Homo sapiens__NP_000592.3__HsHGF
augugggugaccaagcugcuccccgcccuucuguugcagcacgucuuacugcaucuacuccugcuuccuaucgcuauuccauacgcagagggccaaagaaaaaggcggaacacaauacacgaguucaagaaaagcgccaagacuacgcugaucaaaauugacccggcguugaagaucaagaccaaaaagguuaauacagcugaucagugcgccaaccgcuguacucgaaauaaagggcuccccuuuaccugcaaggcauucguguuugacaaagcccguaagcagugucugugguucccuuuuaacuccaugucuucaggaguaaagaaagaguucggucaugaauuugaucuguaugagaauaaggacuacauuagaaacugcaucauaggcaaagggaggaguuauaagggaacagugagcaucaccaaauccggcauuaagugucagccauggucuucgaugaucccccacgaacauucauuccucccuagcaguuaccgggguaaagauuuacaagagaauuauugccgcaacccaagaggggaggaaggaggccccugguguuuuacuuccaauccugaggucagguacgaagugugcgacauuccacaguguucugagguugagugcaugacauguaacggcgaaagcuaucgggggcugauggaucacaccgaguccggaaagaucugccagcgcugggaccaccagacgccgcaucgacacaaguuccuucccgaaagauacccugauaaagguuuugacgauaauuacugcaggaacccagacggccaaccccggccuugguguuauacuuuggauccacauacccguugggaauacugcgcuauaaagacaugugcagacaauacuaugaacgacaccgaugugccccuggaaacaaccgagugcauucaggggcagggagagggcuaucgcgguacggucaauacuaucuggaacgggauuccgugucagagaugggacucacaauacccucacgaacacgauaugacacccgagaacuucaaaugcaaggaccuaagggaaaauuauugucggaacccagauggaagugagagcccuuggugcuuuaccacugaccccaauauccgagugggcuacuguucucagaucccaaacugcgauaugucccauggccaggacuguuaucgcgggaaugguaaaaacuacaugggaaaucucucacaaacaagaagcggccugaccugcaguaugugggauaagaacauggaagaccuucacaggcauauuuucugggagcccgaugccucuaagcugaaugagaacuacugccggaauccugacgacgaugcucacgggccaugguguuauacgggaaacccguugauacccugggacuacugcccuaucucccgcugugaaggcgauaccacaccaacuauuguaaaucucgaccaucccguuaucagcugcgccaaaaccaagcagcugagaguggucaacgguauaccuacaaggacuaauauuggguggauggugucguuacguuaucggaacaaacacaucuguggcggaucucugaucaaggaguccugggugcucaccgcgcgacagugcuucccaucaagagaucuuaaagacuacgaagcauggcugggcauucacgauguccaugggaggggagacgagaaguguaagcagguuuugaacgugagucagcuaguauauggucccgaaggcagcgaucuggugcucaugaaacuggcccgcccggcuguccuugacgauuuuguguccacaaucgaccugccuaauuacgggugcaccauuccagagaagacuucuuguagcguuuauggauggggcuacacggguuugauaaacuacgaugggcuccugcggguggcccacuuauauaucaugggcaaugagaaaugcucacaacaucacagaggaaaggucacacugaacgaaagugagauuugugcaggcgcugagaaaaucggguccggacccugcgaaggugacuacggcgggccucuagugugcgagcagcacaagaugaggaugguacucggaguuaucgugcccggccgcgguugugccauuccaaaucgaccugggauauucguccggguggcguauuacgccaaguggauccauaaaauuauccugaccuauaaggucccccagagcuga

SEQ ID NO: 454 - RNA, 1926 nt, Artificial Sequence
  derived and/or modified CDS sequence (opt3) from Homo sapiens__NP_005336.3 __HsHSPA1A
auggccaaggcugcagccaucggcauugaccuggggaccacauacagcugcgugggagucuuccagcacgguaaaguugagauaaucgcgaacgaucaaggcaauagaacuacgcccuccuauguggcuuuuaccgacacagaaaggcucauuggggaugccgcaaagaaccagguagcccuuaauccucagaacacuguguucgacgcuaaacggcugaucggacgcaaguuuggcgauccagucgugcagucugacaugaaacauuggccguuccaaguuauuaaugauggugacaagcccaaggugcaggucucauacaaaggggagaccaaggcauuuuauccugaagagaucaguagcaugguguugacaaaaaugaaggaaauagccgaggcuuacuuaggauauccaguaaccaacgccguuaucacugugcccgcguacuucaaugauucccagcgacaggcaacaaaagacgccggcgucauugcuggccugaacgugcuacguaucauuaaugagccuaccgccgcagcuaucgccuaugggcucgauagaacgggaaagggugaaaggaacgugcugauauuugaccuuggcgggggaacuuucgaugucucuauucugaccaucgacgacggcauuuuugagguuaaggcgacagccggugauacucaccuugggggagaagacuucgauaaucggcucgugaaccauuuuguagaggaguucaaacgcaagcacaaaaaggacaucucgcaaaauaaaagagcagugaggcggcugcgcaccgcuugugaacgagccaagagaacacugucaagcaguacccaggcuucccucgagaucgauucuuuauuugaaggcauugacuucuacacgagcauaacuagggcccgguucgaggaacugugcuccgaucuuuuucguucaacauuggagccagucgagaaagcacugcgcgacgccaagcuagauaaggcucagauccaugaccucgugcugguuggcgggaguacccggauucccaaagugcagaaguugcugcaagauuucuuuaacggaagggacuugaauaaaagcaucaacccugacgaagcggucgcauacggugccgcugugcaggccgcaauacucaugggcgauaagucugagaacguacaggaccuguuacugcucgauguugccccacuuucccugggguuggaaacugcuggaggcgugaugacagcccuaauuaaaagaaauucaaccaucccgacgaagcaaacccagaucuucacaacuuauagcgacaaccagcccgguguccugauucagguguacgagggggaacgagcaaugaccaaggauaauaaccuccugggccgcuuugagcuuaguggaaucccuccagcgcccagaggcgucccucaaauugaggugacauucgacauagaugcuaaugggauccugaacguuacugccaccgacaaaucuacaggaaaggcaaauaaaauuaccaucacuaacgauaaggguagguuguccaaagaagagaucgaacggauggugcaggaggccgaaaaguauaaggcugaggacgagguacagcgcgaaagagucagcgccaaaaaugcacucgagucguacgcuuuuaacaugaagucugccguggaagaugagggccugaaagggaagauuuccgaggcggacaaaaagaagguuuuagauaaaugucaggaagugauaucauggcuggacgccaauacgcuagcugagaaggacgaguucgaacacaaaaggaaggaacucgagcaagucugcaacccaaucauuaguggacuguaucagggcgccggugggcccggcccgggaggcuuuggggcacagggaccuaaagguggcagcggguccggacccacaaucgaggaaguggauuga

SEQ ID NO: 455 - RNA, 1926 nt, Artificial Sequence; identical to SEQ ID NO: 454
  derived and/or modified CDS sequence (opt3) from Homo sapiens__NP_005337.2 __HsHSPA1B

SEQ ID NO: 456 - RNA, 1926 nt, Artificial Sequence
  derived and/or modified CDS sequence (opt3) from Homo sapiens__NP_005518.3 __HsHSPA1L
auggccaccgcuaagggcaucgcaauugggauagaccugggaacaacuuacagcugcgugggugucuuccagcacggcaaaguugagaucauugccaacgaucaagggaauagaacgacccccuccuauguggcguuuacagacacugaaaggcucaucggagaugcugccaagaaccagguagcaaugaauccucagaacaccguguucgacgccaaacggcuuauuggccgcaaguuuaaugauccagucgugcaggcugacaugaaacuguggccguuccaaguuaucaacgagggugggaagcccaagguguuggucucuuacaaaggagaaaauaaggcauuuuauccugaggaaauaucaaguaugguguuaacaaaacugaaggagaccgccgaggcuuuccuaggccauccaguaacuaacgccguuaucacagugcccgcguacuuuaaugauagccagcgacaggcaaccaaagacgccggcgucauugcugggcucaacgugcugcguaucauuaaugaaccuacggccgcagcuaucgccuauggacuugauaaggguggccagggggagagacacgugcugauauucgacuugggaggcgguacuuuugaugucuccauucucaccaucgacgaugggauuuucgaaguuaaggcgacagccggagacacucaucugggcggcgaggacuuugauaacaggcuggugucucacuucguagaggaauuuaaacggaagcauaaaaaggacaucucgcaaaauaaacgcgcagugagaaggcuccggaccgcuugugagcgcgccaagcgaacauuaucaagcaguacccaggcuaaccuggaaaucgauucccuuuacgaggggauugacuucuauacgucuauaacuagagccagguucgaagaguugugcgcagaucuguuucggggaacacuagagccagucgaaaaagcccuccgugacgcuaagauggauaaggcgaaaauccacgacauugugcugguugguggcagcacccgcauccccaaggugcagagacuucugcaggauuacuucaaugggagggacuugaacaaauccauaaacccugaugaggcagucgccuacggagcugccgugcaagcagccauucucaugggcgacaagucagaaaaaguacaggaccuguuacugcucgauguugcuccacuuagucuggguuuggagacugccgggggcgugaugacagcacuaaucaagcggaauagcaccaucccgacgaagcagacccaaauuuuuacaacuuauucugacaaccagcccggaguccugauccagguguacgaaggcgagcgagcgaugaccaaagauaauaaccuccuggggcgcuucgaccuuacagggauuccuccagcucccagaggugucccucagauagaggugacuuuugauaucgacgccaauggcauucugaacguuaccgcaacagauaaguccaccgggaaagugaauaagaucacuaucacgaacgacaaaggaagguugucaaaggaagagauugaacggaugguacucgaugccgagaaguauaaagcugaagacgagguccaacgcgagaagauagccgcuaaaaaugcacuggaaagcuacgccuucaacaugaagagugugguuucugaugagggcuuaaaagguaagaucuccgaaagcgacaagaauaaaauucuggauaaguguaacgagcuacucucguggcuggaggugaaucagcuugcggaaaaagacgaguuugaccacaagagaaaagaauuggagcagaugugcaacccaaucauuacaaagcuguaucagggaggcuguaccggacccgccugcggcacuggguacgucccgggaaggccugcuaccggucccacaaucgaagagguggauuga

SEQ ID NO: 457 - RNA, 1920 nt, Artificial Sequence
  derived and/or modified CDS sequence (opt3) from Homo sapiens__NP_068814.2 __HsHSPA2
augagcgccagaggccccgcuaucgggauugaccugggaaccacauacuccugcgugggugucuuccagcacggcaagguugagauaaucgcaaacgaucaagggaauaggacuacgccuucuuauguggccuuuaccgacacagaacggcucauuggagaugcggcuaaaaaccagguagccaugaauccaacuaacaccaucuucgacgcaaagcgccuuauuggccgaaaauuugaggaugccacagugcagucagacaugaagcauuggccguuccgugucgugagugaaggugggaaacccaagguucagguggaguacaagggagaaaccaaaacauuuuucccugaggagaucagcuccaugguccugacuaagaugaaagaaauagcugaggcauauuugggcggcaaggugcacucugccguaaucaccguuccagcuuacuuuaaugauucgcaaagacaggccacgaaagacgcggggacuauuaccggauuaaacgugcugaggaucauuaaugaacccacagcagccgcuaucgccuauggucuagauaagaagggcugugcagggggagagaaaaacguccucauauucgaccugggcggugggacuuuugaugugucaauucuuaccaucgaggacggaauuuucgaagucaagagcacagcuggcgauacccaucugggcggggaggacuuugacaaucggauggugagucacuuggccgaagaguucaaacgcaagcauaaaaaggauaucggaccuaacaaaagagcgguuaggcggcuccgcacggccugcgaacgagcaaagagaacucuguccucuagcacacaggcuuccaucgagauugacucacuguacgaggguguggauuuuuauaccaguauaacuagggcccgguucgaggaacucaaugcugacuuauuccguggcacacuggaaccaguagagaaggcccuucgcgaugcaaaauuggacaaggggcagauccaagaaauugugcuggucggaggcagcaccagaauccccaaaauacagaagcuacuccaggacuuuuucaacgguaaagagcugaauaagucuauuaacccugaugaggccguggcuuacggggcggcaguucaggccgcuauccuuaucggcgauaaguccgaaaaugugcaagaccuguugcuccuggaugucacgccauuaucacugggaauugagaccgccggcggggugaugacaccgcucaucaaaaggaacacuaccauucccacaaagcagacucagaccuuuacaaccuacagcgacaaccaaaguucuguacuuguucagguguaugaaggagagcgggcaaugacuaaagacaauaaccuguuggguaaguucgaucuaacgggcauaccuccagcuccccgaggggucccucagaucgaagugacauuugacauugaugccaauggaauccugaacgucaccgccgcagacaaauccacuggcaaggagaauaagaucaccauuacaaacgauaaaggucgccucagcaaggacgauauagacagaauggugcaggaggcggaaagguacaaaucggaggaugaagcuaaucgggaccgcguugccgcaaagaacgcccuggagucuuauaccuacaauaucaaacaaacuguggaggaugaaaaacuuagagggaagauuuccgagcaggacaagaacaagauccuggauaaaugucaggaaguaauuaauugguuggacaggaaccagauggcugagaaggacgaauaugagcacaaacaaaaggagcucgaacgugucugcaauccaaucauaucaaaacuguaccagggcggacccggcgggggaagugguggcgggggaagcggcgccuccggugggccgacaaucgaggaaguggauuga

SEQ ID NO: 458 - RNA, 2523 nt, Artificial Sequence
  derived and/or modified CDS sequence (opt3) from Homo sapiens__NP_002145.3 __HsHSPA4
augagcguggucggcaucgaccugggguuccaguccugcuacguugccguggcuagagcaggagguauugagaccauagccaacgaauauucugauagguguacacccgcgugcaucucauuuggcccuaagaaucggaguauuggggcugccgcaaaaagccaaguaaucuccaacgccaagaauacugugcagggauucaaacgcuuucacggccgagcuuucucugacccauuugucgaggcagaaaagucgaaccucgccuacgauauugugcagcuuccgacgggucugaccgggaucaaaguuacauauauggaggaagaacguaauuucacuaccgaacaggugacagcuauguuguuaucaaagcugaaggaaaccgccgagagcguccucaaaaagcccgugguagacuguguugugagugucccuugcuuuuacacugaugcggaaagaagguccgugauggacgcaacacaaauagccggacuaaacugucugcggcuuaugaaugagaccacggcuguggcccuggcauauggcaucuacaaacaggauuugccagcucucgaggaaaagccccgcaacgucguuuucguggacaugggccauucugccuaucagguaagcgugugcgcguuuaauagagggaaacugaagguccuggccacugcauucgauaccacacucggagguaggaaguuugacgagguguuaguuaaccacuucugugaagaguuuggcaaaaaguacaaacuggauauuaaguccaaaauccgggcucuuuugcgccugucacaggaaugcgagaagcucaaaaagcuaaugagugccaaugcuagcgaccugccucuuucuauugaguguuucaugaacgauguggacgucuccgggacuaugaaucgaggaaaguuccuggaaaugugcaacgacuugcucgccagaguggagccaccccugaggucaguauuagaacaaaccaaacugaagaaagaggauaucuacgcaguugaaauagugggcggugccacacggauuccugcugucaaggagaaaaucagcaaguuuuucgggaaggagcucaguaccacgcuuaaugcggacgaagcagugacucguggaugugcccugcagugcgcuauuuugucuccagccuuuaaaguccgcgaguucuccaucacagaugugguuccguaucccaucagccuaagauggaacucgccugcagaagaggggucuuccgacugcgaaguguuuucaaagaaccaugccgcuccauucaguaaaguacugaccuuuuacaggaaggagcccuucacucucgaggccuauuacagcuccccucaggaucugccauaucccgacccggcaauugcgcaguuuucuguccaaaaagugacaccucagagcgauggcucaaguuccaagguuaaggugaaaguccgggugaauguacacggcauauucagcgugucuucagcuagucuuguugaaguccauaagagcgaggaaaacgaggagcccauggaaaccgaccagaaugccaaagaggaagagaagaugcaaguggaucaggaggagccacacguggaggaacagcagcaacagacgccugcagagaacaaagccgaauccgaggaaauggagaccucucaggcuggaucgaaggacaagaaaauggaucagcccccacaagccaagaaagcaaaggucaaaacaagcacuguugaccugcccaucgagaaucaguugcucuggcagauugaccgagaaaugcugaacuuauacaucgagaaugaagguaagaugauaaugcaggauaaacuggagaaggaacgcaacgacgcuaagaaugccguggaggaguauguguacgaaaugagagauaaacuauccggcgaguacgaaaaguuuguaucagaggacgauaggaacaguuucacccucaaacuggaggacacagaaaauuggcuuuaugaggauggggaagaccaaccuaagcaggucuacguggauaaauuggcggagcugaagaaccucggacagccaauuaagauccgguuucaggaaucugaggagcgcccgaaacuguucgaggagcuuggcaagcaaauccagcaguauaugaaaauuaucagcuccuucaagaauaaagaagaccaauacgaucaccuggacgccgcugauaugacuaagguugagaagucaaccaacgaagcaauggaguggaugaauaacaaauugaaccuccagaauaagcagagccugacaauggaccccguggucaaaucuaaggagauugaagccaaaauaaaggaguuaaccuccacuuguaguccuaucauuagcaagccaaaacccaagguggaaccuccaaaagaggaacagaagaacgcugagcaaaauggucccguugacgggcagggcgauaacccgggaccucaggccgcagagcagggcacggacacagcggugccaucugauuccgacaaaaagcugcccgaaauggauaucgacuga

SEQ ID NO: 459 - RNA, 2520 nt, Artificial Sequence
  derived and/or modified CDS sequence (opt3) from Homo sapiens__NP_055093.2 __HsHSPA4L
augagcguggucggcaucgaccugggguuccucaacugcuacauugccguugcuagauccggagguauagagaccaucgcaaaugaauauucugauagguguacacccgccugcauuucacuuggcagucggacucgcgcgaucgggaacgcugccaagagccagauugugacgaauguacgaaacaccauccacggauuuaaaaagcugcauggccguuccuucgacgauccuauagugcaaacagagagaaucagguugccauacgaauuacagaaaaugccgaaugguucugcaggggucaaggugcgguaucuggaggaagagagacccuuugccauugagcagguuacuggaaugcuacucgcuaaacugaaggaaaccucggagaacgcacuuaagaaaccuguggccgacugugucaucucaauucccagcuucuuuacagaugcugaaagaaggagugugauggccgcggcacagguagccggccugaauugcuugcggcucaugaacgagaccacugcuguugcccuggcauacggcaucuauaagcaagaccugccaccucucgaugagaaaccacgcaauguggucuucauagacauggggcacuccgcuuaccagguguuagugugugccuuuaacaagggaaaacugaagguccuugcgacaaccuucgaucccuauuuggguggccgaaauuuugacgaagcccugguugauuacuucugcgacgaguuuaagacgaaauacaagauuaacgugaaagaaaauucuagagcacuacucaggcuguaucaggagugugaaaaacuuaagaagcugaugagcgcuaacgccuccgauuugccucucaauaucgagugcuucaugaacgaccuggacguaucaaguaaaaugaaccgggcucaguuugagcaauuaugugccagccugcucgcacguguggaaccaccgcuuaaggccgucauggagcaggcuaaucugcagcgcgaagauauuucuuccaucgagaucguugggggagcgacucgcauucccgcagugaaggaacagauaaccaaauucuucuugaaggacaucucaacaacucuaaacgccgaugaggcuguggccaggggcugcgcacugcaaugugccauucucagcccugcuuuuaaaguccgggaguucaguaucaccgaccuggugccauacucuauaacacuucgauggaagaccuccuuugaagaugguagcggggagugcgaaguauucugcaaaaaucaucccgccccuuuuucgaagguuauuacguuccacaagaaagagccauuugaacuggaggcauucuauacuaacuugcaugaggugcccuacccggacgcgcgcaucggaucuuuuacaauccagaaugucuucccucaguccgauggcgacucaaguaaggugaaagucaaggugagaguuaacauucacggcaucuuuagcguggcuuccgccucuguaauugaaaaacaaaaucucgagggggaucacagcgacgcacccauggaaaccgagacuucauucaagaacgagaauaaggauaacauggacaaaaugcaggucgaccaggaagagggacaucagaagugucacgccgaacauacaccagaggaagagauagaucacaccggugcuaaaacgaagagugccguguccgacaaacaagauaggcugaaucagaccuuaaagaagggcaaaguuaagagcaucgaccugccuauucagucuucacuaugccggcagcucgggcaagaucugcuuaacaguuauaucgagaaugaaggaaaaaugaucaugcaggacaaguuggagaaagaacgcaacgaugcaaagaaugcuguggaggaauacgucuaugacuuuagagauaggcugggcacaguguacgagaaauucauuacucccgaggaccucagcaagcuguccgccguacuugaagauaccgagaacuggcuguacgaagacggugaggaucagccaaaacagguguauguugacaaguugcaagaacucaagaaauacgggcagcccauacagaugaaguauauggagcacgaggaacguccuaaagcgcugaacgacuuaggcaagaagauccagcuggucaugaaagugauugaggccuaccggaauaaggaugaacgauaugaccaucuagauccaacagagauggagaaaguggaaaaguguaucucugacgcuaugucguggcucaacagcaaaaugaaugcacaaaacaagcugucccuuacucaggauccggucguuaaggugucagagauuguggccaaaaguaaggaauuggacaauuucugcaaccccaucauauacaaaccuaagccaaaagcugagguacccgaagauaagccuaaggccaauucugagcacaacggaccaauggacggccagagcgggaccgagacaaaauccgauucaaccaaggacagcucucaacauacuaaauccaguggagaaauggaggucgauuga

SEQ ID NO: 460 - RNA, 1965 nt, Artificial Sequence
  derived and/or modified CDS sequence (opt3) from Homo sapiens__NP_005338.1__HsHSPA5
augaagcugagccucguggccgcuaugcuucuguuguuauccgcagccagagcggaggaagaggacaaaaaggaagaugucggcaccguuguggggaucgaccugggaacaacuuacucuugcguagguguguucaaaaacggcagggucgagauuauagcuaaugaucaggggaaccggaucacgcccucauauguggccuuuaccccugaaggagagcgccuaauuggcgacgcagccaagaaucaacucacaaguaacccagagaauacuguuuucgaugcuaaacgacugaucggucguaccuggaacgacccgagcgugcagcaggauauuaaguuucuucccuucaaggucguggaaaagaagacaaaaccuuacauccagguagacauagggggaggccaaaccaagacuuuugcaccagaggaaaucuccgccaugguucugacaaaaaugaaggagaccgcugaggccuauuugggcaagaaagugacgcacgcggucgugacugugcccgcauacuucaaugaugcccagagacaggcuaccaaggacgccgggacaauugcaggacucaacgucaugaggaucauuaaugaaccuacugcugccgcgaucgccuauggucuggauaaacgggagggcgaaaagaacauacugguuuuugaccucgggggaggcaccuucgaugugucuuuacugacaauugacaaugguguauuugagguggucgcaaccaacggggacacgcaucuuggaggcgaagauuucgaccagcgcgugauggagcacuuuaucaaauuguacaagaaaaagacuggcaaggauguuagaaaagacaauagggcugugcaaaagcugcggcgcgaggucgaaaaagccaagcgagcucuaucgucacagcaucaggccagaauugagaucgaaucuuucuaugagggggaagauuuuagugagacacucaccagggcaaaauucgaggaacugaacauggaccuuuuccgguccacuaugaagccagugcagaagguacuggaggauucugacuugaaaaagagcgauaucgacgaaauuguucucgugggagguuccacacguauacccaaaauccaacagcuggucaaggaguuuuucaauggcaaagaaccuucacgcgggauuaacccagaugaggccguggcuuacggagcggcaguccaggccggcguguuaaguggugaccaagacaccggggaucugguucuccuugacguguguccgcugacguugggcaucgagaccguaggaggcgucaugacaaagcuaauacccagaaacacugugguuccuaccaagaaaagccagauuuuuagcacagcuuccgauaaucagccaacugugaccaucaaggucuacgaaggggagaggccccugacaaaagacaaccaccuccugggaaccuucgaucuuacugguaucccuccagcaccccggggcgugccgcagauugaaguaacguuugagaucgacgugaaugggauucugcgaguuacagccgaggauaagggaaccggcaacaaaaauaagauaacuaucaccaacgaccaaaaucgcuugacaccugaagagauugaaagaauggucaacgaugccgagaaguucgcugaagaggacaaaaagcucaaagagaggaucgauacccggaaugaacuggagucauaugccuacagcuuaaagaaccagaucggugacaaagaaaagcuagggggcaaacugaguucugaggauaaggaaacuauggagaaggcaguggaggagaaaauugaauggcucgaaucccaucaggacgcggacauagaggauuuuaaggcuaaaaagaaagaacuggaggagaucgugcagcccauuaucagcaaacuuuauggaucggccggcccaccucccacaggggaagaggacacggcagaaaaggaugaguuguga

SEQ ID NO: 461 - RNA, 1932 nt, Artificial Sequence
  derived and/or modified CDS sequence (opt3) from Homo sapiens__NP_002146.2__HsHSPA6
augcaggcccccagagagcuggcugugggcaucgaccucgggaccacauacagcugcgucggaguuuuccaacaggguaggguggaaauucuugcaaacgaucagggcaaucggacuacgccuuccuauguagccuuuaccgacacagagcgccuggugggggaugcggcuaagucucaggccgcauugaacccacacaauacugucuucgacgccaaacgauuaauaggacguaaguuugcugauaccacagugcaaucagacaugaaacauuggccguucagaguugugagugaaggcgguaagcccaaagucaggguguguuaccgcggggaggauaagaccuuuuauccugaagagaucagcuccaugguacugucuaagaugaaagagacugcagaagccuaccuaggacagccaguuaagcacgcugugauuacaguccccgccuauuucaacgacucgcagcggcaggcgaccaaagaugcaggcgccaucgcuggccucaaugugcugagaauuaucaacgagccuacggccgcagcuauagccuacgggcuugacaggcggggagcgggugaacgcaaugugcugaucuuugauuugggcgggggaacuuucgacgucucaguucucagcauugaugccggcguguuugagguaaaggcaaccgcuggugacacacaucucgggggagaggacuucgauaaccgacuggugaaucacuuuauggaagaguucagaaggaaacauggcaaggaccugaguggcaacaagcgggccuuacgucgccugagaacugcuugcgaaagggccaaacggacccuuuccucuagcacacaagcaaccuuggagaucgauucccuguuugaaggggucgacuucuauacgucaauuacucgagcccgcuucgaggagcuauguagugaucucuuuagaagcacacuggaaccaguggagaaggcucuuagggacgcgaaacuggauaaggcacagauccacgacguuguguuggucggagguucuacccggauacccaaagugcagaagcuccugcaggauuucuuuaauggcaaagaauuaaacaaguccauuaauccugacgaggccguagcuuacggggccgcaguucaagccgcugugcugaugggagauaagugcgaaaaaguccaggaccuccuucuguuggacguggccccacuaucacugggccucgagacugccgguggggucaugacaacccugauccagcgcaacgcgacgauuccgaccaagcaaacacagacuuucaccacauacagcgauaaucagcccggcguguuuauccagguuuaugagggagaaagagcuaugacuaaagacaacaaccuucugggcagguucgaguugagugggaucccuccagcaccccguggagugccucaaauugaaguaaccuuugauauagacgcaaaugguauccucucugucacagccaccgaucgguccacuggcaaggcuaacaaaauuacgaucacaaaugacaaggggcgacugagcaaggaggaaguggagagaaugguucacgaggccgaacaguacaaagcagaggaugaagcucagagggaccgcguggccgcgaagaacucguuagaggcccaugucuuccacgugaaaggaucucugcaggaggaaucccuacgggauaagauaccagaggaagacagaaggaaaaugcaagauaagugucgcgagguacucgcuuggcuggaacauaaucagcuugcagagaaggaggaauaugagcaccagaaacgagaauuggagcagauuugccggcccaucuuuucacgucuguacggcgguccgggggugccuggcggaaguagcuguggcacccaagccagacagggggaccccuccacuggaccaaucauugaagagguugauuga

SEQ ID NO: 462 - RNA, 1104 nt, Artificial Sequence
  derived and/or modified CDS sequence (opt3) from Homo sapiens__P48741__HsHSPA7
augcaggcccccagagagcuggcugugggcaucgaccucgggaccacauacagcugcgucggaguuuuccaacaggguaggguggaaauucuugcaaacgaucagggcaaucggacuacgccuuccuauguagccuuuaccgacacagagcgccuggugggggaugcggcuaagucucaggccgcauugaacccacacaauacugucuucgacgccaaacgauuaauaggacguaaguuugcugauaccacagugcaaucagacaugaaacauuggccguuccagguugugagugaaggcgguaagcccaaagucagaguguguuacaggggagaggauaagaccuuuuauccugaagagaucagcuccaugguacugucuaagaugaaagagacugcagaagccuaccuagggcagccaguuaagcacgcugugauuacaguccccaccuauuucucgaacucacagcggcaagccacgaaagacgcgggcgcaaucgccggccucaaggugcugccuauuaucaaugaggcuacugccgcagcuauagccuacgggcuugaucgcagaggagcggguaaaaggaacgugcugaucuuugacuugggcgggggaaccuucgaugucagcguucucaguauugacgccggcguguuugaaguaaaggcaacagcuggugauacucaucuugggggagaggacuucgacaaucggcuggugaaccacuuuauggaggaguuccgccgaaagcauggcaaagaucucuccggcaauaagagagccuuaaggcggcugcguaccgcuugcgagcgcgccaaaagaacaccaucuagcuccacccaggcaacgcuugaaaucgacucauuguuugagggggucgauuucuauaagaguauuacuagggcccgguucgaagaacuguguagcgaccuauuucgaucuacacucgagcccguggaaaaagcucugcgcgaugcgaagcuggacaaagcacagauccacgauuucguucugggagguggcuugcacucccauccucagggggccgagguggcugccggacuccugcaaagacagggcgcagaacaggagcaccaaccauga

SEQ ID NO: 463 - RNA, 1941 nt, Artificial Sequence
  derived and/or modified CDS sequence (opt3) from Homo sapiens__NP_006588.1 __HsHSPA8
augagcaagggccccgccguggggaucgaccugggaaccacauacuccugcgucgguguuuuccagcacggcaaaguggagauuauagcuaacgaucaagggaauagaacuacgccuucuuauguagcauuuaccgacacagaaaggcucaucggagaugccgcgaagaaccagguggcuaugaauccaacuaacaccgucuucgacgccaaacggcuuauuggccgccgauuugaugacgcagugguucagucagauaugaagcauuggccguucaugguggucaaugacgccggucgucccaaagugcagguagaguacaagggggaaacaaagaguuuuuauccugaggaaguuagcuccauggugcugaccaaaaugaaggagaucgcugaggcauacuugggaaaaacugucacaaacgccguggugaccgucccagcuuauuucaaugauucucaaagacaggccacgaaggacgcgggcacuauugcaggcuuaaacguucugaggaucauaaaugaacccaccgccgcugccaucgcauacgggcuagauaaaaaggugggagcugagcggaacguacucauuuuugaccuggguggcgggacauucgaugugucgauccuuacuauugaagacggaaucuuugaggucaagucaaccgccggcgacacacaccuggguggggaggauuucgacaaucgcauggugaaccauuuuauagcggaauuuaaaagaaagcacaaaaaggauauuagcgagaauaaaagggccguucggcgcuugcgaaccgcaugugaaagagcuaagaggacgcucaguuccucuacucaggccagcaucgagauugacucccuguaugaaggaaucgauuuuuacacaucaaucacccgggcucguuucgaggagcugaacgccgaccucuuccgcggcacuuuagauccuguggaaaaagcacugagagacgccaaacuugauaagagucagauucaugacauagucuuggugggcgggagcacaaggaucccaaagauucaaaagcugcuacaggauuucuucaauggaaaagagcucaacaagucuaucaaccccgacgaagcuguagcguacggugcagccguucaggcugccauacuguccggcgacaaaucagagaaugugcaggaucuucuguugcucgacgucaccccucugagcuuagggauugaaacggcaggaggcgugaugaccguccugaucaagcggaacacaacuaucccaaccaagcaaacacagacuuuuaccacauauagugauaaucagccgggugugcucauucaaguuuacgagggggagcgagccaugaccaaagacaacaaucuucugggcaaguucgaauugacuggaaucccucccgcuccacgcggcgugccccagauugagguaacguuugauauagacgccaacgggauccuaaaugucucugcaguggauaaauccacaggaaaggaaaacaaaauuaccaucacuaaugacaaggguagacugagcaaggaggauaucgaaaggaugguucaggaggcggagaaauauaaggcugaagacgagaaacagcgggauaaggugucgucuaaaaacucccucgaaucauacgccuucaauaugaaggcaaccgucgaggacgagaagcugcaaggcaaaauuaacgaugaagacaagcagaaaauacuugacaagugcaaugagaucauuaacuggcuggauaaaaaucagacagccgaaaaggaggaauuugagcaccagcaaaaagaguuggaaaagguguguaacccuaucauuaccaagcucuaucagagugcugggggaaugccaggcgguaugcccgggggcuucccgggaggcggggccccucccagcggaggugcauccucuggcccaacuaucgaggaaguagacuga

SEQ ID NO: 464 - RNA, 2040 nt, Artificial Sequence
  derived and/or modified CDS sequence (opt3) from Homo sapiens__NP_004125.3 __HsHSPA9
augaucagcgccuccagagcugcagccgcgaggcuggugggcgcugccgcaucucgggggcccaccgccgcucgccaccaggacucauggaacggacucagucaugaggcauuccgacuugucagccguagagauuacgccuccgaagcuauuaagggugccguugugggcauagaccuggggacaacuaauucuugcguagcggugauggagggaaaacaagcaaaggucuuggaaaacgccgagggcgcuaggacgaccccuucggugguugccuuuacagcagauggugaacgguuaguggggaugccagcuaaacgccaggccgucacuaauccgaacaauaccuucuaugcgacaaagagacugaucggaaggcgguacgacgaucccgaggugcagaaagacauuaagaacguaccuuuuaagaucguucgcgccucaaauggcgaugcauggguggaggcucacggcaaacuauauagcccaagucagauuggggccuucguccucaugaagaugaaagaaaccgcugagaacuaccugggacauacugccaagaaugcagugaucacagugcccgccuauuuuaacgacucccaacgacaggcuaccaaagaugcgggucagauaucuggccuuaauguccugagaguuaucaacgaaccuacggcagccgcuuuggccuacgggcucgacaagagcgaggauaaggugauugcaguauaugaccugggaggcgguacuuucgauaucuccauucuggagauccagaaagggguguuugaagucaagucaaccaauggagacacauuccucggcggcgaggacuuugaucaagccuuacugaggcacauagugaaagaguucaagcgggaaacugggguugaccuuaccaaagauaacauggcuuugcagcgugugcgcgaagccgcagagaaggcgaaaugugagcugaguagcucuguccagacagacauuaaucuaccauaccucaccauggauuccucaggacccaagcaucugaacaugaaguugacgagagcucaguuugaagguaucgugacugaccugauuaggcggacaaucgccccuugccaaaaagcaaugcaggaugccgagguaagcaagagugacaucggcgaaguuauuuuggucgggggaaugacccgaaugccaaaagugcagcaaacugugcaggaucucuucggccgcgcuccgucuaaggccgucaaccccgacgaggcaguggcuauaggugccgcgauccaagggggcguucuggccggagaugugacagacguauuacugcucgacgucaccccucuuucccugggcauugaaacgcuugggggaguguuuaccaaacuaaucaauagaaacacaacuauaccaaccaaaaagagccagguuuucucgacagcugcagauggucagacucagguggagauuaaggucugucagggcgagagggaaauggccggggacaauaagcugcucggacaguucacccugaucggcauucccccugcuccacggggugugccccaaaucgagguaacauuugauaucgacgccaacgggauugugcacguuucugcaaaagauaagggcaccggacgcgaacagcagauagucauccaguccucaggcgggcuuaguaaagacgauauugagaauauggugaagaacgcggaaaaguacgccgaggaggacagaaggaaaaaggaacguguggaggcugucaauauggccgaaggaaucauccacgauacugagacgaaaauggaggaguucaaggaccaacugccggcagaugaaugcaacaaauugaaggaagagauuagcaagaugcgggaacuccuggcucgaaaagacuccgagacaggugagaauauaagacaggccgcaucuagcuuacagcaggccucacugaagcuauuugaaauggcuuauaaaaagauggcgagugagagggaaggcuccgggagcucuggaaccggcgagcaaaaagaagaucagaaggaggagaaacaguga

SEQ ID NO: 465 - RNA, 2028 nt, Artificial Sequence
  derived and/or modified CDS sequence (opt3) from Homo sapiens__NP_079291.2__HsHSPA12A
auggccgacaaggaggcuggcgggagcgauggacccagagaaaccgcaccuacauccgccuacucuucaccagcgaggagucugggugacacuggcaucacgccgcucagccccucccacauugugaacgauaccgacucuaaugucucggagcagcaaucauuccuuguugugguagcuguggauuuugggacaacuagcaguggauaugccuacuccuucaccaaagaaccugagugcauacaugucaugcggcgcugggaaggcggugacccaggggugucuaaccagaagacacccaccacuauccuguugacaccugagcgaaaauuucacagcuucggauaugcagcccgugauuuuuaccaugacuuagauccaaaugaggcuaagcaguggcuguaucuagaaaaauucaagaugaagcuccacaccacgggcgaccugacuauggauaccgaccuuacagcagccaacggcaaaaagguuaaagcucuggagauuuuugccuacgcguugcaguauuucaaggaacaagcacucaaagagcuguccgaucaggccgggucagaguuugaaaauagugacgugagaugggucaucacugugcccgcuauuuggaagcagccugccaagcaguucaugaggcaagcagcuuaccaggccggacuggcgagcccagagaacucugaacagcucaucauagccuuagagccggaagcagcuuccaucuacugucggaaacugcgccuucaucagaugauugaguugucaagcaaggccgcuguaaaugguuauaguggcucugacaccguuggggccggauuuacacaagcaaaagagcacaucagaaggaaccggcagucccgcaccuuccugguggaaaaugucauuggcgagaucuggagcgaacuagaggaaggugauaaguacgugguggucgacuccgggggaggcacgguugaucucacugugcaccagauacgacugcccgagggccaucuuaaagagcuguauaaggccacagggggaccuuacgguucuuugggcguagacuaugaauuugagaaacuccuguacaagauuuucggggaagauuucaucgagcaauuuaagauuaaaagaccagcugcguggguggacuuaaugaucgcauucgaauccaggaagcgggccgcugcccccgaucguaccaacccucugaauaucacucucccauuuucauucauugacuauuacaaaaaguuucgcggacacagugucgagcaugcacuuagaaaaagcaacguggauuucguuaagugguccucucagggcaugcugaggaugagccccgacgccaugaaugcuuuguuuaagccgacaauagauucaaucauugagcaccuacgggaccuguuccagaaaccugaagugaguaccgucaaguuucucuuccugguggguggguuugccgaggcaccccuucugcagcaagcgguacaggcugccuucggcgaccagugccgaaucauaauuccacaggauguuggauugacgauccucaaaggcgcagugcuguuuggguuagacccugccgucaucaaggugcgcagaucgccccugaccuacggagucggugugcuaaacagguauguugaaggcaaacacccacccgagaagcuccuggugaaggaugggacacggugguguacugacguauucgauaaauucauuagcgcugaccaaucugucgcccuuggagaguuggugaagcgcucauacaccccugcaaaaccaagucagcugguuaucgugauuaauauauauagcuccgaacaugauaacgucucuuuuaucacagacccgggcgugaagaaaugcgguacucucagacuggaucuuaccgggacaucgggcaccgcuguacccgccaggcgugagauucagacucugaugcaguucggagacacggaaaucaaggcgacagccaucgauauugcuaccagcaaguccgugaaaguuggcauagacuuuuugaacuacuga

SEQ ID NO: 466 - RNA, 2061 nt, Artificial Sequence
  derived and/or modified CDS sequence (opt3) from Homo sapiens__NP_443202.3 __HsHSPA12B
augcuggccgugcccgagaugggccuccaggggcuuuacaucggaagcuccccugaaagaucuccagucccgucacccccugguaguccaaggacccaagagagcugcggcauugcuccccugacaccuucccagucuccaaagcccgaaguucgggcaccucagcaggccucguucucagugguaguggcgauagacuuugggacuacgagcaguggauaugcuuucuccuuugccucugauccagaggcaauccacaugaugcgcaaaugggaaggcggugacccgggggucgcccaccaaaagacccccacauguuuguuacugacuccugagggagcuuuccacagcuuuggcuacaccgcacgagauuauuaccaugaccuagauccagaggaagcccgugacuggcucuauuucgagaaauuuaagaugaaaauucacuccgcuacagaucugacccuuaagacucagcuggaagccgugaacggcaagacaaugcccgcguuggagguuuucgcacaugcccucagauuuuucagggagcacgcucugcaggaacugcgggagcagucaccuagucucccagaaaaagacaccgugcgcugggucuuaacggugcccgccaucuggaagcaaccggcaaaacaguuuaugagagaggcugccuaccuggcggggcuuguaagcagggaaaaugccgagcaguugcugauugcacuagagccugaagcugccucuguuuauugccggaagcuccgccugcaccagcuucuggauuuguccggacgagcucccgguggcgggagacucggagagaggcggucaaucgacagcaguuuccgucaagcccgcgaacagcugagaaggucucggcauucccgaaccuuuuuaguggagagcggcgucggugaacugugggcagagaugcaggccggggaucgcuacgugguggcugacuguggaggcggcacugucgaucucacaguucaccaacuugagcagccacaugggacucugaaagaauuguacaaggcgucgggagguccuuauggcgcaguggggguagaccuagccuucgagcagcugcucugcagaauauucggagaagacuuuaucgcuaccuucaagaggcagcggcccgccgcauggguggaucugacaauugccuuugaggcucgcaaaagaaccgccggcccacacagggcgggugcacuuaacaucucucugcccuucuccuuuauugacuucuaccguaagcaacgggggcacaaugucgaaacggcuuugcgaagaucaagugugaacuuuguuaaauggagcucccagggcaugcucaggaugucuugugaggccaugaaugagcuguuccagccuacugugagcggaaucauacagcauauugaagcauuacuggcccgcccagagguccaaggcgugaagcuacucuuucugguagggggauucgcugaaucagccguucuucagcacgcagugcaggcugccuugggugcgcggggccugagagucguggucccgcaugauguggggcucacaauccugaaaggagccguucuuuuuggccaggcucccggugugguaaggguccgccgaaguccucugaccuauggggugggcguuuugaaccgguucgugccaggacgucaucccccugagaagcuccuggucagagacggcaggcgcuggugcacugauguguuugagcgguucguagcagccgaacaauccguggcuuuaggggaggaaguuagaaggagcuacuguccagcccgacccggacagcgccggguccugauuaaucuauauugcugugcagcggaggacgccagauucaucacagauccgggugugaggaaaugcggcgcucucucucuggaacuugagccugccgacugugggcaggauaccgcaggagcuccacccggccgucgcgagauccgggccgcaaugcaguuuggugacacggaaauuaaggugaccgccgucgauguuucaacaaacagaagugugagggcuagcauagacuucuuguccaauuga

SEQ ID NO: 467 - RNA, 1416 nt, Artificial Sequence
  derived and/or modified CDS sequence (opt3) from Homo sapiens__NP_008879.3__HsHSPA13
auggcccgggagaugaccauccugggcagcgcugugcucacacuucuguuggcaggguacuuagcccagcaauaucugccccuaccuacuccaaaggucauuggaauagaccucgguacgaccuacugcuccguuggcguguucuuuccggggacaggaaaaguaaaggugauccccgaugaaaacggccacauuucuaucccuucaauggucaguuucacugacaaugauguguauguugguuacgagagcguggaacuggcggacuccaacccacagaauaccauuuaugaugcuaaaagguuuaucgggaagauauucacagccgaggaacuugaggcagagaucggacgguaccccuuuaaaguccugaacaagaauggcaugguggaguucucuguaaccucgaacgaaacuauuacaguuucaccugaauaugugggcagccgcuugcuccugaagcugaaagagauggccgaggcuuaccucgggaugccagucgcaaaugccgugaucagugugcccgcugaauuugacuuaaagcagcgaaacuccaccauugaggccgcgaaucuggcaggacuuaaaaucuugcgugucauaaacgaaccuacggccgcugccauggcauacggucugcauaaggcugauguuuuccacgugcuaguaauugaccucggcgggggaacucuggaugugucucuucugaauaaacagggcgguauguuuuugaccagagccaugagcgggaacaauaagcucggaggccaagacuucaaccagaggcuguuacaguaucuguacaagcagaucuaucaaacauacggcuuugucccaucccggaaagaggaaauucaucgccucagacaggcgguggagaugguuaaguugaaucugacuuugcaccagucagcccagcuaagugugcugcucaccgucgaggaacaagauaggaaagagccgcauagcucugacacagaacugcccaaggauaaacuuuccucagcagacgaccaccgggugaacagcggguucggacgcggucugagugauaagaaaucuggcgagucccagguauuguuugaaaccgagaucagccgaaaacucuucgacacgcugaacgaggauuuauuccagaagauccugguuccuauucaacaggugcuaaaggaagggcaccucgagaagacugaaauagacgaggucgugcuggucggaggcucgacaagaaucccaaggauuagacaggugauccaggaauuuuucgguaaagaucccaauaccucuguugacccugaucuugcugugguaacuggggucgccauacaagcuggcauugacggaggcuccuggccacuucaggugucagcccuggagauccccaacaagcaucuccagaaaacaaauuuuaacuga

SEQ ID NO: 468 - RNA, 1530 nt, Artificial Sequence
  derived and/or modified CDS sequence (opt3) from Homo sapiens__NP_057383.2__HsHSPA14
auggccgcuaucggcgugcaccuggggugcaccagcgcaugugucgccguuuacaaggacgguagagcgggagugguagcuaacgaugccggcgacagggugacacccgcagucguggccuauuccgagaaugaagagauuguugggcucgcugcaaaacagucucggauacgcaacaucucaaauacugugaugaaggucaaacaaauucuuggacgaaguagcuccgauccucaggcccagaaguacaucgcugaaucuaaaugccuggugauugagaagaacggcaaguugcguuaugaaaucgacacgggugaggagaccaaauucguaaauccagaagauguugccagauuaauauuuucgaagaugaaagagacagcgcauucagugcuggggagcgacgcaaacgaugucgugaucacugugccguucgacuuuggagaaaagcagaaaaaugcccuaggcgaggcugccagggcagcuggcuucaacguccuccggcugauucacgagcccagugccgcgcuucuggccuacgggaucggacaagauuccccuaccgguaagucuaauauuuugguuuuuaagcucggcgggacaagccugucccugucagugauggaaguaaacaguggaaucuaucgcgugcucagcaccaauacugacgauaacauaggcggugcacauuucacagagaccuuagcucaguaccuggccucugaauuucagagauccuucaaacacgacgucagggggaaugcucgggccaugaugaagcugacgaacucagcagagguggccaaacauagcuugaguacucugggaucugcuaauuguuuucuagauucccucuaugaaggccaggacuucgacugcaacguuagccgcgcgcgauuugagcugcuuuguucgccacuguucaacaagugcauugaggcaaucagaggcuugcucgaucaaaauggguuuaccgccgacgauauuaacaaagugguccuguguggagguucuuccaggauccccaaguuacagcagcugaucaaagaccucuucccugcuguggaacuucuuaauucaauuccacccgaugagguaauaccuaucggcgccgcaauugaagccgggaucuugauaggaaaggagaaccuacugguugaagacagucucaugauugagugcagcgcucgggauauccuggugaagggcgucgacgaguccggugccucucguuucacagugcuuuuuccaagcgggacuccgcugcccgcacgcagacagcacaccuugcaagcgccuggcucaaucaguuccgucugucucgaacuguacgagagcgauggcaaaaauucugcuaaggaagagacaaaauucgcccaggugguuuuacaggaccuggauaagaaagaaaacggacuaagggacauucucgcagugcugaccaugaagcgggacgggucacuucacguaacgugcacugaucaagagacaggaaagugugaggccaucaguauugaaauagcuagcuga

SEQ ID NO: 469 - RNA, 2577 nt, Artificial Sequence
  derived and/or modified CDS sequence (opt3) from Homo sapiens__NP_006635.2 __HsHSPH1
augagcguggucggccuggacguugggucccagucuugcuacaucgccguggcuagagcaggagguauugagaccauagccaacgaguucucagauagguguacacccaguguaaucagcuuuggcuccaagaaucggacuauugggguggcggcuaaaaaccaacagaucacgcacgccaauaacaccgucucuaauuucaagcgcuuucauggacgagcauucaacgacccuuuuauucagaaagagaaggaaaaucucucguaugaucuugugccacugaaaaacggcgguguugggaucaaggugauguacaugggagaggaacacuuguucucagucgagcagauaacagccauguuacugacuaagcuaaaagagaccgcugaaaauagccucaagaaaccggugacagacugcguaaucaguguucccuccuuuuucaccgaugcagagcguagaucugugcuggacgccgcucaaauugucggccuuaacugucugagguugaugaaugauaugacugccguggcgcucaacuauggcaucuacaagcaggaccugccuagccuggaugaaaaaccacggauuguggucuuuguugacauggggcauuccgcauuccaggugucagccugcgcuuuuaauaagggaaagcucaaaguauuagguacagccuucgaucccuuucugggcgggaagaacuucgacgagaaacuuguggagcacuucugugcagaauuuaagaccaaauauaaguuggaugcuaaaaguaagauccgcgcccugcuaagacucuaccaggagugcgaaaagcugaaaaagcugaugagcucuaauuccacggaccuuccuuugaacauagaguguuucaugaacgacaaagaugucucaggaaagaugaauaggagccaauuugaagaacucugcgcggagcuguuacagaaaauugaagugccacuguauagucuccuugagcagacucaucugaagguugaagacgugucugccgucgagaucgugggcggugcaacccggauucccgcuguaaaggaacgcaucgccaaauucuuugggaaggauaucuccacaacuuugaacgcugacgaggccguugcacgaggaugugcccuacagugcgcuauucugagcccugcguucaaagugagagaguuuucggucaccgaugcagugccauucccgauaucucucaucuggaaucacgacuccgaagauacagagggcguccacgaaguguuuucaaggaaccaugccgcucccuucaguaagguucugaccuuucuucggcguggcccuuucgagcuggaagccuuuuacagcgacccacaaggggugcccuacccugaggcaaaaauuggacgcuucguaguccagaauguguccgcccagaaggauggugagaagucuagaguuaaagugaaggucagggugaacacgcacggcaucuucacuauaagcacagcuucaaugguagaaaaagugccaaccgaggaaaaugagaugaguuccgaggccgacauggaauguuugaaccaacggcccccggagaauccugauacugacaagaacguucagcaggacaauagcgaagcagggacacagccccaaguccagaccgaugcgcagcagacgucucaaucaccaccuagucccgagcucaccagcgaagagaacaaaauuccagacgcugauaaggccaaugagaagaaaguggaccagcccccugaagcaaagaaaccaaagaucaaaguggucaacguugagcugccgaucgaagccaauuuaguguggcagcugggaaaggaucuacucaacauguauauugagacagaaggcaaaaugaucaugcaggacaagcuggagaaggagcgaaacgaugcuaaaaaugccguggaagaguacguauaugaauuucgcgacaaacuuugcggucccuacgagaaauucauuugcgaacaagaucaucagaacuuuuugagacugcucacugagaccgaggacuggcuguaugaagagggggaagaucaggcaaagcaggcuuacgucgacaaacuugaggagcugaugaagauaggcacaccugugaagguuagguuccaagaagccgaggaacggccaaaaauguuugaggaauugggacagcgccuccagcacuaugcgaagaucgccgcugauuucagaaauaaagacgagaaguacaaccacauugacgaguccgaaaugaaaaagguggagaagucugucaaugaagugauggaguggaugaacaauguuaugaacgcacaagccaaaaagucgcuggaucaggaccccgugguaagggcucaggaaaucaaaacuaagaucaaagaguuaaauaacaccugugagccugucgugacacagccaaagcccaagauugaaagcccgaaacuggagcguaccccuaauggcccaaacauagauaagaaagaagaggaccuagaagauaagaauaacuuuggggccgagcccccucaucaaaauggagagugcuaccccaacgaaaagaacuccgugaauauggaccucgauuga

SEQ ID NO: 470 - RNA, 3000 nt, Artificial Sequence
  derived and/or modified CDS sequence (opt3) from Homo sapiens__NP_006380.1 __HsHYOU1
auggccgacaaggugagaaggcagcggccccgccgacgugucugcugggcucugguugcagugcuccuugccgaucuguuggcguuaagcgacacccuggcuguaauguccguggaucuaggcucugagucaaugaaagucgccaucgugaagccugggguuccaauggaaauugugcucaacaaagagaguagaaggaagacaccggucauagugacucugaaagaaaaugagcgguucuuuggagacagcgcagccuccauggcuaucaagaaccccaaggcaacgcuucgcuacuuccaacaccuguuggguaaacaggccgauaauccucauguagcucucuaucaggccagauuuccagaacacgagcugaccuucgacccccagaggcaaacaguucauuuucagauuucuucgcagcugcaguucucaccugaggaagugcucggcauggucuuaaacuacagccggagucuggcggaggauuuugcagaacaaccaaucaaggacgccgugauuacugugcccgucuucuuuaaucaggcugagcgccgagccguucuucaggcagcuagaauggccggguugaaagugcugcagcuaaucaacgauaauaccgcgacagcccucuccuauggaguauucaggcggaaggacauaaacaccacugcacaaaauaucauguuuuacgauaugggcucugguagcacaguguguaccauugucacguaucagauggugaaaacuaaggaggcugggaugcagccucaacugcagauccguggaguuggcuucgaccgcacccuuggcgggcuggaaauggaguugagacucagggaacggcuggccggauuauuuaacgagcagcgaaagggucagcgcgcuaaagaugugagagaaaauccaagggccauggcaaagcugcuccgggaggccaaccgccuuaaaacaguccuguccgcuaaugcggaccacauggcacaaauugagggcuugauggacgauguggacuucaaggccaaaguaacuagaguugaguucgaggaacuaugcgcugaucuguuugagagggugccggggcccguccagcaggcccuccagucagcagaaaugagucuggacgagaucgagcaagugauacuugucggaggcgccacccgugugccucggguucaggaagugcuguugaaggcuguagguaaagaggaacucgggaagaacauuaaugccgaugaggcagcggcuaugggagccgucuaccaggcagccgcucugagcaaggccuucaaagugaagccauuuguugugcgagacgcagucguguaucccaucuuaguagaguucacaagagagguggaggaagaaccuggcauucauucucugaaacacaacaagaggguucuauuuucccgcaugggcccauacccccagcggaaagucaucaccuucaacagauacucacacgauuuuaauuuccauaucaacuauggggaccucggauuucuggguccggaagaucuuaggguguucggcagccaaaauuugacgacugugaagcugaagggggucggagacaguuuuaaaaaguacccugauuaugagucuaaaggcauuaaggcucacuucaaccucgacgaguccgguguucugagccuugaccgcguggaaucgguguuugagacacugguagaagauucugccgaggaagaguccaccuugacuaaacucgggaauacaauaucaagucuguucggcggaggcaccacgcccgacgcgaaggagaacgggaccgauacaguccaggaagaggaagagagcccagccgaaggauccaaggacgagccuggugaacagguggaauuaaaagaggaagcugaggcacccguugaagauggcucucagccacccccuccagagccgaagggggacgccacucccgagggagaaaaagcuaccgagaaggaaaauggcgauaaaagcgaggcccaaaagccuucagagaaggcagaagcggguccagaggggguggcccccgcuccugaaggcgagaaaaagcagaaaccagcccgaaagcggcguauggucgaagagaucggaguggagcugguugugcuagaccuccccgaucugccggaagacaaacuugcacagaguguacaaaaguugcaggaucugacacucagagaccuggagaaacaggaaagggagaaggcugccaacuccuuagaagcauucauuuuugagacucaggauaagcuguaccaaccugaguaucaggaagucagcaccgaggaacagcgcgaggaaaucucuggcaaacuuucagccgcuaguacaugguuggaggacgagggggugggagcgaccacugugaugcucaaggaaaaacuggccgagcuacggaagcugugucagggucucuucuuuagagucgaagagaggaaaaaguggccagagcgacugagcgcacuugacaauuugcugaaccauuccucuauguucuuaaagggcgcucgccucauacccgaaauggaucaaauuuuuacggagguugaaaugacaacccuggagaaagugaucaaugaaacuugggccuggaagaacgccacccuugcugagcaggcaaaacugccugccacagagaagcccguauugcucucgaaagacaucgaagcgaagaugauggcucuggaucgggaggugcaguaccuacugaauaaggccaaauucaccaagccaagaccuaggcccaaagacaagaacgggacucgugcagaaccaccgcucaaugccagcgcuuccgaucagggagagaaagucauuccucccgcaggccaaacagaagacgccgagccaaucucagagcccgaaaagguggagacggguagugaaccuggggauaccgagccacuggaacuuggcggacccggcgcggagccugagcagaaggaacagucuacugggcaaaaacgcccguugaagaacgacgagcuguga

SEQ ID NO: 471 - RNA, 2199 nt, Artificial Sequence
  derived and/or modified CDS sequence (opt3) from Homo sapiens__NP_005339.3 __HsHSP90AA1
augcccgaggaaacccagacacaagaccagccuauggaggaagaggaaguggagacuuucgccuuucaggcugagaucgcacagcugaugagccucauuauaaacacguucuacuccaauaaggaaaucuuucuuagagagcugauuucuaacucaagugaugccuuggacaaaaucagguaugagagcuuaaccgauccauccaagcuggacucuggcaaagagcuacacauuaaucucaucccgaacaagcaagaucggacacugacuauagucgacaccgggaucggaaugacaaaagcggaucuuauuaauaaccuggguaccaucgcuaagucgggcacuaaggccuucauggaggcauugcaggccggggcugacauuucaaugaucggacaguuuggcguugguuucuacagcgcauaucucguggccgaaaaaguaacagugauaaccaagcauaaugaugacgagcaguacgcuugggaaaguuccgccgggggaucuuuuacgguccgcacugauaccggcgagcccaugggccgagggacaaaagugauucugcaccugaaggaagaccaaacugaguaucucgaggaacguagaaucaaagagauuguuaagaagcauagccaguucaucggauacccuaucaccuuauuuguggaaaaagagagggauaaggaagucuccgacgacgaggcggaggaaaaagaggauaaggaagaggaaaaagagaaggaggaaaaagagucagaagacaagccagagauugaggauguggguagugacgaagaggaagagaagaaagauggcgacaagaaaaagaaaaagaagauaaaagaaaaguauaucgaucaggaggagcugaacaaaacaaagcccauuuggacccggaauccugacgauaucacgaacgaagaguacggggaguucuacaaaagccuuacuaaugacugggaagaucacuuggcaguaaagcauuuuucuguugaaggacagcuggaguuccgcgcccuacucuuugugccaagaagggcucccuucgaccuguucgagaaccggaagaaaaagaauaacauaaaacuuuauguccgccgaguguuuauuauggacaauugcgaagaacugaucccugaauacuugaacuucaucagaggcguggucgauuccgaggaccucccacugaacauuucaagggaaauguuacaacagagcaagauccugaaaguuauucggaagaaucucgugaagaaaugucuugagcuguuuacagaguuggccgaagauaaggagaacuauaaaaaguucuacgaacaguuuaguaaaaauauaaagcuagguauccacgaggacucucaaaaccguaaaaagcuguccgagcuccugcgcuauuacaccagcgcaucgggggaugaaaugguaucucuuaaggacuauugcacuagaaugaaagagaaucagaagcacauuuacuacaucacaggagaaaccaaagaucagguggcuaacuccgccuucgucgagaggcugcggaagcauggcuuggaagugaucuauaugauugagccgauagacgaguacuguguucagcaacucaaagaauuugagggcaagacgcuggugucagucaccaaggaaggguuagagcugcccgaagaugaggaggagaaaaagaaacaggaagaaaagaaaacaaaguucgagaaucuaugcaagaucaugaaagacauucucgaaaagaaaguggagaagguaguugugaguaaccgacuggucacuagcccuuguugcaucgugaccuccacauauggauggacugcgaauauggagcgcauuaugaaagcccaggcacuuagagauaacucuaccauggguuacauggcugccaagaagcacuuggaaaucaauccagaccauagcauaaucgagacacugaggcagaaagcugaagccgauaagaacgacaaaucagucaaggaccucgugauucugcuuuaugagaccgcacuguugaguuccggcuuuagccucgaggauccccaaacucacgccaaucggaucuaccgcaugauuaaacugggguuaggaaucgacgaagaugacccuacggcugaugacacaucugcggcaguuaccgaggaaaugccaccccuggagggcgaugacgauacuucaagaauggaagagguggacuga

SEQ ID NO: 472 - RNA, 339 nt, Artificial Sequence
  derived and/or modified CDS sequence (opt3) from Homo sapiens__NG_005218__HsHSP90AA3P
auggacagcuccaagcuggauucuggcaaagggcuccacaucaaccuugugcccaauaagcagaaccaaacccugacaauugucgacacuagaauaggaaugacgaaaaccgauuugaucaauaacuuagguacaguuacuaagucaggcaccaaagccuucauggaggcucugcaggcagacgccgauauuaguaugaucgggcauuuuggagugggcuucuacagcgcguaucuaguagcuaagaaggugacagucauuuccaaacacaauaacgacgaacaguacaccugggagucuucggccggugggucauuuacugugaggacagaugaauga

SEQ ID NO: 473 - RNA, 2175 nt, Artificial Sequence
  derived and/or modified CDS sequence (opt3) from Homo sapiens__NP_031381.2__HsHSP90AB1
augcccgaggaagugcaccauggcgaggaagaggucgaaaccuucgccuuucaggcugagaucgcacaacugaugagccucauuauaaacacauucuacuccaauaaggagaucuuucuuagagaacugauuucuaacgccucagacgcguuggauaaaaucagguaugagaguuuaacugacccuagcaagcuggauuccgggaaagaacuaaagauugacaucauaccaaauccgcaggagcggacgcucacccugguugauacaggaaucgguaugacuaaagcugaccuuauuaacaaucugggcaccaucgccaagucugggacaaaggcauucauggaggccuugcaggcuggagcagauauuucgaugaucggccaguuuggugugggguucuacucagccuaucucguagcugaaaaaguggucgugauaaccaagcacaacgacgaugagcaauacgccugggaaagcagugcgggaggcuccuuuacuguucgcgcagaccauggcgagcccauugggcgaggaacaaaagugauccugcaccugaaggaagaucagaccgaguaucucgaggaacguagagucaaagaggugguaaagaagcauucucaguucauugguuacccuaucacguuauaucuggaaaaagagagggaaaaggagaucagcgacgaugaggccgaagaggaaaaaggcgagaaggaagaggaggacaaagacgaugaagagaagccaaaaauugaagacguuggguccgaugaggaggacgauucaggaaaggacaagaaaaagaaaacuaagaaaauaaaggaaaaguacaucgaucaggaggaacuuaauaaaaccaagcccauuuggacacggaacccugacgauaucacucaagaggaauacggcgaguuuuauaaaaguuugaccaaugacugggaggaucaccuggcugugaagcacuucagcgucgaaggucagcuagaguuucgcgcccuccuguucauaccaagaagggcacccuuugaccuuuucgaaaacaaaaagaagaaaaauaacauuaagcuguacgugcggcgcguguucaucauggacucuugcgaugaguugaucccugaauaucucaauuuuauucgaggggucguugacuccgaggaucugccauuaaacaucucaagagagaugcugcagcagagcaaaauucucaaggugauaaggaaaaauaucguaaagaagugucuugaacuguucagugaguuggcugaagacaaagagaacuacaagaaauuuuaugaagccuucucuaagaaccuaaaacugggcauucaugaggauuccacaaaucggcgucgccucagcgagcugcuuagauaccacaccucgcaaucuggagacgaaaugacgucccugucagaguaugugaguaggaugaaggaaacucagaaaagcaucuacuacaucacaggcgaguccaaggagcaggucgcgaacucugccuuuguggaacggguucgaaagcgcggguucgagguggucuauaugaccgaaccgauugaugaguacugcgugcaacaguugaaagaauuugacggaaagagccucguaucaguuacuaaagagggucuggaguuacccgaagaugaggaagagaagaaaaagauggaagagaguaaggcaaaauucgagaaucuguguaagcuaaugaaagaaauacucgacaagaaaguggagaaggucacaaucuccaacagacuggugagcucuccuugcuguauugucaccucaacguauggcuggaccgcuaauauggaaaggaucaugaaggcccaggcccuucgggauaacaguacaaugggguacaugauggcuaaaaagcauuuggagauuaauccagaccaccccaucguggaaacucugcgccagaaagcagaggccgauaagaacgacaaagcuguuaaggaccucgugguacugcuuuuugagaccgcgcuguugagcuccggauucucucucgaagauccucaaacacacucgaauagaauauauaggaugaucaagcugggcuuagguauugacgaggaugaagucgcagccgaggagccaaacgcugccgugcccgacgaaaucccgccucuggagggggaugaagacgcaagccguauggaggaaguugauuga

SEQ ID NO: 474 - RNA, 2412 nt, Artificial Sequence
  derived and/or modified CDS sequence (opt3) from Homo sapiens__NP_003290.1__HsHSP90B1
augagagcccugugggugcucggccuuugcuguguccuguugaccuucgggagcguuagggcugacgaugagguggacguagauggaacaguggaagaggacuuagguaagucccgggaaggcucucgcacugaugacgaggucgugcagcgagaagaggaggcaauccaacuggaugggcuaaacgccucacagauucgugaacucagagagaaaagugaaaaguuugcguuccaggcugagguuaauaggaugaugaaacugauaaucaacagccuuuacaagaauaaagagauuuuucugcgggaauugaucuccaacgccucugacgcacucgauaagauucgccugaucucgcugacggacgagaaugcccucucaggaaacgaagaguuaaccgugaagauaaaaugcgauaaggagaaaaaucugcuucacgucacagacacuggcguggguaugaccagagaggaguugguaaagaaccuggggacaaucgcuaaaagcggaaccagugaguuccuaaauaagaugacugaagcacaggaagauggccaauccacaucugagcucauuggccaguuugggguuggauucuauagcgccuuucugguggcugacaaggucaucgugaccuccaaacauaacaaugacacgcagcacauuugggaaucagauaguaacgaguucagcgugaucgccgaccccagggguaauacucuuggccgggggaccacaauaacucuggucuugaaggaggaagcgucugauuaccucgagcuggacaccauuaaaaacuuaguuaagaaauauucccaguuuaucaauuucccuauuuacguguggucaagcaagacagaaaccguagaggaaccaauggaggaggaagaggcagccaaagaagagaaggaggaaagugaugacgaggcugccguggaagaggaagaggaggaaaagaaaccgaagacgaaaaaggucgagaaaacugugugggauugggaacugaugaacgacaucaagcccaucuggcaacgcccuucuaaggagguugaagaggaugaguauaaagcauuuuacaaguccuucagcaaagaaucggacgauccaauggcuuauauucauuuuacagccgagggagaagugaccuucaagucuauacucuucguccccacuuccgcgccucgaggccuuuuugacgaguacgguaguaaaaagucagacuacaucaagcuguaugugagaaggguauucauuacagaugacuuucacgauaugaugccaaaauacuugaacuucguuaaggggguggucgacagcgaugaccuaccccugaaugugucccgggaaacccuccagcagcauaaacugcuuaaggucauccguaaaaagcuggugcgcaagacguuggauaugauuaaaaagauagccgacgauaaauauaacgacaccuuuuggaaggaguucggaacaaauaucaaacucggcguuaucgaggaucacucuaacagaacuaggcuggcaaaguuacugcgguuucagagcucacaccauccuaccgacauuacaagucuagaucaauacguggaacgaaugaaagagaagcaggacaagaucuauuucauggcuggcuccagccgcaaagaagccgagucuucaccauuuguagagagacuccugaagaaaggguacgaagucauuuaucuuacugagccgguggacgaauacuguauacaggcuuugcccgaguucgauggaaagagguuucaaaauguugccaaagaaggugugaaguucgacgagagugagaagaccaaagaaagccgggaggcagucgaaaaggaguuugaaccucugcucaacuggaugaaagauaaggcccugaaagacaagaucgagaaggcugugguaucccagcgccuuacagagucuccaugcgcgcugguggcaucgcaguacggcuggagcgggaauauggaaagaauuaugaaagcccaggcuuaucaaaccggaaaggauaucuccacuaacuacuaugccucacagaaaaagacguucgagaucaaucccaggcacccuuugauucgugacaugcuccggcgaauaaaagaagaugaggacgauaagacaguucuggacuuagcagucgugcuguucgaaaccgccacucuaagaaguggcuaccuccugccagauaccaaggcuuauggugacaggaucgagcgcaugcuucgguugucucugaacauugaucccgacgccaaaguggaggaagaaccggaagaggagccugaagagacagcagaagacaccacugaggauacagaacaggacgaggaugaggaaauggacgucgggacggaugaggaagaggaaaccgcgaaggagagcacugcugagaaagacgaacucuga

SEQ ID NO: 475 - RNA, 2115 nt, Artificial Sequence
  derived and/or modified CDS sequence (opt3) from Homo sapiens__NP_057376.2__HsTRAP1
auggccagagagcugagggcucuccuucuguggggccggcgcuugcgacccuuacugcgugcuccugcccuagcggcugugccagggggaaagccgauccucugccccagaaggaccacagcccagcuggguccucggcgcaacccagcauggagccuucaagccggcagacuguucuccacucagacggcugaagacaaagaggaacccuugcacucuauuauaucaaguaccgagagcguccagggguccacaucuaagcaugaauuucaggcagagacuaaaaagcuccuggauaucguugccaggucgcuguacucagagaaagaaguguucauucgggagcucaucagcaaugcuagugacgccuuagaaaagcugcgccacaagcuaguauccgauggacaagcguugccugagauggagauucaucugcagaccaacgcagaaaaaggcacaaucaccauacaggacacugguaucgggaugacacaggaggaacuugugucuaaucucggaaccauugcccgaagcggcuccaaggcuuuucuggaugcccuucaaaaccaggcagaggcuucaaguaaaaucauuggccaguucggggucggauuuuauagcgccuucaugguggcggacagaguugaaguguacucuagguccgccgcaccagguucacugggcuaucagugguugagcgaugggaguggagucuuugagaucgcugaggccucuggcgugcggacggguacuaagauaauuauccaccucaaauccgacuguaaggaauuuagcucggaggcucguguacgcgauguugugaccaaguacucuaauuuugucuccuucccccuguauuuaaacgggagaaggaugaauacacugcaagccauuuggaugauggacccuaaagaugugcgggaauggcagcaugaggaauuuuaccgauauguggcacaggcccacgacaagccacgcuacacucuccacuacaaaaccgaugcuccgcuuaacaucagaucaaucuucuauguccccgacaugaagccuaguauguuugacguuagcagggagcugggauccucuguggcguuguacagccggaaaguacuaauucaaacaaaggcaaccgauauacugccaaaauggcuccgcuucaucagaggcguggucgacucagaggauauuccccugaaucuuaguagggaacuguugcaggaguccgcccucauccguaagcugcgggacguguuacagcagcgacugauaaaguucuuuauugaucaaagcaaaaaggacgcugaaaaauaugccaaguucuuugaggauuacggccuauucaugagagaagggaucguuacggcaacugagcaggaggugaaagaagacaucgccaagcuccugagguaugagucuucagcacuuccuaguggacaguugacaagccuguccgaauacgccucucgcaugcgggcagguaccagaaacauuuauuaccucugcgcgccaaauaggcaucuggcugagcacucgcccuacuaugaggccaugaagaaaaaggauacugaaguccuuuucuguuucgagcaguuugacgaacugacauugcuccaucugcgcgaguucgauaaaaagaaauuaaucagcguggaaaccgacauuguaguugaccacuacaaggaggagaaguuugaagaucgauccccggcagccgagugccugucagaaaaagagacggaagaacuaauggcuuggaugcggaacgugcucggcagucgugucaccaaugugaaggucacacugagacuugacacucacccugccauggugaccguuuuggagaugggggcagcuaggcauuuccugcgcaugcaacagcucgccaaaacacaggaggagcgggcgcagcuguuacaacccacucuggaaauaaacccaagacacgcccuuaucaagaaauugaaucagcucagggcuucugagccuggacuggcacagcuacugguggaucagauuuaugaaaacgccaugaucgcugccggccucguagacgauccccgagcaauggucggucgccugaacgagcuuuuggugaaggcgcuggagcggcauuga

SEQ ID NO: 476 - RNA, 462 nt, Artificial Sequence
  derived and/or modified CDS sequence (opt3) from Homo sapiens__NP_000609.1__HsIGF1
augggcaagaucagcucccugcccacccaacucuucaaaugcuguuuuugcgacuuccuuaaggugaaaaugcacacaaugucuucaagucaucuguuuuacuuggccuuaugucugcuaacuuucacgagcuccgcuaccgcagggccugagacacucugcggagccgaacuggucgaugcgcuucaguuuguuuguggugacagaggcuucuauuuuaacaagccaacuggguacggaucuucgucaaggcgggcuccgcagaccggcauuguggaugagugcuguuuccgcagcugcgaccugcgacguuuggaaauguauugugcaccccucaaaccugccaagagugccagauccguaagggcucagcggcacacagauaugccaaagacccagaaagaggugcaucugaagaaugcaucucgcgguagcgccgggaacaaaaauuacagaauguga

SEQ ID NO: 477 - RNA, 543 nt, Artificial Sequence
  derived and/or modified CDS sequence (opt3) from Homo sapiens__NP_000603.1__HsIGF2
augggcauccccaugggaaagagcaugcuggugcuccuuaccuuccuggccuuugcuuccugcuguauugcagccuacagaccuucugagacauugugcgggggugaauuagucgacacucugcaguucguuuguggcgauaggggguuuuauuucucacggccagcgagucgcgugagccgacguuccagaggaauaguagaggaaugcuguuuuaggucuugcgaccuagcucuccuggagacguacugugccaccccggcaaaaucggaacgggaugugucaacacccccuacuguccuuccagacaacuucccccgcuauccugugggcaaguuuuuccaauacgauaccuggaaacagagcacacagagacugaggcgggguuugccagcccuccugcgcgcucgaagagggcacguucuggcaaaggagcucgaggccuuuagggaagcuaaacggcaucgucccuuaaucgcccugccuacccaggacccagcgcacggaggcgcaccgcccgagauggccaguaaucgcaaguga

SEQ ID NO: 478 - RNA, 639 nt, Artificial Sequence
  derived and/or modified CDS sequence (opt3) from Homo sapiens__NP_000591.1__HsIL6
augaacagcuucuccaccucugccuuuggccccguggcuuucucacuggggcuccuucuggucuugccugcagccuuuccagcgccgguucccccuggagaggacaguaaggauguggcugccccacacagacagcccuuaacaagcuccgaaaggaucgacaaacaaauucgguacauacuggaugguaucucugcacuacgcaaggagacuugcaauaaaucgaacaugugugaaucaagcaaggaggcccucgcugaaaauaaccugaaucuuccuaaaauggcagagaaggacggcugcuuccagaguggguuuaacgaggaaacgugucugguaaagauuaucaccggauugcucgaguucgaaguguaucuggaguaccugcagaaucgauuugaguccucugaagaacaggcccgugcuguccaaaugagcacaaaagugcucauucaguucuuacagaagaaagccaagaaccuggaugcgaucacuaccccagaccccacaaccaaugcaucccuuuugacuaaacugcaggcccaaaaccaguggcuacaggauaugacaacccaucucauacugagaucauuuaaggaguuccuucagaguagccugagggcuuugcggcaaauguga

SEQ ID NO: 479 - RNA, 1281 nt, Artificial Sequence
  derived and/or modified CDS sequence (opt3) from Homo sapiens__NP_002183.1__HsINHBA
augccccugcucuggcuuagaggcuuccuguuggccagcugcuggaucauugugagguccucuccuaccccagggucagagggacacagugcugcaccggacugucccagcugcgccuuagcggcucugccuaaggaugucccaaacucccagcccgaaaugguugaggccgugaaaaagcauauacuaaauaugcuccaccugaaaaagcggccugacguaacacaaccagugcccaaagcagcccuucugaacgcuauccgcaaguugcaugucgguaaggugggcgaaaauggguacguugagauugaagaugacaucggacgacgugcagagaugaacgagcucauggaacagacuucugagauuaucacguuugccgaaucgggcaccgcuagaaaaacacugcacuucgagauaucaaaggaggguagcgaucugaguguggucgaaagggccgagguguggcucuuuuuaaaaguaccuaaggcgaaucggacucgcaccaaaguuacaaucagacuguuccagcagcaaaagcauccacaggggucccuugacaccggagaagaggcagaagaggugggcuugaagggcgagaggucugaacugcuacucagcgagaaagucguggaugcccggaaguccacuuggcacguguuuccggucucaaguagcauucagcgccugcuugaccaggggaaaucuucccuggauguucgaaucgcuugugaacaaugccaggagucaggagccagcuuggugcuccuggguaagaaaaagaaaaaggaagaggagggcgaagggaagaaaaagggaggcggugaagggggagcaggcgcugacgaggagaaagaacagagucacagacccuucuuaaugcugcaggccaggcaaucugaggaucauccucaccggcgucgcagaaggggccucgagugugacgggaagguaaacauuugcuguaaaaagcaguuuuucguguccuuuaaggauaucggauggaaugacuggauaauugcgccaagcgguuaucaugccaacuacugcgaaggcgagugucccucgcacaucgcagggacaucuggauccucacuuaguuuccacagcaccgucauuaaucauuaucggaugcgaggccacuccccuuuugcuaaccugaaaucuugcugugugccaacgaaguugcgccccaugagcaugcuauacuaugacgauggucagaauaucaucaaaaaggacauucaaaacaugauaguugaagagugcgggugcucauga

SEQ ID NO: 480 - RNA, 1224 nt, Artificial Sequence
  derived and/or modified CDS sequence (opt3) from Homo sapiens__NP_002184.2__HsINHBB
auggacggccugcccgggagagcccucggagcugcaugccuucuguuguuagccgcggguuggcugggcccugaggcuugggggagcccaaccccgcccccuacaccagccgcacccccuccacccccuccaccgggaucccccggcgguucucaggauacuuguacgucaugcgggggauucaggcggccugaggaacuaggccgcguggacggcgauuuucucgaagccgucaagcgacacauccugagucgucuucaaaugagagggaggccaaacauuacccaugcuguucccaaagcagccauggugacagcucugcggaaguugcacgccggaaaaguacgcgaggacgguagaguggaaauaccucaucucgauggccacgcgagcccaggggcagacggacaggagagggucuccgagaucauuucuuucgccgaaacugauggccuggcuucgucacgggugcgccuguacuuuuucaucagcaaugaggguaaccagaaucucuuuguugugcaggccaguuuauggcuguaucuuaaguugcugcccuacguccuagaaaaagggucccgaagaaaggugaggguaaagguuuauuuccaagagcagggacauggcgaccgguggaacaugguggagaaacgugucgaucucaagcgcucuggcuggcacaccuuuccgcugacagaagcaauucaggcucuuuucgagagaggggaaaggcggcugaauuuggacgugcagugugauagcugccaagagcucgccguggucccuguuuuuguggaccccggagaagagucccaccgaccauucguagugguccaggcgcgccugggugauucaagacauaggauccggaaacgcggcuuagagugugacgggagaaccaaccugugcuguaggcagcaguuuuucauagacuuucgucucaucggauggaaugauuggauuaucgccccuacuggcuacuaugguaacuacugcgaagggaguugucccgcauaucuugcuggcgugccaggaagcgccucuuccuuccacacagcuguugugaaucaauaccggaugcgaggccugaaccccgggaccgucaauucaugcuguauuccuacgaaguugagcacuaugaguaugcuauacuucgacgaugaguauaacaucgugaaaagagacguaccaaauaugauaguugaagagugcggaugcgccuga

SEQ ID NO: 481 - RNA, 3459 nt, Artificial Sequence
  derived and/or modified CDS sequence (opt3) from Homo sapiens__NP_000623.2__HsITGAM
auggcccugagagugcuccuucugaccgcuuugacauuaugccacggcuucaaccuggacacugagaaugcaaugacguuucaggaaaacgccaggggguucggacaaagcgucguucagcuacaggguucccgggugguagugggcgcgccccaggagaucgucgcugccaaucaacgcgggucucucuaccagugugauuauucaaccggaaguugcgaaccuauucgacugcaagugccaguugaggcagugaacaugagccuuggccuguccuuggccgcuacaacuucuccgccccagcuccuggcaugugguccuaccguccaucaaacaugcucggaaaauaccuacgugaaggggcuguguuuucucuucggaucaaacuuacgucagcagccacagaaauuucccgaggcccugagaggcugcccucaagaggacagcgauauagcuuuccuuaucgacggcaguggguccauuaucccacacgauuuuaggcggaugaaggaguucguaucuacuguuauggaacaguugaaaaagagcaaaacacuguuuucccuaaugcaguauucagaagaguuccgcauucauuuuaccuucaaggaguuucaaaauaaccccaauccuagaagucucgugaagccaaucacgcagcugcuuggaaggacucacaccgccacagguauacggaaagucgugcgcgaacuguucaacaucacuaauggcgcgcgaaagaacgcauucaaaauuuugguggucaucaccgacggggagaaguuuggagauccgcucggcuacgaagacguuauucccgaggccgauagagaaggugugaucagguauguaauaggggugggagacgcuuuccggagcgagaaaucucgucaggagcugaauacaauugccuccaagccuccacgcgaucaugucuuucaggugaacaauuucgaagcauuaaagaccauccaaaaccagcugagagagaaaauuuuugcuaucgaaggcacgcagacuggcucaagcaguucuuucgagcacgaaaugucccaggagggguuuagcgccgcgaucacaucgaacggaccccuccuuucuaccguugguuccuacgacugggccggcgggguguuccuguauacuucaaaggagaaaaguacauuuauuaauaugaccagggucgauagcgacaugaacgacgcauacuugggauacgcugccgcuauaauccuacggaaucgagugcaaucccugguacucggcgccccucgcuaucagcacauuggucugguugcaauguucagacagaacacggggaugugggaaucuaaugccaacgugaagggcacccagaucggagcuuacuuuggcgcgagccuuuguucagucgauguggacaguaauggguccacagaucuggucuugauaggagcaccacauuauuacgagcaaacuagggguggccaggugagcguuugcccccucccgcgggggcgcgccagauggcagugugacgcugugcuguauggagaacagggccaaccuugggguagguucggggccgcauuaaccguacugggcgaugucaacggagacaaacuaacagauguggccauuggcgcucccggggaggaagacaaucguggagccguuuaccucuuucacgguacuucuggcucagggaucaguccaagccauucccagcggaucgcaggaucuaagcugucgccucgacuucaguauuucggccagagcuuguccggugggcaggaucugaccauggacggccucguggaucugacagucggagcgcagggccacgugcuucuguugagaucacagcccguacucagggugaaagcuauuauggaguucaacccacgcgagguugcccggaaugucuuugaaugcaacgaccaaguggugaaggggaaggaggcaggagaagucagaguuugucugcacgugcagaaaaguaccagggaccgcuuacgagagggccagauccagucugugguaacuuacgaucuggcccuagacagcggucggccccauucccgugcugucuucaaugagacgaagaacucaacaagaaggcaaacccaggugcucgggcugacucagaccugcgaaacacuuaaauugcagcugccuaauugcauugaggauccaguuagcccgauagugcuccgccugaacuuuucuuuagucggaaccccucuguccgccuucggcaaccuucggccuguguuggcagaagacgcucaaagacucuuuacugcccuguucccauuugagaagaauugugguaacgauaauaucugccaggacgaucuaaguauuacauucagcuuuaugucucuggacugucucguugugggcgggcccagggaguucaacguaacggucaccgugcgaaaugauggagaagacuccuaccgcacucaggugacauuuuucuuuccucuggaucuuucauaucggaaagucaguaccuugcaaaaccagagaagccagaggucguggcgucuggcgugcgaguccgccucuagcacagaaguuucaggcgcuuuaaagaguacuuccuguucuaucaaucacccaaucuuccccgagaacagcgaagugaccuucaauauuacguuugacguagauuccaaggcaucacucgggaacaaacugcuucugaaggccaaugugaccagcgagaacaauaugccgcgcacaaacaaaacugaguuccaguuggaacucccugucaaguacgcuguguauaugguugugaccagucauggagucucuacaaaauaccugaauuuuacugccuccgagaacaccagccgggugaugcaacaccaguaucagguuucgaaccuaggccagagaucacugccaauaucucucguguuccugguccccguaaggcuuaaucaaacggugaucugggaccgaccucagguuacauuuagugaaaacuuguccucuaccugccauacuaaggagcggcugcccagccacagcgacuucuuagcagaacuccgcaaggcgccaguggucaauuguuccauugccgugugccagagaauccagugugauauucccuuuuucgguauccaagaggaauuuaacgcuacacugaaagggaaucuuucauucgacugguacauaaagaccagucacaaccaucugcuaaucguaagcacugccgagauucucuuuaaugauucuguguucacccuguugcccggacagggcgcauucgucaggucccagacagagacgaaaguugaaccauuugaggugccgaacccucugcccuuaaucguggguucaagugucggcgggcuccugcuucuggcuuugauuaccgccgcacucuauaagcugggauucuuuaaacggcaguacaaggacaugaugagcgaaggcgggccacccggagccgagccucaauga

SEQ ID NO: 482 - RNA, 1404 nt, Artificial Sequence
  derived and/or modified CDS sequence (opt3) from Homo sapiens__NP_002415.1__HsMMP8
auguucagccugaagacccuccccuuucuucuguuguuacacgugcagaucuccaaagccuucccugucucuucaaaggagaaaaacacaaagacuguucaagacuaccuggaaaaauuuuaucagcuaccaaguaaucaguaccagagcacgagaaagaacggcaccaaugugauuguagagaagcucaaagaaaugcaaagguucuuugggcugaacgugacaggaaagccgaaugaggaaacucuugauaugaugaaaaagccccggugcggugucccugacuccggcggguucaugcugaccccaggaaaccccaaaugggagcgcacaaauuugaccuaucgaauacguaacuacacuccucagcucucugaggcugaaguggagagagcaaucaaggaugccuuugaacuguggucgguugcgucaccacugauuuucacaaggaucagccagggcgaggcugacauuaauaucgccuuuuaucagcgggaucauggugacaacagucccuucgaugggccuaauggaauacucgcacacgccuuucaaccaggccagggcaucgggggagacgcucauuucgaugcagaggaaaccuggacgaacacuuccgccaauuacaacuuauuucugguggcugcccacgaguucggucauucucuuggcuuggcgcacagcuccgacccgggggcacugauguaucccaauuacgccuuccgcgaaaccucaaacuacagucuaccucaggaugacauugauggaauccaggcuauuuauggccucagcucuaacccaauccaacccacagguccuuccacuccaaagcccugugacccgucacugaccuuugacgccauaacaacccuuagaggggagauucuguucuuuaaagauagguacuucuggcggcgccacccucaguugcagcgagucgaaaugaauuuuaucagccucuucuggcccagucugccaacgggcauucaagcagcuuaugaggacuuugauagagacuuaaucuuccuguuuaagggaaaccaguacugggcccucucuggcuaugauauccuucagggguacccuaaagacauuuccaauuauggauuccccagcucggugcaggcgauagaugccgcaguauuuuacaggucuaagacuuacuucuuuguuaacgaccaauucuggcgguaugauaaucagcgucaguucauggagccagguuaccccaaauccaucucaggcgcuuuuccugggauugaaaguaagguggacgccgucuuccagcaagagcacuuuuuccauguguuuagcggaccacgcuauuacgcuuucgaucugaucgcccagagagugacaagggucgcacggggcaacaaaugguugaauugccgauaugguuga

SEQ ID NO: 483 - RNA, 2124 nt, Artificial Sequence
  derived and/or modified CDS sequence (opt3) from Homo sapiens__NP_004985.2__HsMMP9
augagccuguggcagccccucgugcuuguccuguugguuuuaggcugcuguuucgccgcuccuagacaaaggcaguccacccuggugcuauuuccaggggaccuccggacaaaccugacugaucgccagcuugcagaggaauaccuguaucgauacggauauacgcguguagccgagaugagaggugaaucuaaaucauugggcccggcgcuccugcugcuccagaaacaauuaagucugcccgagaccggggaacuugacagcgcuacauugaaggccaugaggacuccucggugcggagugccagaucugggccgcuuccagaccuuugagggugaccuaaaauggcaccaucacaauaucacauacuggauucagaacuauuccgaggaucuccccagagcagucauagacgaugccuucgcuagggcauuugcccuguggucugcugugaccccucuuacuuucacacggguuuacucgcgcgacgccgauaucgugauucaguuuggggucgcggaacauggagacggcuauccauucgauggcaaggacgggcuguuggcacacgccuuucccccuggaccagguauccaaggcgaugcucauuucgacgacgaugagcucuggucacuggggaaaggagugguaguuccgacccgauuuggcaaugccgacggugcagcuugucacuuccccuuuauuuucgaagggagaagcuacagugccugcacgacugauggaagguccgacggcuuaccuugguguucuaccacagcgaacuacgauacugacgaucgguucggcuuuugcccaagcgagcgucuguauacccaggacgggaaugccgauggaaagcccugucaguucccuuuuaucuuccagggucaauccuacucagcaugcacaaccgacggccgcagugauggguauagauggugugcuacgacugccaacuacgacagggacaagcucuuuggauucugcccaacacgggcugauagcaccgugaugggcgguaauucugccggggagcuuugugucuuucccuucacuuuucugggcaaagaauauuccacaugcaccucagagggacgaggcgacgggcgcuuguggugcgcaacgaccagcaacuucgauagugacaagaaauggggauuuuguccggaucaggguuacucucuauuccugguggccgcucacgaauuuggccaugcgcucgggcuggaccacuccagcgugccugaggcacuuauguaucccauguacagauucacagaaggaccaccucugcauaaggaugacgucaauggcauaaggcacuuguacgguccccggccagagcccgagccucgcccaccgacuaccacaacuccccagccuaccgccccacccacaguuugcccuaccgggccacccacugugcacccgucggaaagaccuacggcuggcccaacaggacccccuucugccggccccaccgggccaccuacugcaggacccuccaccgccacaaccguaccacucucaccgguggaugacgcuuguaacgucaauaucuucgaugccauugcagagaucgguaaccaacuguauuuauuuaaagacggcaaguacuggagguucagugaagggcguggaagccggccucagggccccuuucugauugcggauaaguggccagcucuaccccgaaaacucgacuccguguucgaggaaagacugucuaagaaauuguuuuucuuuagcgguaggcagguuuggguguauacuggggccucaguccuuggcccucgccggcuggacaagcucggacugggcgcagauguggcccagguaacaggggcucuuagaaguggaaggggcaaaaugcuguuguucuccggucgccgacucuggcgguuugacguuaaggcccaaaugguggauccacguagcgcaucugaggucgacagaauguuccccggggugccucuggauacgcaugacgucuuucaguacagggagaaggcuuauuucugccaggaucgcuuuuacuggcgggugucaaguagaagcgaauuaaaucagguugaccaagugggauauguaaccuacgauauccugcaguguccggaggacuga

SEQ ID NO: 484 - RNA, 1416 nt, Artificial Sequence
  derived and/or modified CDS sequence (opt3) from Homo sapiens__NP_002418.1__HsMMP13
augcaccccggcgugcuggccgcuuuccucuuucuuagcuggacccauugcagagcacugccuuugccauccgggggagacgaggaugacuuaucugaagaggaucugcaguucgccgaaagguaccuacggucauauuaccacccgacaaaccucgcggguauccugaaggagaaugcugccaguagcaugacugaacgccuucgagagaugcaauccuuuuucggccuggaggucacggggaaauuggacgauaacacccucgacguuaugaagaaaccccguuguggagugccugauguaggcgaauauaauguguuuccaagaacacugaaguggucuaaaaugaaccugacuuacaggauugucaauuauacccccgacaugacacauucggagguggaaaaggcauucaagaaagccuuuaagguuuggucagaugugaccccucucaacuucacucgguuacacgacgguauagcugauaucaugauuagcuuugggaucaaagagcauggagacuucuacccauuugauggccccaguggccugcuugcacacgccuucccuccagggccgaauuauggaggugacgcucacuuugacgaugacgagacauggaccuccucuagcaagggcuacaacuuguuccuggucgccgcgcaugaguucgggcacucccuaggacucgaucauucaaaagaccccggcgcacugauguuuccuauuuacacguauacugguaagagucacuucaugcuuccagaugacgaugugcaggggauccagagccuguacggacccggcgacgaagauccuaauccaaagcaccccaaaaccccggacaagugcgauccuucuuugucccucgacgccauaacaucacugcgcggcgaaacuaugaucuuuaaagacagauucuuuuggagguuacauccccagcaaguagaugcugagcuguuccucaccaagagcuuuuggccagaacuuccuaaccggauugacgccgcauaugagcaccccagucaugaucugaucuucauuuuucgcgggcgaaaauucugggcuuugaauggauacgacauccuagaggguuauccaaagaaaauaucugaacugggccuccccaaggagguuaagaaaauuuccgccgcggugcacuuugaagauacagggaagacccugcuuuucagcggaaaccaggucuggagauacgacgauacgaaucauaucauggacaaagauuauccuaggcugauugaggaagacuuuccaggcaucggugauaagguggacgccguguacgagaaaaacggguacaucuauuucuucaauggcccgauucaguuugaguacucgauauggucuaaccggaucguccguguuaugcccgcaaacuccauuuugugguguuga

SEQ ID NO: 485 - RNA, 1068 nt, Artificial Sequence
  derived and/or modified CDS sequence (opt3) from Homo sapiens__NP_001286.1__HsCCR1
auggagacccccaacacaacugaagacuacgauacgaccacagaguucgacuauggcgaugccacuccuugccagaaggugaaugaaagagcuuuuggggcacaacugcucccaccgcuuuacagccuggucuucguuaucggauugguggguaacauuuuaguagugcugguccuagugcaguauaaaaggcucaagaauaugaccuccauauaccugcuuaaccuggccaucucugacuugcucuuucuguucacacugcccuuuuggauugauuauaaacucaaggacgauuggguuuucggcgacgcgauguguaaaaucuuaucaggguuuuacuauaccggacuguacagugagauuuucuuuaucauacuuuugacuaucgaucgguaccuggcuauugugcacgccgucuucgcacuacgcgcccgaacagugaccuuuggcguaaucacgagcauuaucauaugggcucucgcaauucuggccuccaugccuggucuuuauuucucuaagacucagugggaauuuacccaucacacaugcucgcugcauuucccacacgagucauugcgugaguggaaacucuuccaggcucugaaguuaaaucuguuugggcucguucuuccccuguuggugaugaucauuuguuacacuggaaucaucaagauucuacugagaaggccuaacgagaaaaagagcaaagccguccggcucauauucgugaucaugauuaucuuuuuccuguuuuggaccccauauaaucuuacaauacugauuaguguguuccaagacuuuuuguucacccaugaaugcgaacagucccgccaccucgaucuggcgguccagguuacggaggugaucgcauacacucacuguugcguaaaccccgugaucuaugccuuugucggcgagagauucaggaaguacuuacggcagcuguuucaucgccgaguggcuguucaccuagugaaguggcucccuuuccugucugucgacagacuugaaagggugagcuccacaucaccaaguaccggcgagcaugaauugagcgccggguuuuga

SEQ ID NO: 486 - RNA, 636 nt, Artificial Sequence
  derived and/or modified CDS sequence (opt3) from Homo sapiens__NP_002598.4__HsPDGFA
augagaacccuggccugccuccuucuguugggauguggguacuuagcucacgugcuggcagaggaagccgagauccccagggaagucauugagcggcuagcgcgcagccagauacauuccauccgagaccuccaacgucugcuugaaauugauucuguuggaucagaggacagucuggauacuagcuugagagcucacggugugcaugccacaaagcacguaccugagaaaaggccacucccgauccggcgcaagagauccauugaagaggcagugcccgccgucugcaaaacgaggaccgugaucuaugaaauaccucggucucagguugacccaacaucggcuaacuuccugaucuggcccccuuguguggaggucaagcgcugcacuggcuguugcaauaccucaagcgugaaaugucagccaagucgaguacaucacagauccguuaagguggcaaaggucgaguacgugaggaaaaagcccaaacugaaggaagugcagguccggcucgaggaacacuuagagugcgccugugcuacaaccucucugaacccugauuaucgugaagaggacacugggcgcccaagagagagcggcaaaaagaggaagcggaaacgacuuaagccgacauga

SEQ ID NO: 487 - RNA, 726 nt, Artificial Sequence
  derived and/or modified CDS sequence (opt3) from Homo sapiens__NP_002599.1__HsPDGFB
augaacagaugcugggcccuguuccucagccuuuguugcuaccugagguugguguccgcugagggcgaccccaucccugaagaguuauaugaaaugcugucugaucacucaauucggaguuuugacgaucuacagcgccuccugcauggggacccaggagaggaagauggugcagagcuugaccugaauaugacccgaagccacuccggcggggaguuggaaucucucgcccguggaagaaggucgcugggcucacugacaauagcggagccggcuaugaucgccgaauguaagacucggacggaggucuucgagauuagccgcagacucaucgauaggaccaacgcaaacuuuuuaguuuggcccccuugcguggaaguacaacgguguagugguugcuguaauaaucgcaacgugcagugccgaccaacacagguccagcugagacccgugcaaguuaggaaaauugagaucgugcggaagaaaccuauauucaagaaagccacugucacccuugaagaccauuuggcuuguaagugcgagacaguggcagccgcucguccaguaacccgcucccccgggggaucucaggaacagagagccaagacuccucagacaaggguuaccauccggacggugcgaguccgcagaccaccgaaaggcaagcacaggaaauuuaagcauacucacgauaaaaccgcgcugaaggagacacuaggcgcauga

SEQ ID NO: 488 - RNA, 1038 nt, Artificial Sequence
  derived and/or modified CDS sequence (opt3) from Homo sapiens__NP_057289.1__HsPDGFC
augagccuguucggccuccuucuguugaccuccgccuuagcugggcagagacaaggaacacaggcagagucuaaccugucaaguaaguuucaguucagcuccaauaaagaacagaacggugugcaagacccccagcacgagaggaucauuacugucucuacgaauggcucgauacauucaccucgguuuccacacaccuacccgcgcaacacaguucuaguguggcgacucguagccguggaagagaaugucuggauccagcugacuuucgaugaacguuuugggcuugaggaccccgaggaugacauuugcaaguaugauuucguggaaguugaggaaccuagcgacggaaccauccugggcagauggugugguagugggacagugccaggaaaacagauuuccaagggcaaccaaaucaggauacgguuugucucugaugaguacuuccccagcgagccuggcuuuugcauccauuauaauauugugaugccacaguucaccgaagcgguaucccccucaguuuugccuccaagugcucucccgcuggaccugcucaacaaugccaucacugcauuuagcacauuagaggaucugauucgcuaccuugaacccgagagauggcaguuggaccuggaagaucuauauaggccuaccuggcagcuccuggggaaagccuucguguuuggacggaagucucgcgucguggaccuuaaccuguugacggaggaggugcgacucuacuccuguacuccaagaaauuucucagucagcaucagggaggaacugaagcggaccgauacaauauucuggcccgguugcuuacugguuaaacguuguggcgggaacugcgcuuguugccuccacaauuguaacgaaugccaaugugugccuaguaagguaacuaaaaaguaucaugaggugcuucagcugcgcccaaaaaccggagucagaggcuugcacaagucucuaacagacguggcacuggaacaccaugaggagugcgacugcguuuguagggguuccaccgggggauga

SEQ ID NO: 489 - RNA, 1095 nt, Artificial Sequence
  derived and/or modified CDS sequence (opt3) from Homo sapiens__NP_149126.1__HsPDGFD
augcacagacugaucuucguguacacccucauuugcgccaacuuuuguagcugcagggacacauccgcuacuccccagucugcaucaauaaaggcccuucggaaugcgaaccugcgccgagaugacuuguaucguagagaugagacgauccaagucaaaggaaauggguacguucagaguccuagguucccaaacagcuauccgcggaauuuacugcuaaccuggcgccuccauucccaggaaaacacaaggauucagcugguguuugacaaucaauucggacuugaggaagcugagaacgauaucuguagauacgacuuuguagaaguggaggauauuucugagacuucgaccaucauacggggucgcuggugcggccacaaggaagugcccccucgaaucaaaucaagaacaaaucagauuaagaucaccuucaaaagcgacgauuauuuugucgccaagccaggguucaagauuuacuauagucuguuggaggacuuucagcccgcagccgcuuccgaaacuaacugggagucuguuacaagcuccaucucaggagugaguuacaauagcccuucugucaccgauccaacgcucauagcagacgcccuggauaaaaagauugcugaguucgacacuguggaagaccugcucaaauacuuuaaccccgaguccuggcaggaagauuuagagaauauguaucuggacaccccuagguaccggggccguucauaucaugaucgcaagagcaaaguagaccuugauagauugaacgacgaugccaagagguacaguuguacaccacggaauuauucuguuaacauccgagaggaacugaagcuagcgaacguggucuucuuuccgcgcugccuccuggugcaaagauguggugggaauugcggauguggcacugugaacuggagguccugcaccuguaauagcggcaaaacagucaagaaauaccacgagguucuucaguucgaacccgggcauauuaagcggcgcggcagagcaaaaaccauggcccugguggacauccaguuggaucaccacgagaggugcgacugcaucuguucgucucguccuccacgguga

SEQ ID NO: 490 - RNA, 678 nt, Artificial Sequence
  derived and/or modified CDS sequence (opt3) from Homo sapiens__NP_003946.3__HsSOCS3
auggugacccacagcaaguuccccgccgcuggcauguccagaccucuggacacaucucucaggcuuaaaacuuuuucaaguaagagcgaguaccagcuggucguuaacgcagugcggaaauugcaagaauccggguucuauuggucugccguaacgggaggugaggcgaauuuacugcuaucggcugaaccagccggcaccuuucucauccgcgauucaagcgaccagcgacauuucuuuacacugagugugaagacucaguccgggaccaaaaaccuucguauucagugcgagggaggcucuuucagccugcaauccgauccgagaucaacacagcccgucccuagguuugacuguguguugaagcucguucaccauuacaugccacccccuggugcaccaaguuuccccagcccuccaaccgaaccgucuuccgaggugcccgagcagccuucagcccagccacugcccgggagcccuccacggcgcgcuuauuacauauauaguggaggcgaaaagaucccccugguccucucuagaccguuauccagcaauguggcaacucugcaacaccuuugcaggaaaacaguaaacggccauuuggauucguacgagaagguuacccagcugccugggcccauucgggaauuucuagaccaguaugaugccccacucuga

SEQ ID NO: 491 - RNA, 483 nt, Artificial Sequence
  derived and/or modified CDS sequence (opt3) from Homo sapiens__NP_003227.1__HsTGFA
auggugcccagcgccggccagcuggcucucuucgcacuugggaucguccuggccgcgugccaggcuuuggagaacuccaccucuccuuuaucagccgacccaccgguugcagccgcugugguaagucacuuuaaugauugucccgacagccauacacaauucugcuuucacggaacuuguagauuccuggugcaggaagauaagccugcaugcgucugucauuccgguuacgugggcgccaggugcgagcacgcugaccuacucgccguuguggcggcaucucagaaaaagcaagccauuacggcucuggucgugguaucgauaguugcccuugcagugcugaucauuaccugugucuugauccauugcugucaggugcggaaacacugcgaauggugucgcgcucucauuugccgacacgagaagccaucagcccugcugaaagggcguacagcgugcugucauagcgaaacuguggucuga

SEQ ID NO: 492 - RNA, 1173 nt, Artificial Sequence
  derived and/or modified CDS sequence (opt3) from Homo sapiens__NP_000651.3__HsTGFB1
augcccccuagcggccugagacuccuuccacuguuguuaccgcugcuauggcuccuggugcuuacccccgggaggccugccgcuggacuguccacaugcaagacuaucgacauggaguuggucaaacggaagcgcauugaagcaauacgaggucagauccucucuaaacugcgucuggccucaccacccagucaaggcgagguuccuccagggccccucccugaagcgguguuagcucuguacaacagcacgagagauaggguagccggagaguccgcagaaccagagccggagcccgaagccgacuauuacgcuaaggaggugacccggguccuuaugguggaaacacacaaugagauuuaugauaaauucaagcagucuacucauucgaucuacauguuuuucaacaccucagaguugcgcgaagcaguuccugagccagugcugcuaagcagagccgaacucaggcugcuucggcugaaguugaaagucgagcagcacguggaacucuaucagaaguacaguaauaacuccuggcgcuaucugucuaaucgauuacuggcucccagcgacuccccugaguggcucucauuugauguaacaggcguugugagacaauggcuuaguagggguggggagauugaaggauuccggcugagcgcccauuguucuugcgacucccgugauaacaccuugcaggucgacaucaauggcuuuacuacaggccgcagaggggaucuagcgaccauacacggaaugaacaggccauuccugcuccugauggcaacgccccuugagcgggcccagcaucugcagucaagccgacaccgcagagcuuuggacacuaauuacuguuuuaguucuaccgagaaaaacugcugugugaggcaacucuacaucgauuuccggaaggaccuggguuggaaauggauucacgaaccgaagggcuaucaugccaauuuuugcuuagggccuugucccuacaucuggucccuggauacacaguauagcaaggugcuagcacucuacaaccagcacaauccaggagcuucggccgcgccuugcugugucccccaggcccuggaaccacuucccauuguuuauuacgugggccgcaaaccuaagguagagcaauugucuaacaugaucgugagauccugcaaauguucauga

SEQ ID NO: 493 - RNA, 1245 nt, Artificial Sequence
  derived and/or modified CDS sequence (opt3) from Homo sapiens__NP_003229.1__HsTGFB2
augcacuacugcgugcugagcgccuuccucauccuucaucuggucaccguugcuuuguccuuaucuacauguucaacucuggacauggaucaguuuaugagaaagaggauugaggcaauacggggccaaauccuaaguaaacucaagcugacgagcccucccgaagacuauccagagccggaagaggugcccccugaaguaauuuccaucuacaacucuacccgcgaucuucugcaggagaaagccucgcgacgugcggcugccugcgagagagaaaggucagacgaggaauauuacgcaaaggagguguauaaaauugauaugccacccuucuuuccuagcgagaaugccaucccacccacauucuaccggccuuauuuucgcauagucagauucgacgugagugcuauggaaaagaacgcauccaauuugguuaaggccgaguuuaggguguuccggcuccagaacccaaaagcucgcgucccggaacagcgaaucgagcuguaccaaauucugaagucuaaagaucucacuagccccacccagagauacaucgacuccaaggugguaaaaacaagggccgaaggggagugguuaucauuugauguuaccgacgcggugcacgaguggcugcaucacaaggaucggaaucuuggauucaagauuaguuugcauuguccuugcuguacuuuugucccaagcaacaauuauaucauacccaacaaaucugaggaacuggaagcacguuucgccgguauugacggcacauccaccuacacgucaggggaucagaagacuaucaaaagcacccgcaagaaaaauaguggaaagacaccucaccuacuccugaugcuucugccaucuuauagauuggagucccagcaaacuaacaggcggaaaaagcgagcucucgacgccgcauacugcuuucgcaaugugcaggacaacuguugccugagacccuuauauauugauuucaagagggaccugggcuggaaauggauccacgaaccgaaggguuacaaugcuaacuucugugccggggcgugcccuuaucucuggagcucggauacccagcauucucgggugcuuucccuguacaauacaaucaaccccgaggccucagcaaguccauguugcgucagccaggacuuggagccucuaaccauucuguacuauauaggaaaaacgcccaagaucgaacaacucuccaacaugauuguuaaaucuugcaaguguagcuga

SEQ ID NO: 494 - RNA, 1239 nt, Artificial Sequence
  derived and/or modified CDS sequence (opt3) from Homo sapiens__NP_003230.1__HsTGFB3
augaagaugcaucugcagagagcccucgugguccuugcucuguugaacuucgcaaccguuagcuuaucccugucuacaugcacuacgcuagacuuuggccacaucaaaaagaaaaggguggaggccauucgggggcaaauacucucaaagcugcgccuuaccagucccccugaaccaacaguaaugacucacgugccguaccagguccuggcguuguauaauagcacccgagagcuccuggaagagaugcauggagaacgugaggaggguuguacacaggaaaacaccgaguccgaauacuaugcuaaagagauccacaaguucgauaugauucagggccuggccgagcauaaugaacucgcagugugccccaaggggaucacuucuaaaguuuuuagauucaacgugucgucagucgagaagaauaggacaaacuuauuucgggccgaguuccgcgugcugagaguaccuaauccaagcaguaaaaggaacgaacaacggauugaacuuuuucagaucuugcgccccgacgagcacauagcuaagcagcgauacaucggaggcaaaaaucugccuaccagagguacggcagaguggcuauccuucgauguuacugacaccgugagggaauggcuccugcggcgugagucuaaccuugggcuggaaauuagcauccacuguccaugccauacauuucagcccaauggagauauuuuggagaacauccacgaagucauggagauaaaguucaagggcguggacaaugaggaugaccauggccgcggggaucucggaagacugaaaaagcaaaaagaccaccacaacccucauuuaauucugaugaugaucccaccgcacaggcucgauaaucccggucagggcgggcagcggaagaaacgagcccuugacacuaacuauuguuuucgcaaccuggaagagaauugcugugugagaccuuuguacauugauuucaggcaggaccuaggauggaaguggguccaugaaccaaaaggcuauuacgcuaacuuuugcuccggucccuguccuuaccugcggucagccgacaccacacacaguaccguucucgggcuguauaauacgcuuaacccagaggcgagcgcaucucccugcugugugccgcaagaucuggaaccuuugacuauccucuacuauguaggacgcacacccaagguggagcagcuguccaauauggucgugaagucaugcaaaugcagcuga

SEQ ID NO: 495 - RNA, 1386 nt, Artificial Sequence
  derived and/or modified CDS sequence (opt3) from Homo sapiens__NP_001057.1__HsTNFRSF1B
auggcccccguggcugucugggcagcccuggcgguuggccucgagcuuugggcugccgcacacgcccugccugcucagguggcauucaccccauacgccccggaacccgggagcacaugcagauugagggaguauuacgaccaaacugcucagauguguugcuccaaguguucuccuggacagcaugccaaaguauuuugcacgaagaccucagauacagugugugacaguugcgaagauagcacuuauacccaguuauggaacugggucccagagugucuguccugcgguucucgguguucgucagaccaaguggaaacacaggcgugcacccgcgagcagaaucgaaucuguacuugccgucccggcugguacugcgcacuaagcaaacaggagggguguagacucugcgccccucugaggaagugucggccaggauucggcguugcucgccccgguacagaaaccagugauguggucugcaaaccuugugccccagggacguuuuccaacacuaccucuagcacagacauuugcagaccgcaccaaauauguaaugugguagcaauccccggaaacgcuuccauggaugccguuugcacuucaaccaguccuacaaggagcauggcgccaggcgccgugcaucuuccccagccugucucuacccggucccagcacacgcagccaacucccgagccgucaacagcaccuagcaccaguuuccuguugcccaugggcccaucuccucccgcugaaggguccacuggagacuuugcccucccagugggucugauugugggcgucacagcucuggggcucuuaaucauuggaguugugaauuguguaaucaugacccaagugaagaagaaaccccugugccuucagcgcgaggccaaggucccucauuugccagcagauaaagcccgaggcacgcaggguccggagcaacagcaucugcuaauaaccgcucccagcucgucuuccucaagucucgaaagcuccgcgucugcacuggacagaagggccccuacacggaaccagccacaggcucccgggguggaggccagcggagcaggcgaagcccgugcuucaacuggcaguuccgauagcucuccugggggacacgguacccaaguuaaugugacauguaucgucaacgugugcucaaguagcgaccacuccucucagugcucgagccaggccuccucaacuaugggcgauaccgacaguucuccaagcgagucccccaaggacgaacagguaccguucucaaaagaggagugugcauuucgcagccaacuugaaacaccugagacccuguuggggucuacugaagagaagccacucccccugggaguuccugaugcgggcaugaagcccuccuga

SEQ ID NO: 496 - RNA, 513 nt, Artificial Sequence
  derived and/or modified CDS sequence (opt3) from Homo sapiens__NP_002623.2__HsPGF
augcccgugaugagacuguucccuugcuuucuccagcuucuggccggcuuggcuuuaccagcagucccgccccaacagugggcccugagcgcggggaacggauccucugagguugaagugguaccuuuccaggaggugugggguaggucauacugucgggcucuagaacgccucgucgacgugguuagugaguauccaagcgaaguggagcacauguuuucccccucuugcgucucgcugcuucgauguaccggcugcuguggggaugagaaucugcauugcgugccuguagaaacagccaacguuacuaugcaguugcucaagauccguucaggagacagaccaagcuacguggagcugacguucagucaacacgucaggugugaaugccggccccugcgcgagaaaaugaagccugagagaaggcggccaaaaggccgcgguaagcgaagaagggaaaaacagcggccgaccgauugucaucucugcggggacgcagugccccgucgcuga

SEQ ID NO: 497 - RNA, 1239 nt, Artificial Sequence
  derived and/or modified CDS sequence (opt3) from Homo sapiens__NP_001020537.2__HsVEGFA
augaccgacagacagacagauacugcccccagcccuuccuaccaucugcucccaggcaggcggcgcacgguggacgcugcagccucucgagggcaaggaccggagcccgcgccugguggcggggucgaaggaguuggcgcucgugguguggcccuuaagcuguucguacaguuguuagggugcucaagauuuggaggcgcaguggucagggccggcgaggcugaaccaaguggggcagcccggagcgcuuccucuggacgcgaggaaccccagccugaggagggugaagaggaagaggagaaagaagaggaaagaggcccacaguggaggcugggggcccggaagcccggaucguggaccggcgaggcggcagugugugccgauucagcuccugccgcacgcgcuccacaagcccuagcgcgagccagcgguagagggggaaggguugcacggcguggcgcugaagagaguggcccgccccacuccccuucucgcagagggagcgccuccagggcuggaccaggucgggccucagagacaaugaacuuccuccugaguugggugcacuggagccuugcacuguugcucuaucugcaucacgccaaauggucucaggcugcgcccauggcagaaggcgggggacagaaucaucacgaggucgugaaguuuauggacguauaccagcgauccuauugccacccuaucgaaacucugguugauauuuuccaagaguacccagacgaaauagaguauaucuuuaaacccucaugugugccgcucaugcgcugcggcgguuguugcaacgaugagggguuagaaugugucccuaccgaggaaagcaauauuacaaugcagaucaugagaauuaagccccaucagggccagcacaucggagagaugaguuuccugcaacauaacaagugcgaauguaggccuaaaaaggaccgggcccgccaggagaaaaagucugugagaggcaaagggaagggacagaagaggaaacguaagaaaucccgguacaagagcuggucgguguaugucggugcucgaugcugucuuaugccauggucuuugcccggcccacaccccugcgggccuugcuccgagagaaggaaacaccuguuuguucaagauccacagaccuguaagugcucauguaaaaauacugacagucgcugcaaggcccggcagcuagaacucaacgagagaacauguaggugcgauaagccgcgccgauga

SEQ ID NO: 498 - RNA, 699 nt, Artificial Sequence
  derived and/or modified CDS sequence (opt3) from Homo sapiens__NP_001165094.1__HsVEGFA
augaacuuccugcucagcugggugcacuggucccuugcccuguuguuauaccugcaucacgcuaaguggucucaggcagcccccauggcggagggcgggggacaaaaucaucacgaagucguuaaauuuauggacguguaucagagaucauacugccauccuaucgagacccuaguagauauuuuccaggaauauccagacgagauagaauacaucuuuaagccgaguugugugccccucaugaggugcgguggcuguugcaacgaugaggggcuggagugugucccuacagaagagagcaauauuacuaugcagaucaugcggauuaaaccacaccaaggacagcacaucggcgaaauguccuuccuucagcauaacaagugcgagugucgccccaaaaaggaccgagcucgucaggagaagaaaucugugagagguaaggggaaaggacaaaagaggaaacggaagaagucgcgcuauaaaucauggagcguuuacgugggcgccagaugcugucugaugccuuggaguuugccaggcccccacccuugcgggccauguuccgaaaggcggaagcaucucuuuguccaggauccgcagacgugcaaaugcucuuguaagaauaccgacagccgcugcaaagcacgacagcuggagcugaacgaaagaacauguaggugcgauaagccccggcguuga

SEQ ID NO: 499 - RNA, 624 nt, Artificial Sequence
  derived and/or modified CDS sequence (opt3) from Homo sapiens__NP_003368.1__HsVEGFB
augagcccccugcucagaaggcuucuguuggccgcuuuacugcagcuagccccugcacaagcgccagugucccagccggacgcucccggccaccagcggaaggucguuucuuggaucgauguguacacccgcgccacaugccagccucgagagguaguggucccacucacuguggaacugauggggacgguugcaaaacaacuugugcccucaugugucaccgugcagcguugcggagguuguugcccugacgauggccuggaguguguaccaacagggcagcaucagguuagaaugcaaauuuugaugauaagguaucccaguagccagcucggagaaaugucccuggaggaacacucucagugcgagugucggccuaagaaaaaggacucggccgugaaaccagaucgcgcugcaacuccgcaucacagaccccagccuaggucagucccaggcugggacagcgcccccggugcuccuaguccagccgauaucacccaucccacaccggcgccugggcccuccgcacacgccgcuccaucuaccacuagcgcccugacaccuggacccgcagcugccgcggccgacgcagcugccuccucaguggcuaagggcggcgccuga

SEQ ID NO: 500 - RNA, 1260 nt, Artificial Sequence
  derived and/or modified CDS sequence (opt3) from Homo sapiens__NP_005420.1__HsVEGFC
augcaccuucucggcuucuuuagcguggccugcucccuucuggcugcagccuuguuacccgggccuagagaggcgccagcugccgcagccgcuuucgaaucuggacuggaccuaucagaugcagagccggacgccggugaagcuaccgccuacgcgaguaaggaucucgaggaacagcugaggagcgucuccucuguugacgagcuuaugacagugcuguaucccgaguacuggaaaauguauaagugucaauugcggaaaggcggguggcagcauaaccgcgaacaggcaaaucucaacucgcgaacugaggaaacgaucaaguuugccgcugcccacuacaauaccgagauucugaaaucaauagauaacgaguggcguaagacacagugcaugccuagagaaguauguaucgacgugggaaaggaguucggcgucgcaacuaauaccuuuuucaaaccacccugcgugagcguuuauagguguggugggugcuguaacagugaaggacugcaaugcaugaauacauccaccucuuaccucagcaagacuuuauuugagauuacagugccucugucccagggcccaaaacccgucaccaucucauucgcuaaccauacgaguugucggugcaugagcaagcuggauguguaucgccagguacacucuauuaucagaagguccuugccugccacucugccacagugucaagcggccaauaaaaccugcccgacaaacuacauguggaauaaccauauaugccggugucuagcacaggaagacuuuauguucucaagcgaugcuggcgacgauaguacugacggguuucacgauaucugcggacccaauaaggagcucgacgaggaaaccugucagugcguuugucgcgccggucugcgaccugcuucuugcggcccacacaaggagcuugacagaaacuccugucagugcguguguaaaaauaagcuguuccccagccaaugcggggccaacagggaauuugaugagaacacaugucagugcgucugcaaacggaccuguccucguaaucagccauugaaccccggaaagugcgcaugugaaugcacggagucgccgcaaaaaugucuccugaagggcaaaaaguuccaucaccagacuugcucuuguuaccgcagaccuugcacaaauaggcagaaggccugugagcccgguuucuccuauucagaagaggugugccggugugugccaaguuacuggaaacgaccucagaugagcuga

SEQ ID NO: 501 - RNA, 1065 nt, Artificial Sequence
  derived and/or modified CDS sequence (opt3) from Homo sapiens__NP_004460.1__HsVEGFD
auguacagagaguggguggucguuaacguguucaugaugcuguauguacagcucgugcaaggcagcuccaaugaacacgggcccgucaagaggucuucacagaguacccuugagcggagcgaacagcagauccgcgccgcuuccucucuggaggaauuguuacgaauuacacauucggaggacuggaaacuguggcguugcagacuaaggcucaagucauuuacuagcauggauagucgguccgcaucucaccgcagcacgagauucgccgcgaccuuuuacgacauagagacacugaaagugaucgaugaagaguggcaaaggacucaguguuccccucgggaaaccugcguugagguggcuucagagcuuggaaagaguacaaacaccuucuuuaaaccaccgugugucaauguguuccgcugcgguggcuguugcaacgaagagagccugauuuguaugaauacuucuacauccuauaucucaaagcaguuguuugaaauuagcguaccccucaccaguguuccugagcuggugccagucaagguggccaaccauacggggugcaaaugucugcccacugcaccucgacacccauacucuaucauaagaagguccauccagauucccgaagaggaccggugcagccauucgaagaaacucuguccuaucgauauguuaugggacucuaauaagugcaaaugcgugcugcaagaggaaaacccacuugccggaaccgaggaucacucccacuugcaggaaccggcucuguguggcccccauaugauguucgacgaggaucguugcgaaugugucugcaagacaccuuguccaaaggaccuaauucagcaccccaaaaauugcucauguuuugagugcaaggagagucucgaaacuuguugccagaaacauaagcuguuccacccugauaccuguagcugcgaggaccgcugcccauuucacacaagacccugugcauccgguaaaaccgccugcgcuaagcauuguagguucccgaaagaaaagcgggccgcgcaagggccucacucucgaaagaaccccuga

SEQ ID NO: 502 - RNA, 72 nt, Artificial Sequence
  derived and/or modified CDS sequence (opt4) from Homo sapiens__AAA59606.1__signal peptide-HLA-A2-SP
auggccgugauggcccccagaacccuggugcugcugcugagcggcgcccuggcccugacccagaccugggcc

SEQ ID NO: 503 - RNA, 69 nt, Artificial Sequence
  derived and/or modified CDS sequence (opt4) from Homo sapiens__AAA61213.1__signal peptide-HsPLAT
auggacgccaugaagagaggccugugcugcgugcugcugcugugcggcgccguguucgugagccccagc

SEQ ID NO: 504 - RNA, 81 nt, Artificial Sequence
  derived and/or modified CDS sequence (opt4) from Homo sapiens__NP_000790.2__signal peptide-HsEPO
augggcgugcacgagugccccgccuggcuguggcugcugcugagccugcugagccugccccugggccugcccgugcugggc

SEQ ID NO: 505 - RNA, 54 nt, Artificial Sequence
  derived and/or modified CDS sequence (opt4) from Homo sapiens__NP_000468.1__signal peptide-HsALB
augaagugggugaccuucaucagccugcuguuccuguucagcagcgccuacagc

SEQ ID NO: 506 - RNA, 18 nt, Artificial Sequence
  derived and/or modified CDS sequence (opt4) from Artificial____cleavage site-Furin
agaagaagaagaaagaga

SEQ ID NO: 507 - RNA, 630 nt, Artificial Sequence
  derived and/or modified CDS sequence (opt4) from Homo sapiens__NP_061986.1__HsFGF21
auggacagcgacgagaccggcuucgagcacagcggccugugggugagcgugcuggccggccugcugcugggcgccugccaggcccaccccauccccgacagcagcccccugcugcaguucggcggccaggugagacagagauaccuguacaccgacgacgcccagcagaccgaggcccaccuggagaucagagaggacggcaccgugggcggcgccgccgaccagagccccgagagccugcugcagcugaaggcccugaagcccggcgugauccagauccugggcgugaagaccagcagauuccugugccagagacccgacggcgcccuguacggcagccugcacuucgaccccgaggccugcagcuucagagagcugcugcuggaggacggcuacaacguguaccagagcgaggcccacggccugccccugcaccugcccggcaacaagagcccccacagagaccccgcccccagaggccccgccagauuccugccccugcccggccugccccccgcccugcccgagccccccggcauccuggccccccagccccccgacgugggcagcagcgacccccugagcauggugggccccagccagggcagaagccccagcuacgccagcuga

SEQ ID NO: 508 - RNA, 1410 nt, Artificial Sequence
  derived and/or modified CDS sequence (opt4) from Homo sapiens__NP_002412.1__HsMMP1
augcacagcuuccccccccugcugcugcugcuguucuggggcguggugagccacagcuuccccgccacccuggagacccaggagcaggacguggaccuggugcagaaguaccuggagaaguacuacaaccugaagaacgacggcagacagguggagaagagaagaaacagcggccccgugguggagaagcugaagcagaugcaggaguucuucggccugaaggugaccggcaagcccgacgccgagacccugaaggugaugaagcagcccagaugcggcgugcccgacguggcccaguucgugcugaccgagggcaaccccagaugggagcagacccaccugaccuacagaaucgagaacuacacccccgaccugcccagagccgacguggaccacgccaucgagaaggccuuccagcuguggagcaacgugaccccccugaccuucaccaaggugagcgagggccaggccgacaucaugaucagcuucgugagaggcgaccacagagacaacagccccuucgacggccccggcggcaaccuggcccacgccuuccagcccggccccggcaucggcggcgacgcccacuucgacgaggacgagagauggaccaacaacuucagagaguacaaccugcacagaguggccgcccacgagcugggccacagccugggccugagccacagcaccgacaucggcgcccugauguaccccagcuacaccuucagcggcgacgugcagcuggcccaggacgacaucgacggcauccaggccaucuacggcagaagccagaaccccgugcagcccaucggcccccagacccccaaggccugcgacagcaagcugaccuucgacgccaucaccaccaucagaggcgaggugauguucuucaaggacagauucuacaugagaaccaaccccuucuaccccgagguggagcugaacuucaucagcguguucuggccccagcugcccaacggccuggaggccgccuacgaguucgccgacagagacgaggugagauucuucaagggcaacaaguacugggccgugcagggccagaacgugcugcacggcuaccccaaggacaucuacagcagcuucggcuuccccagaaccgugaagcacaucgacgccgcccugagcgaggagaacaccggcaagaccuacuucuucguggccaacaaguacuggagauacgacgaguacaagagaagcauggaccccggcuaccccaagaugaucgcccacgacuuccccggcaucggccacaagguggacgccguguucaugaaggacggcuucuucuacuucuuccacggcaccagacaguacaaguucgaccccaagaccaagagaauccugacccugcagaaggccaacagcugguucaacugcagaaagaacuga

SEQ ID NO: 509 - RNA, 1170 nt, Artificial Sequence
  derived and/or modified CDS sequence (opt4) from Homo sapiens__NP_002412.1__HsMMP1(1-19,100-469)
augcacagcuuccccccccugcugcugcugcuguucuggggcguggugagccacagcuucgugcugaccgagggcaaccccagaugggagcagacccaccugaccuacagaaucgagaacuacacccccgaccugcccagagccgacguggaccacgccaucgagaaggccuuccagcuguggagcaacgugaccccccugaccuucaccaaggugagcgagggccaggccgacaucaugaucagcuucgugagaggcgaccacagagacaacagccccuucgacggccccggcggcaaccuggcccacgccuuccagcccggccccggcaucggcggcgacgcccacuucgacgaggacgagagauggaccaacaacuucagagaguacaaccugcacagaguggccgcccacgagcugggccacagccugggccugagccacagcaccgacaucggcgcccugauguaccccagcuacaccuucagcggcgacgugcagcuggcccaggacgacaucgacggcauccaggccaucuacggcagaagccagaaccccgugcagcccaucggcccccagacccccaaggccugcgacagcaagcugaccuucgacgccaucaccaccaucagaggcgaggugauguucuucaaggacagauucuacaugagaaccaaccccuucuaccccgagguggagcugaacuucaucagcguguucuggccccagcugcccaacggccuggaggccgccuacgaguucgccgacagagacgaggugagauucuucaagggcaacaaguacugggccgugcagggccagaacgugcugcacggcuaccccaaggacaucuacagcagcuucggcuuccccagaaccgugaagcacaucgacgccgcccugagcgaggagaacaccggcaagaccuacuucuucguggccaacaaguacuggagauacgacgaguacaagagaagcauggaccccggcuaccccaagaugaucgcccacgacuuccccggcaucggccacaagguggacgccguguucaugaaggacggcuucuucuacuucuuccacggcaccagacaguacaaguucgaccccaagaccaagagaauccugacccugcagaaggccaacagcugguucaacugcagaaagaacuga

SEQ ID NO: 510 - RNA, 3357 nt, Artificial Sequence
  derived and/or modified CDS sequence (opt4) from Clostridium histolyticum__BAA77453.1__ColG
augaagaagaacauccugaagauccugauggacagcuacagcaaggagagcaagauccagaccgugagaagagugaccagcgugagccugcuggccguguaccugaccaugaacaccagcagccuggugcuggccaagcccaucgagaacaccaacgacaccagcaucaagaacguggagaagcugagaaacgcccccaacgaggagaacagcaagaagguggaggacagcaagaacgacaagguggagcacgugaagaacaucgaggaggccaagguggagcagguggcccccgaggugaagagcaagagcacccugagaagcgccagcaucgccaacaccaacagcgagaaguacgacuucgaguaccugaacggccugagcuacaccgagcugaccaaccugaucaagaacaucaaguggaaccagaucaacggccuguucaacuacagcaccggcagccagaaguucuucggcgacaagaacagagugcaggccaucaucaacgcccugcaggagagcggcagaaccuacaccgccaacgacaugaagggcaucgagaccuucaccgaggugcugagagccggcuucuaccugggcuacuacaacgacggccugagcuaccugaacgacagaaacuuccaggacaagugcauccccgccaugaucgccauccagaagaaccccaacuucaagcugggcaccgccgugcaggacgaggugaucaccagccugggcaagcugaucggcaacgccagcgccaacgccgagguggugaacaacugcgugcccgugcugaagcaguucagagagaaccugaaccaguacgcccccgacuacgugaagggcaccgccgugaacgagcugaucaagggcaucgaguucgacuucagcggcgccgccuacgagaaggacgugaagaccaugcccugguacggcaagaucgaccccuucaucaacgagcugaaggcccugggccuguacggcaacaucaccagcgccaccgagugggccagcgacgugggcaucuacuaccugagcaaguucggccuguacagcaccaacagaaacgacaucgugcagagccuggagaaggccguggacauguacaaguacggcaagaucgccuucguggccauggagagaaucaccugggacuacgacggcaucggcagcaacggcaagaagguggaccacgacaaguuccuggacgacgccgagaagcacuaccugcccaagaccuacaccuucgacaacggcaccuucaucaucagagccggcgacaaggugagcgaggagaagaucaagagacuguacugggccagcagagaggugaagagccaguuccacagaguggugggcaacgacaaggcccuggaggugggcaacgccgacgacgugcugaccaugaagaucuucaacagccccgaggaguacaaguucaacaccaacaucaacggcgugagcaccgacaacggcggccuguacaucgagcccagaggcaccuucuacaccuacgagagaaccccccagcagagcaucuucagccuggaggagcuguucagacacgaguacacccacuaccugcaggccagauaccugguggacggccuguggggccagggccccuucuacgagaagaacagacugaccugguucgacgagggcaccgccgaguucuucgccggcagcaccagaaccagcggcgugcugcccagaaagagcauccugggcuaccuggccaaggacaagguggaccacagauacagccugaagaagacccugaacagcggcuacgacgacagcgacuggauguucuacaacuacggcuucgccguggcccacuaccuguacgagaaggacaugcccaccuucaucaagaugaacaaggccauccugaacaccgacgugaagagcuacgacgagaucaucaagaagcugagcgacgacgccaacaagaacaccgaguaccagaaccacauccaggagcuggccgacaaguaccagggcgccggcaucccccuggugagcgacgacuaccugaaggaccacggcuacaagaaggccagcgagguguacagcgagaucagcaaggccgccagccugaccaacaccagcgugaccgccgagaagagccaguacuucaacaccuucacccugagaggcaccuacaccggcgagaccagcaagggcgaguucaaggacugggacgagaugagcaagaagcuggacggcacccuggagagccuggccaagaacagcuggagcggcuacaagacccugaccgccuacuucaccaacuacagagugaccagcgacaacaaggugcaguacgacgugguguuccacggcgugcugaccgacaacgccgacaucagcaacaacaaggcccccaucgccaaggugaccggccccagcaccggcgccgugggcagaaacaucgaguucagcggcaaggacagcaaggacgaggacggcaagaucgugagcuacgacugggacuucggcgacggcgccaccagcagaggcaagaacagcgugcacgccuacaagaaggccggcaccuacaacgugacccugaaggugaccgacgacaagggcgccaccgccaccgagagcuucaccaucgagaucaagaacgaggacaccaccacccccaucaccaaggagauggagcccaacgacgacaucaaggaggccaacggccccaucguggagggcgugaccgugaagggcgaccugaacggcagcgacgacgccgacaccuucuacuucgacgugaaggaggacggcgacgugaccaucgagcugcccuacagcggcagcagcaacuucaccuggcugguguacaaggagggcgacgaccagaaccacaucgccagcggcaucgacaagaacaacagcaaggugggcaccuucaagagcaccaagggcagacacuacguguucaucuacaagcacgacagcgccagcaacaucagcuacagccugaacaucaagggccugggcaacgagaagcugaaggagaaggagaacaacgacagcagcgacaaggccaccgugauccccaacuucaacaccaccaugcagggcagccugcugggcgacgacagcagagacuacuacagcuucgaggugaaggaggagggcgaggugaacaucgagcuggacaagaaggacgaguucggcgugaccuggacccugcaccccgagagcaacaucaacgacagaaucaccuacggccagguggacggcaacaaggugagcaacaaggugaagcugagacccggcaaguacuaccugcugguguacaaguacagcggcagcggcaacuacgagcugagagugaacaaguga

SEQ ID NO: 511 - RNA, 3081 nt, Artificial Sequence
  derived and/or modified CDS sequence (opt4) from Clostridium histolyticum__BAA77453.1__HsALB(1-18)_ColG(111-1118)
augaagugggugaccuucaucagccugcuguuccuguucagcagcgccuacagcaucgccaacaccaacagcgagaaguacgacuucgaguaccugaacggccugagcuacaccgagcugaccaaccugaucaagaacaucaaguggaaccagaucaacggccuguucaacuacagcaccggcagccagaaguucuucggcgacaagaacagagugcaggccaucaucaacgcccugcaggagagcggcagaaccuacaccgccaacgacaugaagggcaucgagaccuucaccgaggugcugagagccggcuucuaccugggcuacuacaacgacggccugagcuaccugaacgacagaaacuuccaggacaagugcauccccgccaugaucgccauccagaagaaccccaacuucaagcugggcaccgccgugcaggacgaggugaucaccagccugggcaagcugaucggcaacgccagcgccaacgccgagguggugaacaacugcgugcccgugcugaagcaguucagagagaaccugaaccaguacgcccccgacuacgugaagggcaccgccgugaacgagcugaucaagggcaucgaguucgacuucagcggcgccgccuacgagaaggacgugaagaccaugcccugguacggcaagaucgaccccuucaucaacgagcugaaggcccugggccuguacggcaacaucaccagcgccaccgagugggccagcgacgugggcaucuacuaccugagcaaguucggccuguacagcaccaacagaaacgacaucgugcagagccuggagaaggccguggacauguacaaguacggcaagaucgccuucguggccauggagagaaucaccugggacuacgacggcaucggcagcaacggcaagaagguggaccacgacaaguuccuggacgacgccgagaagcacuaccugcccaagaccuacaccuucgacaacggcaccuucaucaucagagccggcgacaaggugagcgaggagaagaucaagagacuguacugggccagcagagaggugaagagccaguuccacagaguggugggcaacgacaaggcccuggaggugggcaacgccgacgacgugcugaccaugaagaucuucaacagccccgaggaguacaaguucaacaccaacaucaacggcgugagcaccgacaacggcggccuguacaucgagcccagaggcaccuucuacaccuacgagagaaccccccagcagagcaucuucagccuggaggagcuguucagacacgaguacacccacuaccugcaggccagauaccugguggacggccuguggggccagggccccuucuacgagaagaacagacugaccugguucgacgagggcaccgccgaguucuucgccggcagcaccagaaccagcggcgugcugcccagaaagagcauccugggcuaccuggccaaggacaagguggaccacagauacagccugaagaagacccugaacagcggcuacgacgacagcgacuggauguucuacaacuacggcuucgccguggcccacuaccuguacgagaaggacaugcccaccuucaucaagaugaacaaggccauccugaacaccgacgugaagagcuacgacgagaucaucaagaagcugagcgacgacgccaacaagaacaccgaguaccagaaccacauccaggagcuggccgacaaguaccagggcgccggcaucccccuggugagcgacgacuaccugaaggaccacggcuacaagaaggccagcgagguguacagcgagaucagcaaggccgccagccugaccaacaccagcgugaccgccgagaagagccaguacuucaacaccuucacccugagaggcaccuacaccggcgagaccagcaagggcgaguucaaggacugggacgagaugagcaagaagcuggacggcacccuggagagccuggccaagaacagcuggagcggcuacaagacccugaccgccuacuucaccaacuacagagugaccagcgacaacaaggugcaguacgacgugguguuccacggcgugcugaccgacaacgccgacaucagcaacaacaaggcccccaucgccaaggugaccggccccagcaccggcgccgugggcagaaacaucgaguucagcggcaaggacagcaaggacgaggacggcaagaucgugagcuacgacugggacuucggcgacggcgccaccagcagaggcaagaacagcgugcacgccuacaagaaggccggcaccuacaacgugacccugaaggugaccgacgacaagggcgccaccgccaccgagagcuucaccaucgagaucaagaacgaggacaccaccacccccaucaccaaggagauggagcccaacgacgacaucaaggaggccaacggccccaucguggagggcgugaccgugaagggcgaccugaacggcagcgacgacgccgacaccuucuacuucgacgugaaggaggacggcgacgugaccaucgagcugcccuacagcggcagcagcaacuucaccuggcugguguacaaggagggcgacgaccagaaccacaucgccagcggcaucgacaagaacaacagcaaggugggcaccuucaagagcaccaagggcagacacuacguguucaucuacaagcacgacagcgccagcaacaucagcuacagccugaacaucaagggccugggcaacgagaagcugaaggagaaggagaacaacgacagcagcgacaaggccaccgugauccccaacuucaacaccaccaugcagggcagccugcugggcgacgacagcagagacuacuacagcuucgaggugaaggaggagggcgaggugaacaucgagcuggacaagaaggacgaguucggcgugaccuggacccugcaccccgagagcaacaucaacgacagaaucaccuacggccagguggacggcaacaaggugagcaacaaggugaagcugagacccggcaaguacuaccugcugguguacaaguacagcggcagcggcaacuacgagcugagagugaacaaguga

SEQ ID NO: 512 - RNA, 3429 nt, Artificial Sequence
  derived and/or modified CDS sequence (opt4) from Clostridium histolyticum__BAA77453.1__HsALB(1-18)_ColG(1-110)_CS-F_ColG(111-1 118)
augaagugggugaccuucaucagccugcuguuccuguucagcagcgccuacagcaugaagaagaacauccugaagauccugauggacagcuacagcaaggagagcaagauccagaccgugagaagagugaccagcgugagccugcuggccguguaccugaccaugaacaccagcagccuggugcuggccaagcccaucgagaacaccaacgacaccagcaucaagaacguggagaagcugagaaacgcccccaacgaggagaacagcaagaagguggaggacagcaagaacgacaagguggagcacgugaagaacaucgaggaggccaagguggagcagguggcccccgaggugaagagcaagagcacccugagaagcgccagcagaagaagaagaaagagaaucgccaacaccaacagcgagaaguacgacuucgaguaccugaacggccugagcuacaccgagcugaccaaccugaucaagaacaucaaguggaaccagaucaacggccuguucaacuacagcaccggcagccagaaguucuucggcgacaagaacagagugcaggccaucaucaacgcccugcaggagagcggcagaaccuacaccgccaacgacaugaagggcaucgagaccuucaccgaggugcugagagccggcuucuaccugggcuacuacaacgacggccugagcuaccugaacgacagaaacuuccaggacaagugcauccccgccaugaucgccauccagaagaaccccaacuucaagcugggcaccgccgugcaggacgaggugaucaccagccugggcaagcugaucggcaacgccagcgccaacgccgagguggugaacaacugcgugcccgugcugaagcaguucagagagaaccugaaccaguacgcccccgacuacgugaagggcaccgccgugaacgagcugaucaagggcaucgaguucgacuucagcggcgccgccuacgagaaggacgugaagaccaugcccugguacggcaagaucgaccccuucaucaacgagcugaaggcccugggccuguacggcaacaucaccagcgccaccgagugggccagcgacgugggcaucuacuaccugagcaaguucggccuguacagcaccaacagaaacgacaucgugcagagccuggagaaggccguggacauguacaaguacggcaagaucgccuucguggccauggagagaaucaccugggacuacgacggcaucggcagcaacggcaagaagguggaccacgacaaguuccuggacgacgccgagaagcacuaccugcccaagaccuacaccuucgacaacggcaccuucaucaucagagccggcgacaaggugagcgaggagaagaucaagagacuguacugggccagcagagaggugaagagccaguuccacagaguggugggcaacgacaaggcccuggaggugggcaacgccgacgacgugcugaccaugaagaucuucaacagccccgaggaguacaaguucaacaccaacaucaacggcgugagcaccgacaacggcggccuguacaucgagcccagaggcaccuucuacaccuacgagagaaccccccagcagagcaucuucagccuggaggagcuguucagacacgaguacacccacuaccugcaggccagauaccugguggacggccuguggggccagggccccuucuacgagaagaacagacugaccugguucgacgagggcaccgccgaguucuucgccggcagcaccagaaccagcggcgugcugcccagaaagagcauccugggcuaccuggccaaggacaagguggaccacagauacagccugaagaagacccugaacagcggcuacgacgacagcgacuggauguucuacaacuacggcuucgccguggcccacuaccuguacgagaaggacaugcccaccuucaucaagaugaacaaggccauccugaacaccgacgugaagagcuacgacgagaucaucaagaagcugagcgacgacgccaacaagaacaccgaguaccagaaccacauccaggagcuggccgacaaguaccagggcgccggcaucccccuggugagcgacgacuaccugaaggaccacggcuacaagaaggccagcgagguguacagcgagaucagcaaggccgccagccugaccaacaccagcgugaccgccgagaagagccaguacuucaacaccuucacccugagaggcaccuacaccggcgagaccagcaagggcgaguucaaggacugggacgagaugagcaagaagcuggacggcacccuggagagccuggccaagaacagcuggagcggcuacaagacccugaccgccuacuucaccaacuacagagugaccagcgacaacaaggugcaguacgacgugguguuccacggcgugcugaccgacaacgccgacaucagcaacaacaaggcccccaucgccaaggugaccggccccagcaccggcgccgugggcagaaacaucgaguucagcggcaaggacagcaaggacgaggacggcaagaucgugagcuacgacugggacuucggcgacggcgccaccagcagaggcaagaacagcgugcacgccuacaagaaggccggcaccuacaacgugacccugaaggugaccgacgacaagggcgccaccgccaccgagagcuucaccaucgagaucaagaacgaggacaccaccacccccaucaccaaggagauggagcccaacgacgacaucaaggaggccaacggccccaucguggagggcgugaccgugaagggcgaccugaacggcagcgacgacgccgacaccuucuacuucgacgugaaggaggacggcgacgugaccaucgagcugcccuacagcggcagcagcaacuucaccuggcugguguacaaggagggcgacgaccagaaccacaucgccagcggcaucgacaagaacaacagcaaggugggcaccuucaagagcaccaagggcagacacuacguguucaucuacaagcacgacagcgccagcaacaucagcuacagccugaacaucaagggccugggcaacgagaagcugaaggagaaggagaacaacgacagcagcgacaaggccaccgugauccccaacuucaacaccaccaugcagggcagccugcugggcgacgacagcagagacuacuacagcuucgaggugaaggaggagggcgaggugaacaucgagcuggacaagaaggacgaguucggcgugaccuggacccugcaccccgagagcaacaucaacgacagaaucaccuacggccagguggacggcaacaaggugagcaacaaggugaagcugagacccggcaaguacuaccugcugguguacaaguacagcggcagcggcaacuacgagcugagagugaacaaguga

SEQ ID NO: 513 - RNA, 3105 nt, Artificial Sequence
  derived and/or modified CDS sequence (opt4) from Clostridium histolyticum__BAA34542.1__ColH
augaacuuccugaagaucauccugaacagaggcaagaccaugaagagaaagugccugagcaagagacugaugcuggccaucaccauggccaccaucuucaccgugaacagcacccugcccaucuacgccgccguggacaagaacaacgccaccgccgccgugcagaacgagagcaagagauacaccgugagcuaccugaagacccugaacuacuacgaccugguggaccugcuggugaagaccgagaucgagaaccugcccgaccuguuccaguacagcagcgacgccaaggaguucuacggcaacaagaccagaaugagcuucaucauggacgagaucggcagaagagccccccaguacaccgagaucgaccacaagggcauccccacccugguggagguggugagagccggcuucuaccugggcuuccacaacaaggagcugaacgagaucaacaagagaagcuucaaggagagagugauccccagcauccuggccauccagaagaaccccaacuucaagcugggcaccgaggugcaggacaagaucgugagcgccaccggccugcuggccggcaacgagaccgccccccccgagguggugaacaacuucacccccauccugcaggacugcaucaagaacaucgacagauacgcccuggacgaccugaagagcaaggcccuguucaacgugcuggccgcccccaccuacgacaucaccgaguaccugagagccaccaaggagaagcccgagaacacccccugguacggcaagaucgacggcuucaucaacgagcugaagaagcuggcccuguacggcaagaucaacgacaacaacagcuggaucaucgacaacggcaucuaccacaucgccccccugggcaagcugcacagcaacaacaagaucggcaucgagacccugaccgaggugaugaagguguaccccuaccugagcaugcagcaccugcagagcgccgaccagaucaagagacacuacgacagcaaggacgccgagggcaacaagaucccccuggacaaguucaagaaggagggcaaggagaaguacugccccaagaccuacaccuucgacgacggcaaggugaucaucaaggccggcgccagaguggaggaggagaaggugaagagacuguacugggccagcaaggaggugaacagccaguucuucagaguguacggcaucgacaagccccuggaggagggcaaccccgacgacauccugaccauggugaucuacaacagccccgaggaguacaagcugaacagcgugcuguacggcuacgacaccaacaacggcggcauguacaucgagcccgagggcaccuucuucaccuacgagagagaggcccaggagagcaccuacacccuggaggagcuguucagacacgaguacacccacuaccugcagggcagauacgccgugcccggccaguggggcagaaccaagcuguacgacaacgacagacugaccugguacgaggagggcggcgccgagcuguucgccggcagcaccagaaccagcggcauccugcccagaaagagcaucgugagcaacauccacaacaccaccagaaacaacagauacaagcugagcgacaccgugcacagcaaguacggcgccagcuucgaguucuacaacuacgccugcauguucauggacuacauguacaacaaggacaugggcauccugaacaagcugaacgaccuggccaagaacaacgacguggacggcuacgacaacuacaucagagaccugagcagcaacuacgcccugaacgacaaguaccaggaccacaugcaggagagaaucgacaacuacgagaaccugaccgugcccuucguggccgacgacuaccuggugagacacgccuacaagaaccccaacgagaucuacagcgagaucagcgagguggccaagcugaaggacgccaagagcgaggugaagaagagccaguacuucagcaccuucacccugagaggcagcuacaccggcggcgccagcaagggcaagcuggaggaccagaaggccaugaacaaguucaucgacgacagccugaagaagcuggacaccuacagcuggagcggcuacaagacccugaccgccuacuucaccaacuacaagguggacagcagcaacagagugaccuacgacgugguguuccacggcuaccugcccaacgagggcgacagcaagaacagccugcccuacggcaagaucaacggcaccuacaagggcaccgagaaggagaagaucaaguucagcagcgagggcagcuucgaccccgacggcaagaucgugagcuacgagugggacuucggcgacggcaacaagagcaacgaggagaaccccgagcacagcuacgacaaggugggcaccuacaccgugaagcugaaggugaccgacgacaagggcgagagcagcgugagcaccaccaccgccgagaucaaggaccugagcgagaacaagcugcccgugaucuacaugcacgugcccaagagcggcgcccugaaccagaaggugguguucuacggcaagggcaccuacgaccccgacggcagcaucgccggcuaccagugggacuucggcgacggcagcgacuucagcagcgagcagaaccccagccacguguacaccaagaagggcgaguacaccgugacccugagagugauggacagcagcggccagaugagcgagaagaccaugaagaucaagaucaccgaccccguguaccccaucggcaccgagaaggagcccaacaacagcaaggagaccgccagcggccccaucgugcccggcauccccgugagcggcaccaucgagaacaccagcgaccaggacuacuucuacuucgacgugaucacccccggcgaggugaagaucgacaucaacaagcugggcuacggcggcgccaccugggugguguacgacgagaacaacaacgccgugagcuacgccaccgacgacggccagaaccugagcggcaaguucaaggccgacaagcccggcagauacuacauccaccuguacauguucaacggcagcuacaugcccuacagaaucaacaucgagggcagcgugggcagauga

SEQ ID NO: 514 - RNA, 3066 nt, Artificial Sequence
  derived and/or modified CDS sequence (opt4) from Clostridium histolyticum__BAA34542.1__ColH
augaagagaaagugccugagcaagagacugaugcuggccaucaccauggccaccaucuucaccgugaacagcacccugcccaucuacgccgccguggacaagaacaacgccaccgccgccgugcagaacgagagcaagagauacaccgugagcuaccugaagacccugaacuacuacgaccugguggaccugcuggugaagaccgagaucgagaaccugcccgaccuguuccaguacagcagcgacgccaaggaguucuacggcaacaagaccagaaugagcuucaucauggacgagaucggcagaagagccccccaguacaccgagaucgaccacaagggcauccccacccugguggagguggugagagccggcuucuaccugggcuuccacaacaaggagcugaacgagaucaacaagagaagcuucaaggagagagugauccccagcauccuggccauccagaagaaccccaacuucaagcugggcaccgaggugcaggacaagaucgugagcgccaccggccugcuggccggcaacgagaccgccccccccgagguggugaacaacuucacccccauccugcaggacugcaucaagaacaucgacagauacgcccuggacgaccugaagagcaaggcccuguucaacgugcuggccgcccccaccuacgacaucaccgaguaccugagagccaccaaggagaagcccgagaacacccccugguacggcaagaucgacggcuucaucaacgagcugaagaagcuggcccuguacggcaagaucaacgacaacaacagcuggaucaucgacaacggcaucuaccacaucgccccccugggcaagcugcacagcaacaacaagaucggcaucgagacccugaccgaggugaugaagguguaccccuaccugagcaugcagcaccugcagagcgccgaccagaucaagagacacuacgacagcaaggacgccgagggcaacaagaucccccuggacaaguucaagaaggagggcaaggagaaguacugccccaagaccuacaccuucgacgacggcaaggugaucaucaaggccggcgccagaguggaggaggagaaggugaagagacuguacugggccagcaaggaggugaacagccaguucuucagaguguacggcaucgacaagccccuggaggagggcaaccccgacgacauccugaccauggugaucuacaacagccccgaggaguacaagcugaacagcgugcuguacggcuacgacaccaacaacggcggcauguacaucgagcccgagggcaccuucuucaccuacgagagagaggcccaggagagcaccuacacccuggaggagcuguucagacacgaguacacccacuaccugcagggcagauacgccgugcccggccaguggggcagaaccaagcuguacgacaacgacagacugaccugguacgaggagggcggcgccgagcuguucgccggcagcaccagaaccagcggcauccugcccagaaagagcaucgugagcaacauccacaacaccaccagaaacaacagauacaagcugagcgacaccgugcacagcaaguacggcgccagcuucgaguucuacaacuacgccugcauguucauggacuacauguacaacaaggacaugggcauccugaacaagcugaacgaccuggccaagaacaacgacguggacggcuacgacaacuacaucagagaccugagcagcaacuacgcccugaacgacaaguaccaggaccacaugcaggagagaaucgacaacuacgagaaccugaccgugcccuucguggccgacgacuaccuggugagacacgccuacaagaaccccaacgagaucuacagcgagaucagcgagguggccaagcugaaggacgccaagagcgaggugaagaagagccaguacuucagcaccuucacccugagaggcagcuacaccggcggcgccagcaagggcaagcuggaggaccagaaggccaugaacaaguucaucgacgacagccugaagaagcuggacaccuacagcuggagcggcuacaagacccugaccgccuacuucaccaacuacaagguggacagcagcaacagagugaccuacgacgugguguuccacggcuaccugcccaacgagggcgacagcaagaacagccugcccuacggcaagaucaacggcaccuacaagggcaccgagaaggagaagaucaaguucagcagcgagggcagcuucgaccccgacggcaagaucgugagcuacgagugggacuucggcgacggcaacaagagcaacgaggagaaccccgagcacagcuacgacaaggugggcaccuacaccgugaagcugaaggugaccgacgacaagggcgagagcagcgugagcaccaccaccgccgagaucaaggaccugagcgagaacaagcugcccgugaucuacaugcacgugcccaagagcggcgcccugaaccagaaggugguguucuacggcaagggcaccuacgaccccgacggcagcaucgccggcuaccagugggacuucggcgacggcagcgacuucagcagcgagcagaaccccagccacguguacaccaagaagggcgaguacaccgugacccugagagugauggacagcagcggccagaugagcgagaagaccaugaagaucaagaucaccgaccccguguaccccaucggcaccgagaaggagcccaacaacagcaaggagaccgccagcggccccaucgugcccggcauccccgugagcggcaccaucgagaacaccagcgaccaggacuacuucuacuucgacgugaucacccccggcgaggugaagaucgacaucaacaagcugggcuacggcggcgccaccugggugguguacgacgagaacaacaacgccgugagcuacgccaccgacgacggccagaaccugagcggcaaguucaaggccgacaagcccggcagauacuacauccaccuguacauguucaacggcagcuacaugcccuacagaaucaacaucgagggcagcgugggcagauga

SEQ ID NO: 515 - RNA, 3000 nt, Artificial Sequence
  derived and/or modified CDS sequence (opt4) from Clostridium histolyticum__BAA34542.1__HsALB(1-18)_ColH(41-1021)
augaagugggugaccuucaucagccugcuguuccuguucagcagcgccuacagcgugcagaacgagagcaagagauacaccgugagcuaccugaagacccugaacuacuacgaccugguggaccugcuggugaagaccgagaucgagaaccugcccgaccuguuccaguacagcagcgacgccaaggaguucuacggcaacaagaccagaaugagcuucaucauggacgagaucggcagaagagccccccaguacaccgagaucgaccacaagggcauccccacccugguggagguggugagagccggcuucuaccugggcuuccacaacaaggagcugaacgagaucaacaagagaagcuucaaggagagagugauccccagcauccuggccauccagaagaaccccaacuucaagcugggcaccgaggugcaggacaagaucgugagcgccaccggccugcuggccggcaacgagaccgccccccccgagguggugaacaacuucacccccauccugcaggacugcaucaagaacaucgacagauacgcccuggacgaccugaagagcaaggcccuguucaacgugcuggccgcccccaccuacgacaucaccgaguaccugagagccaccaaggagaagcccgagaacacccccugguacggcaagaucgacggcuucaucaacgagcugaagaagcuggcccuguacggcaagaucaacgacaacaacagcuggaucaucgacaacggcaucuaccacaucgccccccugggcaagcugcacagcaacaacaagaucggcaucgagacccugaccgaggugaugaagguguaccccuaccugagcaugcagcaccugcagagcgccgaccagaucaagagacacuacgacagcaaggacgccgagggcaacaagaucccccuggacaaguucaagaaggagggcaaggagaaguacugccccaagaccuacaccuucgacgacggcaaggugaucaucaaggccggcgccagaguggaggaggagaaggugaagagacuguacugggccagcaaggaggugaacagccaguucuucagaguguacggcaucgacaagccccuggaggagggcaaccccgacgacauccugaccauggugaucuacaacagccccgaggaguacaagcugaacagcgugcuguacggcuacgacaccaacaacggcggcauguacaucgagcccgagggcaccuucuucaccuacgagagagaggcccaggagagcaccuacacccuggaggagcuguucagacacgaguacacccacuaccugcagggcagauacgccgugcccggccaguggggcagaaccaagcuguacgacaacgacagacugaccugguacgaggagggcggcgccgagcuguucgccggcagcaccagaaccagcggcauccugcccagaaagagcaucgugagcaacauccacaacaccaccagaaacaacagauacaagcugagcgacaccgugcacagcaaguacggcgccagcuucgaguucuacaacuacgccugcauguucauggacuacauguacaacaaggacaugggcauccugaacaagcugaacgaccuggccaagaacaacgacguggacggcuacgacaacuacaucagagaccugagcagcaacuacgcccugaacgacaaguaccaggaccacaugcaggagagaaucgacaacuacgagaaccugaccgugcccuucguggccgacgacuaccuggugagacacgccuacaagaaccccaacgagaucuacagcgagaucagcgagguggccaagcugaaggacgccaagagcgaggugaagaagagccaguacuucagcaccuucacccugagaggcagcuacaccggcggcgccagcaagggcaagcuggaggaccagaaggccaugaacaaguucaucgacgacagccugaagaagcuggacaccuacagcuggagcggcuacaagacccugaccgccuacuucaccaacuacaagguggacagcagcaacagagugaccuacgacgugguguuccacggcuaccugcccaacgagggcgacagcaagaacagccugcccuacggcaagaucaacggcaccuacaagggcaccgagaaggagaagaucaaguucagcagcgagggcagcuucgaccccgacggcaagaucgugagcuacgagugggacuucggcgacggcaacaagagcaacgaggagaaccccgagcacagcuacgacaaggugggcaccuacaccgugaagcugaaggugaccgacgacaagggcgagagcagcgugagcaccaccaccgccgagaucaaggaccugagcgagaacaagcugcccgugaucuacaugcacgugcccaagagcggcgcccugaaccagaaggugguguucuacggcaagggcaccuacgaccccgacggcagcaucgccggcuaccagugggacuucggcgacggcagcgacuucagcagcgagcagaaccccagccacguguacaccaagaagggcgaguacaccgugacccugagagugauggacagcagcggccagaugagcgagaagaccaugaagaucaagaucaccgaccccguguaccccaucggcaccgagaaggagcccaacaacagcaaggagaccgccagcggccccaucgugcccggcauccccgugagcggcaccaucgagaacaccagcgaccaggacuacuucuacuucgacgugaucacccccggcgaggugaagaucgacaucaacaagcugggcuacggcggcgccaccugggugguguacgacgagaacaacaacgccgugagcuacgccaccgacgacggccagaaccugagcggcaaguucaaggccgacaagcccggcagauacuacauccaccuguacauguucaacggcagcuacaugcccuacagaaucaacaucgagggcagcgugggcagauga

SEQ ID NO: 516 - RNA, 3138 nt, Artificial Sequence
  derived and/or modified CDS sequence (opt4) from Clostridium histolyticum__BAA34542.1__HsALB(1-18)_ColH(1-40)_CS-F_ColH(41-102 1)
augaagugggugaccuucaucagccugcuguuccuguucagcagcgccuacagcaugaagagaaagugccugagcaagagacugaugcuggccaucaccauggccaccaucuucaccgugaacagcacccugcccaucuacgccgccguggacaagaacaacgccaccgccgccagaagaagaagaaagagagugcagaacgagagcaagagauacaccgugagcuaccugaagacccugaacuacuacgaccugguggaccugcuggugaagaccgagaucgagaaccugcccgaccuguuccaguacagcagcgacgccaaggaguucuacggcaacaagaccagaaugagcuucaucauggacgagaucggcagaagagccccccaguacaccgagaucgaccacaagggcauccccacccugguggagguggugagagccggcuucuaccugggcuuccacaacaaggagcugaacgagaucaacaagagaagcuucaaggagagagugauccccagcauccuggccauccagaagaaccccaacuucaagcugggcaccgaggugcaggacaagaucgugagcgccaccggccugcuggccggcaacgagaccgccccccccgagguggugaacaacuucacccccauccugcaggacugcaucaagaacaucgacagauacgcccuggacgaccugaagagcaaggcccuguucaacgugcuggccgcccccaccuacgacaucaccgaguaccugagagccaccaaggagaagcccgagaacacccccugguacggcaagaucgacggcuucaucaacgagcugaagaagcuggcccuguacggcaagaucaacgacaacaacagcuggaucaucgacaacggcaucuaccacaucgccccccugggcaagcugcacagcaacaacaagaucggcaucgagacccugaccgaggugaugaagguguaccccuaccugagcaugcagcaccugcagagcgccgaccagaucaagagacacuacgacagcaaggacgccgagggcaacaagaucccccuggacaaguucaagaaggagggcaaggagaaguacugccccaagaccuacaccuucgacgacggcaaggugaucaucaaggccggcgccagaguggaggaggagaaggugaagagacuguacugggccagcaaggaggugaacagccaguucuucagaguguacggcaucgacaagccccuggaggagggcaaccccgacgacauccugaccauggugaucuacaacagccccgaggaguacaagcugaacagcgugcuguacggcuacgacaccaacaacggcggcauguacaucgagcccgagggcaccuucuucaccuacgagagagaggcccaggagagcaccuacacccuggaggagcuguucagacacgaguacacccacuaccugcagggcagauacgccgugcccggccaguggggcagaaccaagcuguacgacaacgacagacugaccugguacgaggagggcggcgccgagcuguucgccggcagcaccagaaccagcggcauccugcccagaaagagcaucgugagcaacauccacaacaccaccagaaacaacagauacaagcugagcgacaccgugcacagcaaguacggcgccagcuucgaguucuacaacuacgccugcauguucauggacuacauguacaacaaggacaugggcauccugaacaagcugaacgaccuggccaagaacaacgacguggacggcuacgacaacuacaucagagaccugagcagcaacuacgcccugaacgacaaguaccaggaccacaugcaggagagaaucgacaacuacgagaaccugaccgugcccuucguggccgacgacuaccuggugagacacgccuacaagaaccccaacgagaucuacagcgagaucagcgagguggccaagcugaaggacgccaagagcgaggugaagaagagccaguacuucagcaccuucacccugagaggcagcuacaccggcggcgccagcaagggcaagcuggaggaccagaaggccaugaacaaguucaucgacgacagccugaagaagcuggacaccuacagcuggagcggcuacaagacccugaccgccuacuucaccaacuacaagguggacagcagcaacagagugaccuacgacgugguguuccacggcuaccugcccaacgagggcgacagcaagaacagccugcccuacggcaagaucaacggcaccuacaagggcaccgagaaggagaagaucaaguucagcagcgagggcagcuucgaccccgacggcaagaucgugagcuacgagugggacuucggcgacggcaacaagagcaacgaggagaaccccgagcacagcuacgacaaggugggcaccuacaccgugaagcugaaggugaccgacgacaagggcgagagcagcgugagcaccaccaccgccgagaucaaggaccugagcgagaacaagcugcccgugaucuacaugcacgugcccaagagcggcgcccugaaccagaaggugguguucuacggcaagggcaccuacgaccccgacggcagcaucgccggcuaccagugggacuucggcgacggcagcgacuucagcagcgagcagaaccccagccacguguacaccaagaagggcgaguacaccgugacccugagagugauggacagcagcggccagaugagcgagaagaccaugaagaucaagaucaccgaccccguguaccccaucggcaccgagaaggagcccaacaacagcaaggagaccgccagcggccccaucgugcccggcauccccgugagcggcaccaucgagaacaccagcgaccaggacuacuucuacuucgacgugaucacccccggcgaggugaagaucgacaucaacaagcugggcuacggcggcgccaccugggugguguacgacgagaacaacaacgccgugagcuacgccaccgacgacggccagaaccugagcggcaaguucaaggccgacaagcccggcagauacuacauccaccuguacauguucaacggcagcuacaugcccuacagaaucaacaucgagggcagcgugggcagauga

SEQ ID NO: 517 - RNA, 576 nt, Artificial Sequence
  derived and/or modified CDS sequence (opt4) from Homo sapiens__NP_001133.1__HsAMELX
augggcaccuggauccuguucgccugccugcugggcgccgccuucgccaugccccugcccccccaccccggccaccccggcuacaucaacuucagcuacgaggugcugaccccccugaagugguaccagagcaucagaccccccuaccccagcuacggcuacgagcccaugggcggcuggcugcaccaccagaucauccccgugcugagccagcagcacccccccacccacacccugcagccccaccaccacauccccguggugcccgcccagcagcccgugaucccccagcagcccaugaugcccgugcccggccagcacagcaugacccccauccagcaccaccagcccaaccugcccccccccgcccagcagcccuaccagccccagcccgugcagccccagccccaccagcccaugcagccccagccccccgugcaccccaugcagccccugcccccccagcccccccugccccccauguuccccaugcagccccugccccccaugcugcccgaccugacccuggaggccuggcccagcaccgacaagaccaagagagaggagguggacuga

SEQ ID NO: 518 - RNA, 135 nt, Artificial Sequence
  derived and/or modified CDS sequence (opt4) from Homo sapiens__NP_001133.1__HsAMELX-TRAP
augccccugcccccccaccccggccaccccggcuacaucaacuucagcuacgaggugcugaccccccugaagugguaccagagcaucagaccccccuaccccagcuacggcuacgagcccaugggcggcugguga

SEQ ID NO: 519 - RNA, 168 nt, Artificial Sequence
  derived and/or modified CDS sequence (opt4) from Homo sapiens__NP_001133.1__HsAMELX-LRAP
augccccugcccccccaccccggccaccccggcuacaucaacuucagcuacgaggugcugaccccccugaagugguaccagagcaucagacccccccccaugcugcccgaccugacccuggaggccuggcccagcaccgacaagaccaagagagaggagguggacuga

SEQ ID NO: 520 - RNA, 207 nt, Artificial Sequence
  derived and/or modified CDS sequence (opt4) from Homo sapiens__NP_001133.1__HLA-A2-SP_HsAMELX(17-60)
auggccgugauggcccccagaacccuggugcugcugcugagcggcgcccuggcccugacccagaccugggccaugccccugcccccccaccccggccaccccggcuacaucaacuucagcuacgaggugcugaccccccugaagugguaccagagcaucagaccccccuaccccagcuacggcuacgagcccaugggcggcugguga

SEQ ID NO: 521 - RNA, 240 nt, Artificial Sequence
  derived and/or modified CDS sequence (opt4) from Homo sapiens__NP_001133.1__HLA-A2-SP_HsAMELX(17-47,168-191)
auggccgugauggcccccagaacccuggugcugcugcugagcggcgcccuggcccugacccagaccugggccaugccccugcccccccaccccggccaccccggcuacaucaacuucagcuacgaggugcugaccccccugaagugguaccagagcaucagacccccccccaugcugcccgaccugacccuggaggccuggcccagcaccgacaagaccaagagagaggagguggacuga

SEQ ID NO: 522 - RNA, 579 nt, Artificial Sequence
  derived and/or modified CDS sequence (opt4) from Homo sapiens__NP_001134.1__HsAMELY
augggcaccuggauccuguucgccugccuggugggcgccgccuucgccaugccccugcccccccaccccggccaccccggcuacaucaacuucagcuacgaggugcugaccccccugaagugguaccagagcaugaucagaccccccuacagcagcuacggcuacgagcccaugggcggcuggcugcaccaccagaucauccccguggugagccagcagcacccccugacccacacccugcagagccaccaccacauccccguggugcccgcccagcagcccagagugagacagcaggcccugaugcccgugcccggccagcagagcaugacccccacccagcaccaccagcccaaccugccccugcccgcccagcagcccuuccagccccagcccgugcagccccagccccaccagcccaugcagccccagccccccgugcagcccaugcagccccugcugccccagcccccccugccccccauguucccccugagaccccugccccccauccugcccgaccugcaccuggaggccuggcccgccaccgacaagaccaagcaggaggagguggacuga

SEQ ID NO: 523 - RNA, 138 nt, Artificial Sequence
  derived and/or modified CDS sequence (opt4) from Homo sapiens__NP_001134.1__HsAMELY-TRAP
augccccugcccccccaccccggccaccccggcuacaucaacuucagcuacgaggugcugaccccccugaagugguaccagagcaugaucagaccccccuacagcagcuacggcuacgagcccaugggcggcugguga

SEQ ID NO: 524 - RNA, 171 nt, Artificial Sequence
  derived and/or modified CDS sequence (opt4) from Homo sapiens__NP_001134.1__HsAMELY-LRAP
augccccugcccccccaccccggccaccccggcuacaucaacuucagcuacgaggugcugaccccccugaagugguaccagagcaugaucagacccccccccauccugcccgaccugcaccuggaggccuggcccgccaccgacaagaccaagcaggaggagguggacuga

SEQ ID NO: 525 - RNA, 210 nt, Artificial Sequence
  derived and/or modified CDS sequence (opt4) from Homo sapiens__NP_001134.1__HLA-A2-SP_HsAMELY(17-61)
auggccgugauggcccccagaacccuggugcugcugcugagcggcgcccuggcccugacccagaccugggccaugccccugcccccccaccccggccaccccggcuacaucaacuucagcuacgaggugcugaccccccugaagugguaccagagcaugaucagaccccccuacagcagcuacggcuacgagcccaugggcggcugguga

SEQ ID NO: 526 - RNA, 243 nt, Artificial Sequence
  derived and/or modified CDS sequence (opt4) from Homo sapiens__NP_001134.1__HLA-A2-SP_HsAMELY(17-48,169-192)
auggccgugauggcccccagaacccuggugcugcugcugagcggcgcccuggcccugacccagaccugggccaugccccugcccccccaccccggccaccccggcuacaucaacuucagcuacgaggugcugaccccccugaagugguaccagagcaugaucagacccccccccauccugcccgaccugcaccuggaggccuggcccgccaccgacaagaccaagcaggaggagguggacuga

SEQ ID NO: 527 - RNA, 570 nt, Artificial Sequence
  derived and/or modified CDS sequence (opt4) from Sus scrofa__NP_999071.1__SsAMELX-001-1
augggcaccuggauccuguucgccugccugcugggcgccgccuucagcaugccccugcccccccaccccggccaccccggcuacaucaacuucagcuacgaggugcugaccccccugaagugguaccagaacaugaucagacaccccuacaccagcuacggcuacgagcccaugggcggcuggcugcaccaccagaucauccccguggugagccagcagaccccccagagccacgcccugcagccccaccaccacauccccauggugcccgcccagcagcccggcaucccccagcagcccaugaugccccugcccggccagcacagcaugacccccacccagcaccaccagcccaaccugccccugcccgcccagcagcccuuccagccccagcccgugcagccccagccccaccagccccugcagccccagagccccaugcaccccauccagccccugcugccccagcccccccugccccccauguucagcaugcagagccugcugcccgaccugccccuggaggccuggcccgccaccgacaagaccaagagagaggagguggacuga

SEQ ID NO: 528 - RNA, 138 nt, Artificial Sequence
  derived and/or modified CDS sequence (opt4) from Sus scrofa__NP_999071.1__SsAMELX-TRAP
augccccugcccccccaccccggccaccccggcuacaucaacuucagcuacgaggugcugaccccccugaagugguaccagaacaugaucagacaccccuacaccagcuacggcuacgagcccaugggcggcugguga

SEQ ID NO: 529 - RNA, 171 nt, Artificial Sequence
  derived and/or modified CDS sequence (opt4) from Sus scrofa__NP_999071.1__SsAMELX-LRAP
augccccugcccccccaccccggccaccccggcuacaucaacuucagcuacgaggugcugaccccccugaagugguaccagaacaugaucagacaccccagccugcugcccgaccugccccuggaggccuggcccgccaccgacaagaccaagagagaggagguggacuga

SEQ ID NO: 530 - RNA, 210 nt, Artificial Sequence
  derived and/or modified CDS sequence (opt4) from Sus scrofa__NP_999071.1__HLA-A2-SP_SsAMEL(17-61)
auggccgugauggcccccagaacccuggugcugcugcugagcggcgcccuggcccugacccagaccugggccaugccccugcccccccaccccggccaccccggcuacaucaacuucagcuacgaggugcugaccccccugaagugguaccagaacaugaucagacaccccuacaccagcuacggcuacgagcccaugggcggcugguga

SEQ ID NO: 531 - RNA, 243 nt, Artificial Sequence
  derived and/or modified CDS sequence (opt4) from Sus scrofa__NP_999071.1__HLA-A2-SP_SsAMEL(17-49,167-189)
auggccgugauggcccccagaacccuggugcugcugcugagcggcgcccuggcccugacccagaccugggccaugccccugcccccccaccccggccaccccggcuacaucaacuucagcuacgaggugcugaccccccugaagugguaccagaacaugaucagacaccccagccugcugcccgaccugccccuggaggccuggcccgccaccgacaagaccaagagagaggagguggacuga

SEQ ID NO: 532 - RNA, 534 nt, Artificial Sequence
  derived and/or modified CDS sequence (opt4) from Sus scrofa__P45561-2__SsAMELX-001-2
augggcaccuggauccuguucgccugccugcugggcgccgccuucagcaugccccugcccccccaccccggccaccccggcuacaucaacuucagcuacaucagacaccccuacaccagcuacggcuacgagcccaugggcggcuggcugcaccaccagaucauccccguggugagccagcagaccccccagagccacgcccugcagccccaccaccacauccccauggugcccgcccagcagcccggcaucccccagcagcccaugaugccccugcccggccagcacagcaugacccccacccagcaccaccagcccaaccugccccugcccgcccagcagcccuuccagccccagcccgugcagccccagccccaccagccccugcagccccagagccccaugcaccccauccagccccugcugccccagcccccccugccccccauguucagcaugcagagccugcugcccgaccugccccuggaggccuggcccgccaccgacaagaccaagagagaggagguggacuga

SEQ ID NO: 533 - RNA, 570 nt, Artificial Sequence
  derived and/or modified CDS sequence (opt4) from Sus scrofa__NP_998965.1__SsAMELX-001-3
augggcaccuggaucuucuucgccugccugcugggcgccagccuggccaugccccugcccccccaccccggccaccccggcuacaucaacuucagcuacgaggugcugaccccccugaagugguaccagaacaugaucagacaccccuacaccagcuacggcuacgagcccaugggcggcuggcugcaccaccagaucauccccguggugagccagcagaccccccagagccacgcccugcagccccaccaccacauccccauggugcccgcccagcagcccggcaucccccagcagcccaugaugccccugcccggccagcacagcaugacccccacccagcaccaccagcccaaccugccccugcccgcccagcagcccuuccagccccagcccgugcagccccagccccaccagccccugcagccccagagccccaugcaccccauccagccccugcugccccagcccccccugccccccauguucagcaugcagagccugcugcccgaccugccccuggaggccuggcccgccaccgacaagaccaagagagaggagguggacuga

SEQ ID NO: 534 - RNA, 219 nt, Artificial Sequence
  derived and/or modified CDS sequence (opt4) from Sus scrofa__K7GPB2__SsAMELX-002
augggcaccuggauccuguucgccugccugcugggcgccgccuucagcaugccccugcccccccaccccggccaccccggcuacaucaacuucagcuacgaggugcugaccccccugaagugguaccagaacaugaucagacaccccagccugcugcccgaccugccccuggaggccuggcccgccaccgacaagaccaagagagaggagguggacuga

SEQ ID NO: 535 - RNA, 612 nt, Artificial Sequence
  derived and/or modified CDS sequence (opt4) from Sus scrofa__K7GLD0__SsAMELX-003
augggcaccuggauccuguucgccugccugcugggcgccgccuucagcaugccccugcccccccaccccggccaccccggcuacaucaacuucagcuacgaggaccuguaccuggaggccaucagaaucgacagaaccgccuucgugcugaccccccugaagugguaccagaacaugaucagacaccccuacaccagcuacggcuacgagcccaugggcggcuggcugcaccaccagaucauccccguggugagccagcagaccccccagagccacgcccugcagccccaccaccacauccccauggugcccgcccagcagcccggcaucccccagcagcccaugaugccccugcccggccagcacagcaugacccccacccagcaccaccagcccaaccugccccugcccgcccagcagcccuuccagccccagcccgugcagccccagccccaccagccccugcagccccagagccccaugcaccccauccagccccugcugccccagcccccccugccccccauguucagcaugcagagccugcugcccgaccugccccuggaggccuggcccgccaccgacaagaccaagagagaggagguggacuga

SEQ ID NO: 536 - RNA, 498 nt, Artificial Sequence
  derived and/or modified CDS sequence (opt4) from Sus scrofa__K7GPE9__SsAMELX-004
augggcaccuggauccuguucgccugccugcugggcgccgccuucagcaugccccugcccccccaccccggccaccccggcuacaucaacuucagcuacgaggugcugaccccccugaagugguaccagaacaugaucagacaccccaccccccagagccacgcccugcagccccaccaccacauccccauggugcccgcccagcagcccggcaucccccagcagcccaugaugccccugcccggccagcacagcaugacccccacccagcaccaccagcccaaccugccccugcccgcccagcagcccuuccagccccagcccgugcagccccagccccaccagccccugcagccccagagccccaugcaccccauccagccccugcugccccagcccccccugccccccauguucagcaugcagagccugcugcccgaccugccccuggaggccuggcccgccaccgacaagaccaagagagaggagguggacuga

SEQ ID NO: 537 - RNA, 522 nt, Artificial Sequence
  derived and/or modified CDS sequence (opt4) from Sus scrofa__J9JIM4__SsAMELX-201
augccccugcccccccaccccggccaccccggcuacaucaacuucagcuacgaggugcugaccccccugaagugguaccagaacaugaucagacaccccuacaccagcuacggcuacgagcccaugggcggcuggcugcaccaccagaucauccccguggugagccagcagaccccccagagccacgcccugcagccccaccaccacauccccauggugcccgcccagcagcccggcaucccccagcagcccaugaugccccugcccggccagcacagcaugacccccacccagcaccaccagcccaaccugccccugcccgcccagcagcccuuccagccccagcccgugcagccccagccccaccagccccugcagccccagagccccaugcaccccauccagccccugcugccccagcccccccugccccccauguucagcaugcagagccugcugcccgaccugccccuggaggccuggcccgccaccgacaagaccaagagagaggagguggacuga

SEQ ID NO: 538 - RNA, 2961 nt, Artificial Sequence
  derived and/or modified CDS sequence (opt4) from Homo sapiens__NP_006120.1__HsBMP1
augcccggcguggccagacugccccugcugcugggccugcugcugcugcccagacccggcagaccccuggaccuggccgacuacaccuacgaccuggccgaggaggacgacagcgagccccugaacuacaaggaccccugcaaggccgccgccuuccugggcgacaucgcccuggacgaggaggaccugagagccuuccaggugcagcaggccguggaccugagaagacacaccgccagaaagagcagcaucaaggccgccgugcccggcaacaccagcacccccagcugccagagcaccaacggccagccccagagaggcgccugcggcagauggagaggcagaagcagaagcagaagagccgccaccagcagacccgagagaguguggcccgacggcgugauccccuucgugaucggcggcaacuucaccggcagccagagagccguguucagacaggccaugagacacugggagaagcacaccugcgugaccuuccuggagagaaccgacgaggacagcuacaucguguucaccuacagacccugcggcugcugcagcuacgugggcagaagaggcggcggcccccaggccaucagcaucggcaagaacugcgacaaguucggcaucguggugcacgagcugggccacguggugggcuucuggcacgagcacaccagacccgacagagacagacacgugagcaucgugagagagaacauccagcccggccaggaguacaacuuccugaagauggagccccaggagguggagagccugggcgagaccuacgacuucgacagcaucaugcacuacgccagaaacaccuucagcagaggcaucuuccuggacaccaucgugcccaaguacgaggugaacggcgugaagccccccaucggccagagaaccagacugagcaagggcgacaucgcccaggccagaaagcuguacaagugccccgccugcggcgagacccugcaggacagcaccggcaacuucagcagccccgaguaccccaacggcuacagcgcccacaugcacugcguguggagaaucagcgugacccccggcgagaagaucauccugaacuucaccagccuggaccuguacagaagcagacugugcugguacgacuacguggaggugagagacggcuucuggagaaaggccccccugagaggcagauucugcggcagcaagcugcccgagcccaucgugagcaccgacagcagacuguggguggaguucagaagcagcagcaacugggugggcaagggcuucuucgccguguacgaggccaucugcggcggcgacgugaagaaggacuacggccacauccagagccccaacuaccccgacgacuacagacccagcaaggugugcaucuggagaauccaggugagcgagggcuuccacgugggccugaccuuccagagcuucgagaucgagagacacgacagcugcgccuacgacuaccuggaggugagagacggccacagcgagagcagcacccugaucggcagauacugcggcuacgagaagcccgacgacaucaagagcaccagcagcagacuguggcugaaguucgugagcgacggcagcaucaacaaggccggcuucgccgugaacuucuucaaggagguggacgagugcagcagacccaacagaggcggcugcgagcagagaugccugaacacccugggcagcuacaagugcagcugcgaccccggcuacgagcuggcccccgacaagagaagaugcgaggccgccugcggcggcuuccugaccaagcugaacggcagcaucaccagccccggcuggcccaaggaguacccccccaacaagaacugcaucuggcagcugguggcccccacccaguacagaaucagccugcaguucgacuucuucgagaccgagggcaacgacgugugcaaguacgacuucguggaggugagaagcggccugaccgccgacagcaagcugcacggcaaguucugcggcagcgagaagcccgaggugaucaccagccaguacaacaacaugagaguggaguucaagagcgacaacaccgugagcaagaagggcuucaaggcccacuucuucagcgacaaggacgagugcagcaaggacaacggcggcugccagcaggacugcgugaacaccuucggcagcuacgagugccagugcagaagcggcuucgugcugcacgacaacaagcacgacugcaaggaggccggcugcgaccacaaggugaccagcaccagcggcaccaucaccagccccaacuggcccgacaaguaccccagcaagaaggagugcaccugggccaucagcagcacccccggccacagagugaagcugaccuucauggagauggacaucgagagccagcccgagugcgccuacgaccaccuggagguguucgacggcagagacgccaaggcccccgugcugggcagauucugcggcagcaagaagcccgagcccgugcuggccaccggcagcagaauguuccugagauucuacagcgacaacagcgugcagagaaagggcuuccaggccagccacgccaccgagugcggcggccaggugagagccgacgugaagaccaaggaccuguacagccacgcccaguucggcgacaacaacuaccccggcggcguggacugcgagugggugaucguggccgaggagggcuacggcguggagcugguguuccagaccuucgagguggaggaggagaccgacugcggcuacgacuacauggagcuguucgacggcuacgacagcaccgcccccagacugggcagauacugcggcagcggcccccccgaggagguguacagcgccggcgacagcgugcuggugaaguuccacagcgacgacaccaucaccaagaagggcuuccaccugagauacaccagcaccaaguuccaggacacccugcacagcagaaaguga

SEQ ID NO: 539 - RNA, 1191 nt, Artificial Sequence
  derived and/or modified CDS sequence (opt4) from Homo sapiens__NP_001191.1__HsBMP2
augguggccggcaccagaugccugcuggcccugcugcugccccaggugcugcugggcggcgccgccggccuggugcccgagcugggcagaagaaaguucgccgccgccagcagcggcagacccagcagccagcccagcgacgaggugcugagcgaguucgagcugagacugcugagcauguucggccugaagcagagacccacccccagcagagacgccguggugccccccuacaugcuggaccuguacagaagacacagcggccagcccggcagccccgcccccgaccacagacuggagagagccgccagcagagccaacaccgugagaagcuuccaccacgaggagagccuggaggagcugcccgagaccagcggcaagaccaccagaagauucuucuucaaccugagcagcauccccaccgaggaguucaucaccagcgccgagcugcagguguucagagagcagaugcaggacgcccugggcaacaacagcagcuuccaccacagaaucaacaucuacgagaucaucaagcccgccaccgccaacagcaaguuccccgugaccagacugcuggacaccagacuggugaaccagaacgccagcagaugggagagcuucgacgugacccccgccgugaugagauggaccgcccagggccacgccaaccacggcuucgugguggagguggcccaccuggaggagaagcagggcgugagcaagagacacgugagaaucagcagaagccugcaccaggacgagcacagcuggagccagaucagaccccugcuggugaccuucggccacgacggcaagggccacccccugcacaagagagagaagagacaggccaagcacaagcagagaaagagacugaagagcagcugcaagagacacccccuguacguggacuucagcgacgugggcuggaacgacuggaucguggccccccccggcuaccacgccuucuacugccacggcgagugccccuucccccuggccgaccaccugaacagcaccaaccacgccaucgugcagacccuggugaacagcgugaacagcaagauccccaaggccugcugcgugcccaccgagcugagcgccaucagcaugcuguaccuggacgagaacgagaagguggugcugaagaacuaccaggacauggugguggagggcugcggcugcagauga

SEQ ID NO: 540 - RNA, 1227 nt, Artificial Sequence
  derived and/or modified CDS sequence (opt4) from Homo sapiens__NP_001193.2__HsBMP4
augauccccggcaacagaaugcugaugguggugcugcugugccaggugcugcugggcggcgccagccacgccagccugauccccgagaccggcaagaagaagguggccgagauccagggccacgccggcggcagaagaagcggccagagccacgagcugcugagagacuucgaggccacccugcugcagauguucggccugagaagaagaccccagcccagcaagagcgccgugauccccgacuacaugagagaccuguacagacugcagagcggcgaggaggaggaggagcagauccacagcaccggccuggaguaccccgagagacccgccagcagagccaacaccgugagaagcuuccaccacgaggagcaccuggagaacauccccggcaccagcgagaacagcgccuucagauuccuguucaaccugagcagcauccccgagaacgaggugaucagcagcgccgagcugagacuguucagagagcagguggaccagggccccgacugggagagaggcuuccacagaaucaacaucuacgaggugaugaagccccccgccgagguggugcccggccaccugaucaccagacugcuggacaccagacuggugcaccacaacgugaccagaugggagaccuucgacgugagccccgccgugcugagauggaccagagagaagcagcccaacuacggccuggccaucgaggugacccaccugcaccagaccagaacccaccagggccagcacgugagaaucagcagaagccugccccagggcagcggcaacugggcccagcugagaccccugcuggugaccuucggccacgacggcagaggccacgcccugaccagaagaagaagagccaagagaagccccaagcaccacagccagagagccagaaagaagaacaagaacugcagaagacacagccuguacguggacuucagcgacgugggcuggaacgacuggaucguggccccccccggcuaccaggccuucuacugccacggcgacugccccuucccccuggccgaccaccugaacagcaccaaccacgccaucgugcagacccuggugaacagcgugaacagcagcauccccaaggccugcugcgugcccaccgagcugagcgccaucagcaugcuguaccuggacgaguacgacaagguggugcugaagaacuaccaggagauggugguggagggcugcggcugcagauga

SEQ ID NO: 541 - RNA, 1542 nt, Artificial Sequence
  derived and/or modified CDS sequence (opt4) from Homo sapiens__NP_001709.1__HsBMP6
augcccggccugggcagaagagcccaguggcugugcuggugguggggccugcugugcagcugcugcggcccccccccccugagacccccccugcccgccgccgccgccgccgccgccggcggccagcugcugggcgacggcggcagccccggcagaaccgagcagcccccccccagcccccagagcagcagcggcuuccuguacagaagacugaagacccaggagaagagagagaugcagaaggagauccugagcgugcugggccugccccacagacccagaccccugcacggccugcagcagccccagccccccgcccugagacagcaggaggagcagcagcagcagcagcagcugcccagaggcgagcccccccccggcagacugaagagcgccccccuguucaugcuggaccuguacaacgcccugagcgccgacaacgacgaggacggcgccagcgagggcgagagacagcagagcuggccccacgaggccgccagcagcagccagagaagacagcccccccccggcgccgcccacccccugaacagaaagagccugcuggcccccggcagcggcagcggcggcgccagcccccugaccagcgcccaggacagcgccuuccugaacgacgccgacauggugaugagcuucgugaaccugguggaguacgacaaggaguucagccccagacagagacaccacaaggaguucaaguucaaccugagccagauccccgagggcgagguggugaccgccgccgaguucagaaucuacaaggacugcgugaugggcagcuucaagaaccagaccuuccugaucagcaucuaccaggugcugcaggagcaccagcacagagacagcgaccuguuccugcuggacaccagaguggugugggccagcgaggagggcuggcuggaguucgacaucaccgccaccagcaaccuguggguggugaccccccagcacaacaugggccugcagcugagcguggugaccagagacggcgugcacgugcaccccagagccgccggccuggugggcagagacggccccuacgacaagcagcccuucaugguggccuucuucaaggugagcgaggugcacgugagaaccaccagaagcgccagcagcagaagaagacagcagagcagaaacagaagcacccagagccaggacguggccagagugagcagcgccagcgacuacaacagcagcgagcugaagaccgccugcagaaagcacgagcuguacgugagcuuccaggaccugggcuggcaggacuggaucaucgcccccaagggcuacgccgccaacuacugcgacggcgagugcagcuucccccugaacgcccacaugaacgccaccaaccacgccaucgugcagacccuggugcaccugaugaaccccgaguacgugcccaagcccugcugcgcccccaccaagcugaacgccaucagcgugcuguacuucgacgacaacagcaacgugauccugaagaaguacagaaacaugguggugagagccugcggcugccacuga

SEQ ID NO: 542 - RNA, 1296 nt, Artificial Sequence
  derived and/or modified CDS sequence (opt4) from Homo sapiens__NP_001710.1__HsBMP7
augcacgugagaagccugagagccgccgccccccacagcuucguggcccugugggccccccuguuccugcugagaagcgcccuggccgacuucagccuggacaacgaggugcacagcagcuucauccacagaagacugagaagccaggagagaagagagaugcagagagagauccugagcauccugggccugccccacagacccagaccccaccugcagggcaagcacaacagcgcccccauguucaugcuggaccuguacaacgccauggccguggaggagggcggcggccccggcggccagggcuucagcuaccccuacaaggccguguucagcacccagggccccccccuggccagccugcaggacagccacuuccugaccgacgccgacauggugaugagcuucgugaaccugguggagcacgacaaggaguucuuccaccccagauaccaccacagagaguucagauucgaccugagcaagauccccgagggcgaggccgugaccgccgccgaguucagaaucuacaaggacuacaucagagagagauucgacaacgagaccuucagaaucagcguguaccaggugcugcaggagcaccugggcagagagagcgaccuguuccugcuggacagcagaacccugugggccagcgaggagggcuggcugguguucgacaucaccgccaccagcaaccacuggguggugaaccccagacacaaccugggccugcagcugagcguggagacccuggacggccagagcaucaaccccaagcuggccggccugaucggcagacacggcccccagaacaagcagcccuucaugguggccuucuucaaggccaccgaggugcacuucagaagcaucagaagcaccggcagcaagcagagaagccagaacagaagcaagacccccaagaaccaggaggcccugagaauggccaacguggccgagaacagcagcagcgaccagagacaggccugcaagaagcacgagcuguacgugagcuucagagaccugggcuggcaggacuggaucaucgcccccgagggcuacgccgccuacuacugcgagggcgagugcgccuucccccugaacagcuacaugaacgccaccaaccacgccaucgugcagacccuggugcacuucaucaaccccgagaccgugcccaagcccugcugcgcccccacccagcugaacgccaucagcgugcuguacuucgacgacagcagcaacgugauccugaagaaguacagaaacaugguggugagagccugcggcugccacuga

SEQ ID NO: 543 - RNA, 300 nt, Artificial Sequence
  derived and/or modified CDS sequence (opt4) from Homo sapiens__NP_006264.2__HsCCL7
augaaggccagcgccgcccugcugugccugcugcugaccgccgccgccuucagcccccagggccuggcccagcccgugggcaucaacaccagcaccaccugcugcuacagauucaucaacaagaagauccccaagcagagacuggagagcuacagaagaaccaccagcagccacugccccagagaggccgugaucuucaagaccaagcuggacaaggagaucugcgccgaccccacccagaagugggugcaggacuucaugaagcaccuggacaagaagacccagacccccaagcuguga

SEQ ID NO: 544 - RNA, 3624 nt, Artificial Sequence
  derived and/or modified CDS sequence (opt4) from Homo sapiens__NP_001954.2__HsEGF
augcugcugacccugaucauccugcugcccguggugagcaaguucagcuucgugagccugagcgccccccagcacuggagcugccccgagggcacccuggccggcaacggcaacagcaccugcgugggccccgcccccuuccugaucuucagccacggcaacagcaucuucagaaucgacaccgagggcaccaacuacgagcagcuggugguggacgccggcgugagcgugaucauggacuuccacuacaacgagaagagaaucuacuggguggaccuggagagacagcugcugcagagaguguuccugaacggcagcagacaggagagagugugcaacaucgagaagaacgugagcggcauggccaucaacuggaucaacgaggaggugaucuggagcaaccagcaggagggcaucaucaccgugaccgacaugaagggcaacaacagccacauccugcugagcgcccugaaguaccccgccaacguggccguggaccccguggagagauucaucuucuggagcagcgagguggccggcagccuguacagagccgaccuggacggcgugggcgugaaggcccugcuggagaccagcgagaagaucaccgccgugagccuggacgugcuggacaagagacuguucuggauccaguacaacagagagggcagcaacagccugaucugcagcugcgacuacgacggcggcagcgugcacaucagcaagcaccccacccagcacaaccuguucgccaugagccuguucggcgacagaaucuucuacagcaccuggaagaugaagaccaucuggaucgccaacaagcacaccggcaaggacauggugagaaucaaccugcacagcagcuucgugccccugggcgagcugaagguggugcacccccuggcccagcccaaggccgaggacgacaccugggagcccgagcagaagcugugcaagcugagaaagggcaacugcagcagcaccgugugcggccaggaccugcagagccaccugugcaugugcgccgagggcuacgcccugagcagagacagaaaguacugcgaggacgugaacgagugcgccuucuggaaccacggcugcacccugggcugcaagaacacccccggcagcuacuacugcaccugccccgugggcuucgugcugcugcccgacggcaagagaugccaccagcuggugagcugccccagaaacgugagcgagugcagccacgacugcgugcugaccagcgagggcccccugugcuucugccccgagggcagcgugcuggagagagacggcaagaccugcagcggcugcagcagccccgacaacggcggcugcagccagcugugcgugccccugagccccgugagcugggagugcgacugcuuccccggcuacgaccugcagcuggacgagaagagcugcgccgccagcggcccccagcccuuccugcuguucgccaacagccaggacaucagacacaugcacuucgacggcaccgacuacggcacccugcugagccagcagaugggcaugguguacgcccuggaccacgaccccguggagaacaagaucuacuucgcccacaccgcccugaaguggaucgagagagccaacauggacggcagccagagagagagacugaucgaggagggcguggacgugcccgagggccuggccguggacuggaucggcagaagauucuacuggaccgacagaggcaagagccugaucggcagaagcgaccugaacggcaagagaagcaagaucaucaccaaggagaacaucagccagcccagaggcaucgccgugcaccccauggccaagagacuguucuggaccgacaccggcaucaaccccagaaucgagagcagcagccugcagggccugggcagacuggugaucgccagcagcgaccugaucuggcccagcggcaucaccaucgacuuccugaccgacaagcuguacuggugcgacgccaagcagagcgugaucgagauggccaaccuggacggcagcaagagaagaagacugacccagaacgacgugggccaccccuucgccguggccguguucgaggacuacgugugguucagcgacugggccaugcccagcgugaugagagugaacaagagaaccggcaaggacagagugagacugcagggcagcaugcugaagcccagcagccuggugguggugcacccccuggccaagcccggcgccgaccccugccuguaccagaacggcggcugcgagcacaucugcaagaagagacugggcaccgccuggugcagcugcagagagggcuucaugaaggccagcgacggcaagaccugccuggcccuggacggccaccagcugcuggccggcggcgagguggaccugaagaaccaggugaccccccuggacauccugagcaagaccagagugagcgaggacaacaucaccgagagccagcacaugcugguggccgagaucauggugagcgaccaggacgacugcgcccccgugggcugcagcauguacgccagaugcaucagcgagggcgaggacgccaccugccagugccugaagggcuucgccggcgacggcaagcugugcagcgacaucgacgagugcgagaugggcgugcccgugugcccccccgccagcagcaagugcaucaacaccgagggcggcuacgugugcagaugcagcgagggcuaccagggcgacggcauccacugccuggacaucgacgagugccagcugggcgagcacagcugcggcgagaacgccagcugcaccaacaccgagggcggcuacaccugcaugugcgccggcagacugagcgagcccggccugaucugccccgacagcaccccccccccccaccugagagaggacgaccaccacuacagcgugagaaacagcgacagcgagugcccccugagccacgacggcuacugccugcacgacggcgugugcauguacaucgaggcccuggacaaguacgccugcaacugcguggugggcuacaucggcgagagaugccaguacagagaccugaaguggugggagcugagacacgccggccacggccagcagcagaaggugaucgugguggccgugugcgugguggugcuggugaugcugcugcugcugagccuguggggcgcccacuacuacagaacccagaagcugcugagcaagaaccccaagaaccccuacgaggagagcagcagagacgugagaagcagaagacccgccgacaccgaggacggcaugagcagcugcccccagcccugguucguggugaucaaggagcaccaggaccugaagaacggcggccagcccguggccggcgaggacggccaggccgccgacggcagcaugcagcccaccagcuggagacaggagccccagcugugcggcaugggcaccgagcagggcugcuggauccccgugagcagcgacaagggcagcugcccccaggugauggagagaagcuuccacaugcccagcuacggcacccagacccuggagggcggcguggagaagccccacagccugcugagcgccaacccccuguggcagcagagagcccuggaccccccccaccagauggagcugacccaguga

SEQ ID NO: 545 - RNA, 510 nt, Artificial Sequence
  derived and/or modified CDS sequence (opt4) from Homo sapiens__NP_001423.1__HsEREG
augaccgccggcagaagaauggagaugcugugcgccggcagagugcccgcccugcugcugugccugggcuuccaccugcugcaggccgugcugagcaccaccgugauccccagcugcauccccggcgagagcagcgacaacugcaccgcccuggugcagaccgaggacaaccccagaguggcccaggugagcaucaccaagugcagcagcgacaugaacggcuacugccugcacggccagugcaucuaccugguggacaugagccagaacuacugcagaugcgaggugggcuacaccggcgugagaugcgagcacuucuuccugaccgugcaccagccccugagcaaggaguacguggcccugaccgugauccugaucauccuguuccugaucaccguggugggcagcaccuacuacuucugcagaugguacagaaacagaaagagcaaggagcccaagaaggaguacgagagagugaccagcggcgaccccgagcugccccagguguga

SEQ ID NO: 546 - RNA, 468 nt, Artificial Sequence
  derived and/or modified CDS sequence (opt4) from Homo sapiens__NP_000791.1__HsFGF1
auggccgagggcgagaucaccaccuucaccgcccugaccgagaaguucaaccugccccccggcaacuacaagaagcccaagcugcuguacugcagcaacggcggccacuuccugagaauccugcccgacggcaccguggacggcaccagagacagaagcgaccagcacauccagcugcagcugagcgccgagagcgugggcgagguguacaucaagagcaccgagaccggccaguaccuggccauggacaccgacggccugcuguacggcagccagacccccaacgaggagugccuguuccuggagagacuggaggagaaccacuacaacaccuacaucagcaagaagcacgccgagaagaacugguucgugggccugaagaagaacggcagcugcaagagaggccccagaacccacuacggccagaaggccauccuguuccugccccugcccgugagcagcgacuga

SEQ ID NO: 547 - RNA, 867 nt, Artificial Sequence
  derived and/or modified CDS sequence (opt4) from Homo sapiens__NP_001997.5__HsFGF2
auggugggcgugggcggcggcgacguggaggacgugacccccagacccggcggcugccagaucagcggcagaggcgccagaggcugcaacggcauccccggcgccgccgccugggaggccgcccugcccagaagaagacccagaagacaccccagcgugaaccccagaagcagagccgccggcagccccagaaccagaggcagaagaaccgaggagagacccagcggcagcagacugggcgacagaggcagaggcagagcccugcccggcggcagacugggcggcagaggcagaggcagagcccccgagagagugggcggcagaggcagaggcagaggcaccgccgcccccagagccgcccccgccgccagaggcagcagacccggccccgccggcaccauggccgccggcagcaucaccacccugcccgcccugcccgaggacggcggcagcggcgccuucccccccggccacuucaaggaccccaagagacuguacugcaagaacggcggcuucuuccugagaauccaccccgacggcagaguggacggcgugagagagaagagcgacccccacaucaagcugcagcugcaggccgaggagagaggcguggugagcaucaagggcgugugcgccaacagauaccuggccaugaaggaggacggcagacugcuggccagcaagugcgugaccgacgagugcuucuucuucgagagacuggagagcaacaacuacaacaccuacagaagcagaaaguacaccagcugguacguggcccugaagagaaccggccaguacaagcugggcagcaagaccggccccggccagaaggccauccuguuccugcccaugagcgccaagagcuga

SEQ ID NO: 548 - RNA, 585 nt, Artificial Sequence
  derived and/or modified CDS sequence (opt4) from Homo sapiens__NP_002000.1__HsFGF7
augcacaaguggauccugaccuggauccugcccacccugcuguacagaagcugcuuccacaucaucugccuggugggcaccaucagccuggccugcaacgacaugacccccgagcagauggccaccaacgugaacugcagcagccccgagagacacaccagaagcuacgacuacauggagggcggcgacaucagagugagaagacuguucugcagaacccagugguaccugagaaucgacaagagaggcaaggugaagggcacccaggagaugaagaacaacuacaacaucauggagaucagaaccguggccgugggcaucguggccaucaagggcguggagagcgaguucuaccuggccaugaacaaggagggcaagcuguacgccaagaaggagugcaacgaggacugcaacuucaaggagcugauccuggagaaccacuacaacaccuacgccagcgccaaguggacccacaacggcggcgagauguucguggcccugaaccagaagggcauccccgugagaggcaagaagaccaagaaggagcagaagaccgcccacuuccugcccauggccaucaccuga

SEQ ID NO: 549 - RNA, 627 nt, Artificial Sequence
  derived and/or modified CDS sequence (opt4) from Homo sapiens__NP_001936.1__HsHBEGF
augaagcugcugcccagcguggugcugaagcuguuccuggccgccgugcugagcgcccuggugaccggcgagagccuggagagacugagaagaggccuggccgccggcaccagcaaccccgacccccccaccgugagcaccgaccagcugcugccccugggcggcggcagagacagaaaggugagagaccugcaggaggccgaccuggaccugcugagagugacccugagcagcaagccccaggcccuggccacccccaacaaggaggagcacggcaagagaaagaagaagggcaagggccugggcaagaagagagaccccugccugagaaaguacaaggacuucugcauccacggcgagugcaaguacgugaaggagcugagagcccccagcugcaucugccaccccggcuaccacggcgagagaugccacggccugagccugcccguggagaacagacuguacaccuacgaccacaccaccauccuggccgugguggccguggugcugagcagcgugugccugcuggugaucgugggccugcugauguucagauaccacagaagaggcggcuacgacguggagaacgaggagaaggugaagcugggcaugaccaacagccacuga

SEQ ID NO: 550 - RNA, 2187 nt, Artificial Sequence
  derived and/or modified CDS sequence (opt4) from Homo sapiens__NP_000592.3__HsHGF
augugggugaccaagcugcugcccgcccugcugcugcagcacgugcugcugcaccugcugcugcugcccaucgccauccccuacgccgagggccagagaaagagaagaaacaccauccacgaguucaagaagagcgccaagaccacccugaucaagaucgaccccgcccugaagaucaagaccaagaaggugaacaccgccgaccagugcgccaacagaugcaccagaaacaagggccugcccuucaccugcaaggccuucguguucgacaaggccagaaagcagugccugugguuccccuucaacagcaugagcagcggcgugaagaaggaguucggccacgaguucgaccuguacgagaacaaggacuacaucagaaacugcaucaucggcaagggcagaagcuacaagggcaccgugagcaucaccaagagcggcaucaagugccagcccuggagcagcaugaucccccacgagcacagcuuccugcccagcagcuacagaggcaaggaccugcaggagaacuacugcagaaaccccagaggcgaggagggcggccccuggugcuucaccagcaaccccgaggugagauacgaggugugcgacaucccccagugcagcgagguggagugcaugaccugcaacggcgagagcuacagaggccugauggaccacaccgagagcggcaagaucugccagagaugggaccaccagaccccccacagacacaaguuccugcccgagagauaccccgacaagggcuucgacgacaacuacugcagaaaccccgacggccagcccagacccuggugcuacacccuggacccccacaccagaugggaguacugcgccaucaagaccugcgccgacaacaccaugaacgacaccgacgugccccuggagaccaccgagugcauccagggccagggcgagggcuacagaggcaccgugaacaccaucuggaacggcauccccugccagagaugggacagccaguacccccacgagcacgacaugacccccgagaacuucaagugcaaggaccugagagagaacuacugcagaaaccccgacggcagcgagagccccuggugcuucaccaccgaccccaacaucagagugggcuacugcagccagauccccaacugcgacaugagccacggccaggacugcuacagaggcaacggcaagaacuacaugggcaaccugagccagaccagaagcggccugaccugcagcaugugggacaagaacauggaggaccugcacagacacaucuucugggagcccgacgccagcaagcugaacgagaacuacugcagaaaccccgacgacgacgcccacggccccuggugcuacaccggcaacccccugauccccugggacuacugccccaucagcagaugcgagggcgacaccacccccaccaucgugaaccuggaccaccccgugaucagcugcgccaagaccaagcagcugagaguggugaacggcauccccaccagaaccaacaucggcuggauggugagccugagauacagaaacaagcacaucugcggcggcagccugaucaaggagagcugggugcugaccgccagacagugcuuccccagcagagaccugaaggacuacgaggccuggcugggcauccacgacgugcacggcagaggcgacgagaagugcaagcaggugcugaacgugagccagcugguguacggccccgagggcagcgaccuggugcugaugaagcuggccagacccgccgugcuggacgacuucgugagcaccaucgaccugcccaacuacggcugcaccauccccgagaagaccagcugcagcguguacggcuggggcuacaccggccugaucaacuacgacggccugcugagaguggcccaccuguacaucaugggcaacgagaagugcagccagcaccacagaggcaaggugacccugaacgagagcgagaucugcgccggcgccgagaagaucggcagcggccccugcgagggcgacuacggcggcccccuggugugcgagcagcacaagaugagaauggugcugggcgugaucgugcccggcagaggcugcgccauccccaacagacccggcaucuucgugagaguggccuacuacgccaaguggauccacaagaucauccugaccuacaaggugccccagagcuga

SEQ ID NO: 551 - RNA, 1926 nt, Artificial Sequence
  derived and/or modified CDS sequence (opt4) from Homo sapiens__NP_005336.3 __HsHSPA1A
auggccaaggccgccgccaucggcaucgaccugggcaccaccuacagcugcgugggcguguuccagcacggcaagguggagaucaucgccaacgaccagggcaacagaaccacccccagcuacguggccuucaccgacaccgagagacugaucggcgacgccgccaagaaccagguggcccugaacccccagaacaccguguucgacgccaagagacugaucggcagaaaguucggcgaccccguggugcagagcgacaugaagcacuggcccuuccaggugaucaacgacggcgacaagcccaaggugcaggugagcuacaagggcgagaccaaggccuucuaccccgaggagaucagcagcauggugcugaccaagaugaaggagaucgccgaggccuaccugggcuaccccgugaccaacgccgugaucaccgugcccgccuacuucaacgacagccagagacaggccaccaaggacgccggcgugaucgccggccugaacgugcugagaaucaucaacgagcccaccgccgccgccaucgccuacggccuggacagaaccggcaagggcgagagaaacgugcugaucuucgaccugggcggcggcaccuucgacgugagcauccugaccaucgacgacggcaucuucgaggugaaggccaccgccggcgacacccaccugggcggcgaggacuucgacaacagacuggugaaccacuucguggaggaguucaagagaaagcacaagaaggacaucagccagaacaagagagccgugagaagacugagaaccgccugcgagagagccaagagaacccugagcagcagcacccaggccagccuggagaucgacagccuguucgagggcaucgacuucuacaccagcaucaccagagccagauucgaggagcugugcagcgaccuguucagaagcacccuggagcccguggagaaggcccugagagacgccaagcuggacaaggcccagauccacgaccuggugcuggugggcggcagcaccagaauccccaaggugcagaagcugcugcaggacuucuucaacggcagagaccugaacaagagcaucaaccccgacgaggccguggccuacggcgccgccgugcaggccgccauccugaugggcgacaagagcgagaacgugcaggaccugcugcugcuggacguggccccccugagccugggccuggagaccgccggcggcgugaugaccgcccugaucaagagaaacagcaccauccccaccaagcagacccagaucuucaccaccuacagcgacaaccagcccggcgugcugauccagguguacgagggcgagagagccaugaccaaggacaacaaccugcugggcagauucgagcugagcggcaucccccccgcccccagaggcgugccccagaucgaggugaccuucgacaucgacgccaacggcauccugaacgugaccgccaccgacaagagcaccggcaaggccaacaagaucaccaucaccaacgacaagggcagacugagcaaggaggagaucgagagaauggugcaggaggccgagaaguacaaggccgaggacgaggugcagagagagagagugagcgccaagaacgcccuggagagcuacgccuucaacaugaagagcgccguggaggacgagggccugaagggcaagaucagcgaggccgacaagaagaaggugcuggacaagugccaggaggugaucagcuggcuggacgccaacacccuggccgagaaggacgaguucgagcacaagagaaaggagcuggagcaggugugcaaccccaucaucagcggccuguaccagggcgccggcggccccggccccggcggcuucggcgcccagggccccaagggcggcagcggcagcggccccaccaucgaggagguggacuga

SEQ ID NO: 552 - RNA, 1926 nt, Artificial Sequence; identical to SEQ ID NO: 551
  derived and/or modified CDS sequence (opt4) from Homo sapiens__NP_005337.2 __HsHSPA1B

SEQ ID NO: 553 - RNA, 1926 nt, Artificial Sequence
  derived and/or modified CDS sequence (opt4) from Homo sapiens__NP_005518.3 __HsHSPA1L
auggccaccgccaagggcaucgccaucggcaucgaccugggcaccaccuacagcugcgugggcguguuccagcacggcaagguggagaucaucgccaacgaccagggcaacagaaccacccccagcuacguggccuucaccgacaccgagagacugaucggcgacgccgccaagaaccagguggccaugaacccccagaacaccguguucgacgccaagagacugaucggcagaaaguucaacgaccccguggugcaggccgacaugaagcuguggcccuuccaggugaucaacgagggcggcaagcccaaggugcuggugagcuacaagggcgagaacaaggccuucuaccccgaggagaucagcagcauggugcugaccaagcugaaggagaccgccgaggccuuccugggccaccccgugaccaacgccgugaucaccgugcccgccuacuucaacgacagccagagacaggccaccaaggacgccggcgugaucgccggccugaacgugcugagaaucaucaacgagcccaccgccgccgccaucgccuacggccuggacaagggcggccagggcgagagacacgugcugaucuucgaccugggcggcggcaccuucgacgugagcauccugaccaucgacgacggcaucuucgaggugaaggccaccgccggcgacacccaccugggcggcgaggacuucgacaacagacuggugagccacuucguggaggaguucaagagaaagcacaagaaggacaucagccagaacaagagagccgugagaagacugagaaccgccugcgagagagccaagagaacccugagcagcagcacccaggccaaccuggagaucgacagccuguacgagggcaucgacuucuacaccagcaucaccagagccagauucgaggagcugugcgccgaccuguucagaggcacccuggagcccguggagaaggcccugagagacgccaagauggacaaggccaagauccacgacaucgugcuggugggcggcagcaccagaauccccaaggugcagagacugcugcaggacuacuucaacggcagagaccugaacaagagcaucaaccccgacgaggccguggccuacggcgccgccgugcaggccgccauccugaugggcgacaagagcgagaaggugcaggaccugcugcugcuggacguggccccccugagccugggccuggagaccgccggcggcgugaugaccgcccugaucaagagaaacagcaccauccccaccaagcagacccagaucuucaccaccuacagcgacaaccagcccggcgugcugauccagguguacgagggcgagagagccaugaccaaggacaacaaccugcugggcagauucgaccugaccggcaucccccccgcccccagaggcgugccccagaucgaggugaccuucgacaucgacgccaacggcauccugaacgugaccgccaccgacaagagcaccggcaaggugaacaagaucaccaucaccaacgacaagggcagacugagcaaggaggagaucgagagaauggugcuggacgccgagaaguacaaggccgaggacgaggugcagagagagaagaucgccgccaagaacgcccuggagagcuacgccuucaacaugaagagcguggugagcgacgagggccugaagggcaagaucagcgagagcgacaagaacaagauccuggacaagugcaacgagcugcugagcuggcuggaggugaaccagcuggccgagaaggacgaguucgaccacaagagaaaggagcuggagcagaugugcaaccccaucaucaccaagcuguaccagggcggcugcaccggccccgccugcggcaccggcuacgugcccggcagacccgccaccggccccaccaucgaggagguggacuga

SEQ ID NO: 554 - RNA, 1920 nt, Artificial Sequence
  derived and/or modified CDS sequence (opt4) from Homo sapiens__NP_068814.2 __HsHSPA2
augagcgccagaggccccgccaucggcaucgaccugggcaccaccuacagcugcgugggcguguuccagcacggcaagguggagaucaucgccaacgaccagggcaacagaaccacccccagcuacguggccuucaccgacaccgagagacugaucggcgacgccgccaagaaccagguggccaugaaccccaccaacaccaucuucgacgccaagagacugaucggcagaaaguucgaggacgccaccgugcagagcgacaugaagcacuggcccuucagaguggugagcgagggcggcaagcccaaggugcagguggaguacaagggcgagaccaagaccuucuuccccgaggagaucagcagcauggugcugaccaagaugaaggagaucgccgaggccuaccugggcggcaaggugcacagcgccgugaucaccgugcccgccuacuucaacgacagccagagacaggccaccaaggacgccggcaccaucaccggccugaacgugcugagaaucaucaacgagcccaccgccgccgccaucgccuacggccuggacaagaagggcugcgccggcggcgagaagaacgugcugaucuucgaccugggcggcggcaccuucgacgugagcauccugaccaucgaggacggcaucuucgaggugaagagcaccgccggcgacacccaccugggcggcgaggacuucgacaacagaauggugagccaccuggccgaggaguucaagagaaagcacaagaaggacaucggccccaacaagagagccgugagaagacugagaaccgccugcgagagagccaagagaacccugagcagcagcacccaggccagcaucgagaucgacagccuguacgagggcguggacuucuacaccagcaucaccagagccagauucgaggagcugaacgccgaccuguucagaggcacccuggagcccguggagaaggcccugagagacgccaagcuggacaagggccagauccaggagaucgugcuggugggcggcagcaccagaauccccaagauccagaagcugcugcaggacuucuucaacggcaaggagcugaacaagagcaucaaccccgacgaggccguggccuacggcgccgccgugcaggccgccauccugaucggcgacaagagcgagaacgugcaggaccugcugcugcuggacgugaccccccugagccugggcaucgagaccgccggcggcgugaugaccccccugaucaagagaaacaccaccauccccaccaagcagacccagaccuucaccaccuacagcgacaaccagagcagcgugcuggugcagguguacgagggcgagagagccaugaccaaggacaacaaccugcugggcaaguucgaccugaccggcaucccccccgcccccagaggcgugccccagaucgaggugaccuucgacaucgacgccaacggcauccugaacgugaccgccgccgacaagagcaccggcaaggagaacaagaucaccaucaccaacgacaagggcagacugagcaaggacgacaucgacagaauggugcaggaggccgagagauacaagagcgaggacgaggccaacagagacagaguggccgccaagaacgcccuggagagcuacaccuacaacaucaagcagaccguggaggacgagaagcugagaggcaagaucagcgagcaggacaagaacaagauccuggacaagugccaggaggugaucaacuggcuggacagaaaccagauggccgagaaggacgaguacgagcacaagcagaaggagcuggagagagugugcaaccccaucaucagcaagcuguaccagggcggccccggcggcggcagcggcggcggcggcagcggcgccagcggcggccccaccaucgaggagguggacuga

SEQ ID NO: 555 - RNA, 2523 nt, Artificial Sequence
  derived and/or modified CDS sequence (opt4) from Homo sapiens__NP_002145.3 __HsHSPA4
augagcguggugggcaucgaccugggcuuccagagcugcuacguggccguggccagagccggcggcaucgagaccaucgccaacgaguacagcgacagaugcacccccgccugcaucagcuucggccccaagaacagaagcaucggcgccgccgccaagagccaggugaucagcaacgccaagaacaccgugcagggcuucaagagauuccacggcagagccuucagcgaccccuucguggaggccgagaagagcaaccuggccuacgacaucgugcagcugcccaccggccugaccggcaucaaggugaccuacauggaggaggagagaaacuucaccaccgagcaggugaccgccaugcugcugagcaagcugaaggagaccgccgagagcgugcugaagaagcccgugguggacugcguggugagcgugcccugcuucuacaccgacgccgagagaagaagcgugauggacgccacccagaucgccggccugaacugccugagacugaugaacgagaccaccgccguggcccuggccuacggcaucuacaagcaggaccugcccgcccuggaggagaagcccagaaacgugguguucguggacaugggccacagcgccuaccaggugagcgugugcgccuucaacagaggcaagcugaaggugcuggccaccgccuucgacaccacccugggcggcagaaaguucgacgaggugcuggugaaccacuucugcgaggaguucggcaagaaguacaagcuggacaucaagagcaagaucagagcccugcugagacugagccaggagugcgagaagcugaagaagcugaugagcgccaacgccagcgaccugccccugagcaucgagugcuucaugaacgacguggacgugagcggcaccaugaacagaggcaaguuccuggagaugugcaacgaccugcuggccagaguggagcccccccugagaagcgugcuggagcagaccaagcugaagaaggaggacaucuacgccguggagaucgugggcggcgccaccagaauccccgccgugaaggagaagaucagcaaguucuucggcaaggagcugagcaccacccugaacgccgacgaggccgugaccagaggcugcgcccugcagugcgccauccugagccccgccuucaaggugagagaguucagcaucaccgacguggugcccuaccccaucagccugagauggaacagccccgccgaggagggcagcagcgacugcgagguguucagcaagaaccacgccgcccccuucagcaaggugcugaccuucuacagaaaggagcccuucacccuggaggccuacuacagcagcccccaggaccugcccuaccccgaccccgccaucgcccaguucagcgugcagaaggugaccccccagagcgacggcagcagcagcaaggugaaggugaaggugagagugaacgugcacggcaucuucagcgugagcagcgccagccugguggaggugcacaagagcgaggagaacgaggagcccauggagaccgaccagaacgccaaggaggaggagaagaugcagguggaccaggaggagccccacguggaggagcagcagcagcagacccccgccgagaacaaggccgagagcgaggagauggagaccagccaggccggcagcaaggacaagaagauggaccagcccccccaggccaagaaggccaaggugaagaccagcaccguggaccugcccaucgagaaccagcugcuguggcagaucgacagagagaugcugaaccuguacaucgagaacgagggcaagaugaucaugcaggacaagcuggagaaggagagaaacgacgccaagaacgccguggaggaguacguguacgagaugagagacaagcugagcggcgaguacgagaaguucgugagcgaggacgacagaaacagcuucacccugaagcuggaggacaccgagaacuggcuguacgaggacggcgaggaccagcccaagcagguguacguggacaagcuggccgagcugaagaaccugggccagcccaucaagaucagauuccaggagagcgaggagagacccaagcuguucgaggagcugggcaagcagauccagcaguacaugaagaucaucagcagcuucaagaacaaggaggaccaguacgaccaccuggacgccgccgacaugaccaagguggagaagagcaccaacgaggccauggaguggaugaacaacaagcugaaccugcagaacaagcagagccugaccauggaccccguggugaagagcaaggagaucgaggccaagaucaaggagcugaccagcaccugcagccccaucaucagcaagcccaagcccaagguggagccccccaaggaggagcagaagaacgccgagcagaacggccccguggacggccagggcgacaaccccggcccccaggccgccgagcagggcaccgacaccgccgugcccagcgacagcgacaagaagcugcccgagauggacaucgacuga

SEQ ID NO: 556 - RNA, 2520 nt, Artificial Sequence
  derived and/or modified CDS sequence (opt4) from Homo sapiens__NP_055093.2 __HsHSPA4L
augagcguggugggcaucgaccugggcuuccugaacugcuacaucgccguggccagaagcggcggcaucgagaccaucgccaacgaguacagcgacagaugcacccccgccugcaucagccugggcagcagaaccagagccaucggcaacgccgccaagagccagaucgugaccaacgugagaaacaccauccacggcuucaagaagcugcacggcagaagcuucgacgaccccaucgugcagaccgagagaaucagacugcccuacgagcugcagaagaugcccaacggcagcgccggcgugaaggugagauaccuggaggaggagagacccuucgccaucgagcaggugaccggcaugcugcuggccaagcugaaggagaccagcgagaacgcccugaagaagcccguggccgacugcgugaucagcauccccagcuucuucaccgacgccgagagaagaagcgugauggccgccgcccagguggccggccugaacugccugagacugaugaacgagaccaccgccguggcccuggccuacggcaucuacaagcaggaccugcccccccuggacgagaagcccagaaacgugguguucaucgacaugggccacagcgccuaccaggugcuggugugcgccuucaacaagggcaagcugaaggugcuggccaccaccuucgaccccuaccugggcggcagaaacuucgacgaggcccugguggacuacuucugcgacgaguucaagaccaaguacaagaucaacgugaaggagaacagcagagcccugcugagacuguaccaggagugcgagaagcugaagaagcugaugagcgccaacgccagcgaccugccccugaacaucgagugcuucaugaacgaccuggacgugagcagcaagaugaacagagcccaguucgagcagcugugcgccagccugcuggccagaguggagcccccccugaaggccgugauggagcaggccaaccugcagagagaggacaucagcagcaucgagaucgugggcggcgccaccagaauccccgccgugaaggagcagaucaccaaguucuuccugaaggacaucagcaccacccugaacgccgacgaggccguggccagaggcugcgcccugcagugcgccauccugagccccgccuucaaggugagagaguucagcaucaccgaccuggugcccuacagcaucacccugagauggaagaccagcuucgaggacggcagcggcgagugcgagguguucugcaagaaccaccccgcccccuucagcaaggugaucaccuuccacaagaaggagcccuucgagcuggaggccuucuacaccaaccugcacgaggugcccuaccccgacgccagaaucggcagcuucaccauccagaacguguucccccagagcgacggcgacagcagcaaggugaaggugaaggugagagugaacauccacggcaucuucagcguggccagcgccagcgugaucgagaagcagaaccuggagggcgaccacagcgacgcccccauggagaccgagaccagcuucaagaacgagaacaaggacaacauggacaagaugcagguggaccaggaggagggccaccagaagugccacgccgagcacacccccgaggaggagaucgaccacaccggcgccaagaccaagagcgccgugagcgacaagcaggacagacugaaccagacccugaagaagggcaaggugaagagcaucgaccugcccauccagagcagccugugcagacagcugggccaggaccugcugaacagcuacaucgagaacgagggcaagaugaucaugcaggacaagcuggagaaggagagaaacgacgccaagaacgccguggaggaguacguguacgacuucagagacagacugggcaccguguacgagaaguucaucacccccgaggaccugagcaagcugagcgccgugcuggaggacaccgagaacuggcuguacgaggacggcgaggaccagcccaagcagguguacguggacaagcugcaggagcugaagaaguacggccagcccauccagaugaaguacauggagcacgaggagagacccaaggcccugaacgaccugggcaagaagauccagcuggugaugaaggugaucgaggccuacagaaacaaggacgagagauacgaccaccuggaccccaccgagauggagaagguggagaagugcaucagcgacgccaugagcuggcugaacagcaagaugaacgcccagaacaagcugagccugacccaggaccccguggugaaggugagcgagaucguggccaagagcaaggagcuggacaacuucugcaaccccaucaucuacaagcccaagcccaaggccgaggugcccgaggacaagcccaaggccaacagcgagcacaacggccccauggacggccagagcggcaccgagaccaagagcgacagcaccaaggacagcagccagcacaccaagagcagcggcgagauggagguggacuga

SEQ ID NO: 557 - RNA, 1965 nt, Artificial Sequence
  derived and/or modified CDS sequence (opt4) from Homo sapiens__NP_005338.1__HsHSPA5
augaagcugagccugguggccgccaugcugcugcugcugagcgccgccagagccgaggaggaggacaagaaggaggacgugggcaccguggugggcaucgaccugggcaccaccuacagcugcgugggcguguucaagaacggcagaguggagaucaucgccaacgaccagggcaacagaaucacccccagcuacguggccuucacccccgagggcgagagacugaucggcgacgccgccaagaaccagcugaccagcaaccccgagaacaccguguucgacgccaagagacugaucggcagaaccuggaacgaccccagcgugcagcaggacaucaaguuccugcccuucaaggugguggagaagaagaccaagcccuacauccagguggacaucggcggcggccagaccaagaccuucgcccccgaggagaucagcgccauggugcugaccaagaugaaggagaccgccgaggccuaccugggcaagaaggugacccacgccguggugaccgugcccgccuacuucaacgacgcccagagacaggccaccaaggacgccggcaccaucgccggccugaacgugaugagaaucaucaacgagcccaccgccgccgccaucgccuacggccuggacaagagagagggcgagaagaacauccugguguucgaccugggcggcggcaccuucgacgugagccugcugaccaucgacaacggcguguucgaggugguggccaccaacggcgacacccaccugggcggcgaggacuucgaccagagagugauggagcacuucaucaagcuguacaagaagaagaccggcaaggacgugagaaaggacaacagagccgugcagaagcugagaagagagguggagaaggccaagagagcccugagcagccagcaccaggccagaaucgagaucgagagcuucuacgagggcgaggacuucagcgagacccugaccagagccaaguucgaggagcugaacauggaccuguucagaagcaccaugaagcccgugcagaaggugcuggaggacagcgaccugaagaagagcgacaucgacgagaucgugcuggugggcggcagcaccagaauccccaagauccagcagcuggugaaggaguucuucaacggcaaggagcccagcagaggcaucaaccccgacgaggccguggccuacggcgccgccgugcaggccggcgugcugagcggcgaccaggacaccggcgaccuggugcugcuggacgugugcccccugacccugggcaucgagaccgugggcggcgugaugaccaagcugauccccagaaacaccguggugcccaccaagaagagccagaucuucagcaccgccagcgacaaccagcccaccgugaccaucaagguguacgagggcgagagaccccugaccaaggacaaccaccugcugggcaccuucgaccugaccggcaucccccccgcccccagaggcgugccccagaucgaggugaccuucgagaucgacgugaacggcauccugagagugaccgccgaggacaagggcaccggcaacaagaacaagaucaccaucaccaacgaccagaacagacugacccccgaggagaucgagagaauggugaacgacgccgagaaguucgccgaggaggacaagaagcugaaggagagaaucgacaccagaaacgagcuggagagcuacgccuacagccugaagaaccagaucggcgacaaggagaagcugggcggcaagcugagcagcgaggacaaggagaccauggagaaggccguggaggagaagaucgaguggcuggagagccaccaggacgccgacaucgaggacuucaaggccaagaagaaggagcuggaggagaucgugcagcccaucaucagcaagcuguacggcagcgccggccccccccccaccggcgaggaggacaccgccgagaaggacgagcuguga

SEQ ID NO: 558 - RNA, 1932 nt, Artificial Sequence
  derived and/or modified CDS sequence (opt4) from Homo sapiens__NP_002146.2__HsHSPA6
augcaggcccccagagagcuggccgugggcaucgaccugggcaccaccuacagcugcgugggcguguuccagcagggcagaguggagauccuggccaacgaccagggcaacagaaccacccccagcuacguggccuucaccgacaccgagagacuggugggcgacgccgccaagagccaggccgcccugaacccccacaacaccguguucgacgccaagagacugaucggcagaaaguucgccgacaccaccgugcagagcgacaugaagcacuggcccuucagaguggugagcgagggcggcaagcccaaggugagagugugcuacagaggcgaggacaagaccuucuaccccgaggagaucagcagcauggugcugagcaagaugaaggagaccgccgaggccuaccugggccagcccgugaagcacgccgugaucaccgugcccgccuacuucaacgacagccagagacaggccaccaaggacgccggcgccaucgccggccugaacgugcugagaaucaucaacgagcccaccgccgccgccaucgccuacggccuggacagaagaggcgccggcgagagaaacgugcugaucuucgaccugggcggcggcaccuucgacgugagcgugcugagcaucgacgccggcguguucgaggugaaggccaccgccggcgacacccaccugggcggcgaggacuucgacaacagacuggugaaccacuucauggaggaguucagaagaaagcacggcaaggaccugagcggcaacaagagagcccugagaagacugagaaccgccugcgagagagccaagagaacccugagcagcagcacccaggccacccuggagaucgacagccuguucgagggcguggacuucuacaccagcaucaccagagccagauucgaggagcugugcagcgaccuguucagaagcacccuggagcccguggagaaggcccugagagacgccaagcuggacaaggcccagauccacgacguggugcuggugggcggcagcaccagaauccccaaggugcagaagcugcugcaggacuucuucaacggcaaggagcugaacaagagcaucaaccccgacgaggccguggccuacggcgccgccgugcaggccgccgugcugaugggcgacaagugcgagaaggugcaggaccugcugcugcuggacguggccccccugagccugggccuggagaccgccggcggcgugaugaccacccugauccagagaaacgccaccauccccaccaagcagacccagaccuucaccaccuacagcgacaaccagcccggcguguucauccagguguacgagggcgagagagccaugaccaaggacaacaaccugcugggcagauucgagcugagcggcaucccccccgcccccagaggcgugccccagaucgaggugaccuucgacaucgacgccaacggcauccugagcgugaccgccaccgacagaagcaccggcaaggccaacaagaucaccaucaccaacgacaagggcagacugagcaaggaggagguggagagaauggugcacgaggccgagcaguacaaggccgaggacgaggcccagagagacagaguggccgccaagaacagccuggaggcccacguguuccacgugaagggcagccugcaggaggagagccugagagacaagauccccgaggaggacagaagaaagaugcaggacaagugcagagaggugcuggccuggcuggagcacaaccagcuggccgagaaggaggaguacgagcaccagaagagagagcuggagcagaucugcagacccaucuucagcagacuguacggcggccccggcgugcccggcggcagcagcugcggcacccaggccagacagggcgaccccagcaccggccccaucaucgaggagguggacuga

SEQ ID NO: 559 - RNA, 1104 nt, Artificial Sequence
  derived and/or modified CDS sequence (opt4) from Homo sapiens__P48741__HsHSPA7
augcaggcccccagagagcuggccgugggcaucgaccugggcaccaccuacagcugcgugggcguguuccagcagggcagaguggagauccuggccaacgaccagggcaacagaaccacccccagcuacguggccuucaccgacaccgagagacuggugggcgacgccgccaagagccaggccgcccugaacccccacaacaccguguucgacgccaagagacugaucggcagaaaguucgccgacaccaccgugcagagcgacaugaagcacuggcccuuccagguggugagcgagggcggcaagcccaaggugagagugugcuacagaggcgaggacaagaccuucuaccccgaggagaucagcagcauggugcugagcaagaugaaggagaccgccgaggccuaccugggccagcccgugaagcacgccgugaucaccgugcccaccuacuucagcaacagccagagacaggccaccaaggacgccggcgccaucgccggccugaaggugcugcccaucaucaacgaggccaccgccgccgccaucgccuacggccuggacagaagaggcgccggcaagagaaacgugcugaucuucgaccugggcggcggcaccuucgacgugagcgugcugagcaucgacgccggcguguucgaggugaaggccaccgccggcgacacccaccugggcggcgaggacuucgacaacagacuggugaaccacuucauggaggaguucagaagaaagcacggcaaggaccugagcggcaacaagagagcccugagaagacugagaaccgccugcgagagagccaagagaacccccagcagcagcacccaggccacccuggagaucgacagccuguucgagggcguggacuucuacaagagcaucaccagagccagauucgaggagcugugcagcgaccuguucagaagcacccuggagcccguggagaaggcccugagagacgccaagcuggacaaggcccagauccacgacuucgugcugggcggcggccugcacagccacccccagggcgccgagguggccgccggccugcugcagagacagggcgccgagcaggagcaccagcccuga

SEQ ID NO: 560 - RNA, 1941 nt, Artificial Sequence
  derived and/or modified CDS sequence (opt4) from Homo sapiens__NP_006588.1 __HsHSPA8
augagcaagggccccgccgugggcaucgaccugggcaccaccuacagcugcgugggcguguuccagcacggcaagguggagaucaucgccaacgaccagggcaacagaaccacccccagcuacguggccuucaccgacaccgagagacugaucggcgacgccgccaagaaccagguggccaugaaccccaccaacaccguguucgacgccaagagacugaucggcagaagauucgacgacgccguggugcagagcgacaugaagcacuggcccuucaugguggugaacgacgccggcagacccaaggugcagguggaguacaagggcgagaccaagagcuucuaccccgaggaggugagcagcauggugcugaccaagaugaaggagaucgccgaggccuaccugggcaagaccgugaccaacgccguggugaccgugcccgccuacuucaacgacagccagagacaggccaccaaggacgccggcaccaucgccggccugaacgugcugagaaucaucaacgagcccaccgccgccgccaucgccuacggccuggacaagaaggugggcgccgagagaaacgugcugaucuucgaccugggcggcggcaccuucgacgugagcauccugaccaucgaggacggcaucuucgaggugaagagcaccgccggcgacacccaccugggcggcgaggacuucgacaacagaauggugaaccacuucaucgccgaguucaagagaaagcacaagaaggacaucagcgagaacaagagagccgugagaagacugagaaccgccugcgagagagccaagagaacccugagcagcagcacccaggccagcaucgagaucgacagccuguacgagggcaucgacuucuacaccagcaucaccagagccagauucgaggagcugaacgccgaccuguucagaggcacccuggaccccguggagaaggcccugagagacgccaagcuggacaagagccagauccacgacaucgugcuggugggcggcagcaccagaauccccaagauccagaagcugcugcaggacuucuucaacggcaaggagcugaacaagagcaucaaccccgacgaggccguggccuacggcgccgccgugcaggccgccauccugagcggcgacaagagcgagaacgugcaggaccugcugcugcuggacgugaccccccugagccugggcaucgagaccgccggcggcgugaugaccgugcugaucaagagaaacaccaccauccccaccaagcagacccagaccuucaccaccuacagcgacaaccagcccggcgugcugauccagguguacgagggcgagagagccaugaccaaggacaacaaccugcugggcaaguucgagcugaccggcaucccccccgcccccagaggcgugccccagaucgaggugaccuucgacaucgacgccaacggcauccugaacgugagcgccguggacaagagcaccggcaaggagaacaagaucaccaucaccaacgacaagggcagacugagcaaggaggacaucgagagaauggugcaggaggccgagaaguacaaggccgaggacgagaagcagagagacaaggugagcagcaagaacagccuggagagcuacgccuucaacaugaaggccaccguggaggacgagaagcugcagggcaagaucaacgacgaggacaagcagaagauccuggacaagugcaacgagaucaucaacuggcuggacaagaaccagaccgccgagaaggaggaguucgagcaccagcagaaggagcuggagaaggugugcaaccccaucaucaccaagcuguaccagagcgccggcggcaugcccggcggcaugcccggcggcuuccccggcggcggcgccccccccagcggcggcgccagcagcggccccaccaucgaggagguggacuga

SEQ ID NO: 561 - RNA, 2040 nt, Artificial Sequence
  derived and/or modified CDS sequence (opt4) from Homo sapiens__NP_004125.3 __HsHSPA9
augaucagcgccagcagagccgccgccgccagacuggugggcgccgccgccagcagaggccccaccgccgccagacaccaggacagcuggaacggccugagccacgaggccuucagacuggugagcagaagagacuacgccagcgaggccaucaagggcgccguggugggcaucgaccugggcaccaccaacagcugcguggccgugauggagggcaagcaggccaaggugcuggagaacgccgagggcgccagaaccacccccagcgugguggccuucaccgccgacggcgagagacuggugggcaugcccgccaagagacaggccgugaccaaccccaacaacaccuucuacgccaccaagagacugaucggcagaagauacgacgaccccgaggugcagaaggacaucaagaacgugcccuucaagaucgugagagccagcaacggcgacgccuggguggaggcccacggcaagcuguacagccccagccagaucggcgccuucgugcugaugaagaugaaggagaccgccgagaacuaccugggccacaccgccaagaacgccgugaucaccgugcccgccuacuucaacgacagccagagacaggccaccaaggacgccggccagaucagcggccugaacgugcugagagugaucaacgagcccaccgccgccgcccuggccuacggccuggacaagagcgaggacaaggugaucgccguguacgaccugggcggcggcaccuucgacaucagcauccuggagauccagaagggcguguucgaggugaagagcaccaacggcgacaccuuccugggcggcgaggacuucgaccaggcccugcugagacacaucgugaaggaguucaagagagagaccggcguggaccugaccaaggacaacauggcccugcagagagugagagaggccgccgagaaggccaagugcgagcugagcagcagcgugcagaccgacaucaaccugcccuaccugaccauggacagcagcggccccaagcaccugaacaugaagcugaccagagcccaguucgagggcaucgugaccgaccugaucagaagaaccaucgcccccugccagaaggccaugcaggacgccgaggugagcaagagcgacaucggcgaggugauccuggugggcggcaugaccagaaugcccaaggugcagcagaccgugcaggaccuguucggcagagcccccagcaaggccgugaaccccgacgaggccguggccaucggcgccgccauccagggcggcgugcuggccggcgacgugaccgacgugcugcugcuggacgugaccccccugagccugggcaucgagacccugggcggcguguucaccaagcugaucaacagaaacaccaccauccccaccaagaagagccagguguucagcaccgccgccgacggccagacccagguggagaucaaggugugccagggcgagagagagauggccggcgacaacaagcugcugggccaguucacccugaucggcaucccccccgcccccagaggcgugccccagaucgaggugaccuucgacaucgacgccaacggcaucgugcacgugagcgccaaggacaagggcaccggcagagagcagcagaucgugauccagagcagcggcggccugagcaaggacgacaucgagaacauggugaagaacgccgagaaguacgccgaggaggacagaagaaagaaggagagaguggaggccgugaacauggccgagggcaucauccacgacaccgagaccaagauggaggaguucaaggaccagcugcccgccgacgagugcaacaagcugaaggaggagaucagcaagaugagagagcugcuggccagaaaggacagcgagaccggcgagaacaucagacaggccgccagcagccugcagcaggccagccugaagcuguucgagauggccuacaagaagauggccagcgagagagagggcagcggcagcagcggcaccggcgagcagaaggaggaccagaaggaggagaagcaguga

SEQ ID NO: 562 - RNA, 2028 nt, Artificial Sequence
  derived and/or modified CDS sequence (opt4) from Homo sapiens__NP_079291.2__HsHSPA12A
auggccgacaaggaggccggcggcagcgacggccccagagagaccgcccccaccagcgccuacagcagccccgccagaagccugggcgacaccggcaucaccccccugagccccagccacaucgugaacgacaccgacagcaacgugagcgagcagcagagcuuccugguggugguggccguggacuucggcaccaccagcagcggcuacgccuacagcuucaccaaggagcccgagugcauccacgugaugagaagaugggagggcggcgaccccggcgugagcaaccagaagacccccaccaccauccugcugacccccgagagaaaguuccacagcuucggcuacgccgccagagacuucuaccacgaccuggaccccaacgaggccaagcaguggcuguaccuggagaaguucaagaugaagcugcacaccaccggcgaccugaccauggacaccgaccugaccgccgccaacggcaagaaggugaaggcccuggagaucuucgccuacgcccugcaguacuucaaggagcaggcccugaaggagcugagcgaccaggccggcagcgaguucgagaacagcgacgugagaugggugaucaccgugcccgccaucuggaagcagcccgccaagcaguucaugagacaggccgccuaccaggccggccuggccagccccgagaacagcgagcagcugaucaucgcccuggagcccgaggccgccagcaucuacugcagaaagcugagacugcaccagaugaucgagcugagcagcaaggccgccgugaacggcuacagcggcagcgacaccgugggcgccggcuucacccaggccaaggagcacaucagaagaaacagacagagcagaaccuuccugguggagaacgugaucggcgagaucuggagcgagcuggaggagggcgacaaguacguggugguggacagcggcggcggcaccguggaccugaccgugcaccagaucagacugcccgagggccaccugaaggagcuguacaaggccaccggcggccccuacggcagccugggcguggacuacgaguucgagaagcugcuguacaagaucuucggcgaggacuucaucgagcaguucaagaucaagagacccgccgccuggguggaccugaugaucgccuucgagagcagaaagagagccgccgcccccgacagaaccaacccccugaacaucacccugcccuucagcuucaucgacuacuacaagaaguucagaggccacagcguggagcacgcccugagaaagagcaacguggacuucgugaaguggagcagccagggcaugcugagaaugagccccgacgccaugaacgcccuguucaagcccaccaucgacagcaucaucgagcaccugagagaccuguuccagaagcccgaggugagcaccgugaaguuccuguuccuggugggcggcuucgccgaggccccccugcugcagcaggccgugcaggccgccuucggcgaccagugcagaaucaucaucccccaggacgugggccugaccauccugaagggcgccgugcuguucggccuggaccccgccgugaucaaggugagaagaagcccccugaccuacggcgugggcgugcugaacagauacguggagggcaagcacccccccgagaagcugcuggugaaggacggcaccagauggugcaccgacguguucgacaaguucaucagcgccgaccagagcguggcccugggcgagcuggugaagagaagcuacacccccgccaagcccagccagcuggugaucgugaucaacaucuacagcagcgagcacgacaacgugagcuucaucaccgaccccggcgugaagaagugcggcacccugagacuggaccugaccggcaccagcggcaccgccgugcccgccagaagagagauccagacccugaugcaguucggcgacaccgagaucaaggccaccgccaucgacaucgccaccagcaagagcgugaaggugggcaucgacuuccugaacuacuga

SEQ ID NO: 563 - RNA, 2061 nt, Artificial Sequence
  derived and/or modified CDS sequence (opt4) from Homo sapiens__NP_443202.3 __HsHSPA12B
augcuggccgugcccgagaugggccugcagggccuguacaucggcagcagccccgagagaagccccgugcccagcccccccggcagccccagaacccaggagagcugcggcaucgccccccugacccccagccagagccccaagcccgaggugagagccccccagcaggccagcuucagcguggugguggccaucgacuucggcaccaccagcagcggcuacgccuucagcuucgccagcgaccccgaggccauccacaugaugagaaagugggagggcggcgaccccggcguggcccaccagaagacccccaccugccugcugcugacccccgagggcgccuuccacagcuucggcuacaccgccagagacuacuaccacgaccuggaccccgaggaggccagagacuggcuguacuucgagaaguucaagaugaagauccacagcgccaccgaccugacccugaagacccagcuggaggccgugaacggcaagaccaugcccgcccuggagguguucgcccacgcccugagauucuucagagagcacgcccugcaggagcugagagagcagagccccagccugcccgagaaggacaccgugagaugggugcugaccgugcccgccaucuggaagcagcccgccaagcaguucaugagagaggccgccuaccuggccggccuggugagcagagagaacgccgagcagcugcugaucgcccuggagcccgaggccgccagcguguacugcagaaagcugagacugcaccagcugcuggaccugagcggcagagcccccggcggcggcagacugggcgagagaagaagcaucgacagcagcuucagacaggccagagagcagcugagaagaagcagacacagcagaaccuuccugguggagagcggcgugggcgagcugugggccgagaugcaggccggcgacagauacgugguggccgacugcggcggcggcaccguggaccugaccgugcaccagcuggagcagccccacggcacccugaaggagcuguacaaggccagcggcggccccuacggcgccgugggcguggaccuggccuucgagcagcugcugugcagaaucuucggcgaggacuucaucgccaccuucaagagacagagacccgccgccuggguggaccugaccaucgccuucgaggccagaaagagaaccgccggcccccacagagccggcgcccugaacaucagccugcccuucagcuucaucgacuucuacagaaagcagagaggccacaacguggagaccgcccugagaagaagcagcgugaacuucgugaaguggagcagccagggcaugcugagaaugagcugcgaggccaugaacgagcuguuccagcccaccgugagcggcaucauccagcacaucgaggcccugcuggccagacccgaggugcagggcgugaagcugcuguuccuggugggcggcuucgccgagagcgccgugcugcagcacgccgugcaggccgcccugggcgccagaggccugagagugguggugccccacgacgugggccugaccauccugaagggcgccgugcuguucggccaggcccccggcguggugagagugagaagaagcccccugaccuacggcgugggcgugcugaacagauucgugcccggcagacacccccccgagaagcugcuggugagagacggcagaagauggugcaccgacguguucgagagauucguggccgccgagcagagcguggcccugggcgaggaggugagaagaagcuacugccccgccagacccggccagagaagagugcugaucaaccuguacugcugcgccgccgaggacgccagauucaucaccgaccccggcgugagaaagugcggcgcccugagccuggagcuggagcccgccgacugcggccaggacaccgccggcgccccccccggcagaagagagaucagagccgccaugcaguucggcgacaccgagaucaaggugaccgccguggacgugagcaccaacagaagcgugagagccagcaucgacuuccugagcaacuga

SEQ ID NO: 564 - RNA, 1416 nt, Artificial Sequence
  derived and/or modified CDS sequence (opt4) from Homo sapiens__NP_008879.3__HsHSPA13
auggccagagagaugaccauccugggcagcgccgugcugacccugcugcuggccggcuaccuggcccagcaguaccugccccugcccacccccaaggugaucggcaucgaccugggcaccaccuacugcagcgugggcguguucuuccccggcaccggcaaggugaaggugauccccgacgagaacggccacaucagcauccccagcauggugagcuucaccgacaacgacguguacgugggcuacgagagcguggagcuggccgacagcaacccccagaacaccaucuacgacgccaagagauucaucggcaagaucuucaccgccgaggagcuggaggccgagaucggcagauaccccuucaaggugcugaacaagaacggcaugguggaguucagcgugaccagcaacgagaccaucaccgugagccccgaguacgugggcagcagacugcugcugaagcugaaggagauggccgaggccuaccugggcaugcccguggccaacgccgugaucagcgugcccgccgaguucgaccugaagcagagaaacagcaccaucgaggccgccaaccuggccggccugaagauccugagagugaucaacgagcccaccgccgccgccauggccuacggccugcacaaggccgacguguuccacgugcuggugaucgaccugggcggcggcacccuggacgugagccugcugaacaagcagggcggcauguuccugaccagagccaugagcggcaacaacaagcugggcggccaggacuucaaccagagacugcugcaguaccuguacaagcagaucuaccagaccuacggcuucgugcccagcagaaaggaggagauccacagacugagacaggccguggagauggugaagcugaaccugacccugcaccagagcgcccagcugagcgugcugcugaccguggaggagcaggacagaaaggagccccacagcagcgacaccgagcugcccaaggacaagcugagcagcgccgacgaccacagagugaacagcggcuucggcagaggccugagcgacaagaagagcggcgagagccaggugcuguucgagaccgagaucagcagaaagcuguucgacacccugaacgaggaccuguuccagaagauccuggugcccauccagcaggugcugaaggagggccaccuggagaagaccgagaucgacgagguggugcuggugggcggcagcaccagaauccccagaaucagacaggugauccaggaguucuucggcaaggaccccaacaccagcguggaccccgaccuggccguggugaccggcguggccauccaggccggcaucgacggcggcagcuggccccugcaggugagcgcccuggagauccccaacaagcaccugcagaagaccaacuucaacuga

SEQ ID NO: 565 - RNA, 1530 nt, Artificial Sequence
  derived and/or modified CDS sequence (opt4) from Homo sapiens__NP_057383.2__HsHSPA14
auggccgccaucggcgugcaccugggcugcaccagcgccugcguggccguguacaaggacggcagagccggcgugguggccaacgacgccggcgacagagugacccccgccgugguggccuacagcgagaacgaggagaucgugggccuggccgccaagcagagcagaaucagaaacaucagcaacaccgugaugaaggugaagcagauccugggcagaagcagcagcgacccccaggcccagaaguacaucgccgagagcaagugccuggugaucgagaagaacggcaagcugagauacgagaucgacaccggcgaggagaccaaguucgugaaccccgaggacguggccagacugaucuucagcaagaugaaggagaccgcccacagcgugcugggcagcgacgccaacgacguggugaucaccgugcccuucgacuucggcgagaagcagaagaacgcccugggcgaggccgccagagccgccggcuucaacgugcugagacugauccacgagcccagcgccgcccugcuggccuacggcaucggccaggacagccccaccggcaagagcaacauccugguguucaagcugggcggcaccagccugagccugagcgugauggaggugaacagcggcaucuacagagugcugagcaccaacaccgacgacaacaucggcggcgcccacuucaccgagacccuggcccaguaccuggccagcgaguuccagagaagcuucaagcacgacgugagaggcaacgccagagccaugaugaagcugaccaacagcgccgagguggccaagcacagccugagcacccugggcagcgccaacugcuuccuggacagccuguacgagggccaggacuucgacugcaacgugagcagagccagauucgagcugcugugcagcccccuguucaacaagugcaucgaggccaucagaggccugcuggaccagaacggcuucaccgccgacgacaucaacaagguggugcugugcggcggcagcagcagaauccccaagcugcagcagcugaucaaggaccuguuccccgccguggagcugcugaacagcaucccccccgacgaggugauccccaucggcgccgccaucgaggccggcauccugaucggcaaggagaaccugcugguggaggacagccugaugaucgagugcagcgccagagacauccuggugaagggcguggacgagagcggcgccagcagauucaccgugcuguuccccagcggcaccccccugcccgccagaagacagcacacccugcaggcccccggcagcaucagcagcgugugccuggagcuguacgagagcgacggcaagaacagcgccaaggaggagaccaaguucgcccagguggugcugcaggaccuggacaagaaggagaacggccugagagacauccuggccgugcugaccaugaagagagacggcagccugcacgugaccugcaccgaccaggagaccggcaagugcgaggccaucagcaucgagaucgccagcuga

SEQ ID NO: 566 - RNA, 2577 nt, Artificial Sequence
  derived and/or modified CDS sequence (opt4) from Homo sapiens__NP_006635.2 __HsHSPH1
augagcguggugggccuggacgugggcagccagagcugcuacaucgccguggccagagccggcggcaucgagaccaucgccaacgaguucagcgacagaugcacccccagcgugaucagcuucggcagcaagaacagaaccaucggcguggccgccaagaaccagcagaucacccacgccaacaacaccgugagcaacuucaagagauuccacggcagagccuucaacgaccccuucauccagaaggagaaggagaaccugagcuacgaccuggugccccugaagaacggcggcgugggcaucaaggugauguacaugggcgaggagcaccuguucagcguggagcagaucaccgccaugcugcugaccaagcugaaggagaccgccgagaacagccugaagaagcccgugaccgacugcgugaucagcgugcccagcuucuucaccgacgccgagagaagaagcgugcuggacgccgcccagaucgugggccugaacugccugagacugaugaacgacaugaccgccguggcccugaacuacggcaucuacaagcaggaccugcccagccuggacgagaagcccagaaucgugguguucguggacaugggccacagcgccuuccaggugagcgccugcgccuucaacaagggcaagcugaaggugcugggcaccgccuucgaccccuuccugggcggcaagaacuucgacgagaagcugguggagcacuucugcgccgaguucaagaccaaguacaagcuggacgccaagagcaagaucagagcccugcugagacuguaccaggagugcgagaagcugaagaagcugaugagcagcaacagcaccgaccugccccugaacaucgagugcuucaugaacgacaaggacgugagcggcaagaugaacagaagccaguucgaggagcugugcgccgagcugcugcagaagaucgaggugccccuguacagccugcuggagcagacccaccugaagguggaggacgugagcgccguggagaucgugggcggcgccaccagaauccccgccgugaaggagagaaucgccaaguucuucggcaaggacaucagcaccacccugaacgccgacgaggccguggccagaggcugcgcccugcagugcgccauccugagccccgccuucaaggugagagaguucagcgugaccgacgccgugcccuuccccaucagccugaucuggaaccacgacagcgaggacaccgagggcgugcacgagguguucagcagaaaccacgccgcccccuucagcaaggugcugaccuuccugagaagaggccccuucgagcuggaggccuucuacagcgacccccagggcgugcccuaccccgaggccaagaucggcagauucguggugcagaacgugagcgcccagaaggacggcgagaagagcagagugaaggugaaggugagagugaacacccacggcaucuucaccaucagcaccgccagcaugguggagaaggugcccaccgaggagaacgagaugagcagcgaggccgacauggagugccugaaccagagaccccccgagaaccccgacaccgacaagaacgugcagcaggacaacagcgaggccggcacccagccccaggugcagaccgacgcccagcagaccagccagagcccccccagccccgagcugaccagcgaggagaacaagauccccgacgccgacaaggccaacgagaagaagguggaccagccccccgaggccaagaagcccaagaucaagguggugaacguggagcugcccaucgaggccaaccugguguggcagcugggcaaggaccugcugaacauguacaucgagaccgagggcaagaugaucaugcaggacaagcuggagaaggagagaaacgacgccaagaacgccguggaggaguacguguacgaguucagagacaagcugugcggccccuacgagaaguucaucugcgagcaggaccaccagaacuuccugagacugcugaccgagaccgaggacuggcuguacgaggagggcgaggaccaggccaagcaggccuacguggacaagcuggaggagcugaugaagaucggcacccccgugaaggugagauuccaggaggccgaggagagacccaagauguucgaggagcugggccagagacugcagcacuacgccaagaucgccgccgacuucagaaacaaggacgagaaguacaaccacaucgacgagagcgagaugaagaagguggagaagagcgugaacgaggugauggaguggaugaacaacgugaugaacgcccaggccaagaagagccuggaccaggaccccguggugagagcccaggagaucaagaccaagaucaaggagcugaacaacaccugcgagcccguggugacccagcccaagcccaagaucgagagccccaagcuggagagaacccccaacggccccaacaucgacaagaaggaggaggaccuggaggacaagaacaacuucggcgccgagcccccccaccagaacggcgagugcuaccccaacgagaagaacagcgugaacauggaccuggacuga

SEQ ID NO: 567 - RNA, 3000 nt, Artificial Sequence
  derived and/or modified CDS sequence (opt4) from Homo sapiens__NP_006380.1 __HsHYOU1
auggccgacaaggugagaagacagagacccagaagaagagugugcugggcccugguggccgugcugcuggccgaccugcuggcccugagcgacacccuggccgugaugagcguggaccugggcagcgagagcaugaagguggccaucgugaagcccggcgugcccauggagaucgugcugaacaaggagagcagaagaaagacccccgugaucgugacccugaaggagaacgagagauucuucggcgacagcgccgccagcauggccaucaagaaccccaaggccacccugagauacuuccagcaccugcugggcaagcaggccgacaacccccacguggcccuguaccaggccagauuccccgagcacgagcugaccuucgacccccagagacagaccgugcacuuccagaucagcagccagcugcaguucagccccgaggaggugcugggcauggugcugaacuacagcagaagccuggccgaggacuucgccgagcagcccaucaaggacgccgugaucaccgugcccguguucuucaaccaggccgagagaagagccgugcugcaggccgccagaauggccggccugaaggugcugcagcugaucaacgacaacaccgccaccgcccugagcuacggcguguucagaagaaaggacaucaacaccaccgcccagaacaucauguucuacgacaugggcagcggcagcaccgugugcaccaucgugaccuaccagauggugaagaccaaggaggccggcaugcagccccagcugcagaucagaggcgugggcuucgacagaacccugggcggccuggagauggagcugagacugagagagagacuggccggccuguucaacgagcagagaaagggccagagagccaaggacgugagagagaaccccagagccauggccaagcugcugagagaggccaacagacugaagaccgugcugagcgccaacgccgaccacauggcccagaucgagggccugauggacgacguggacuucaaggccaaggugaccagaguggaguucgaggagcugugcgccgaccuguucgagagagugcccggccccgugcagcaggcccugcagagcgccgagaugagccuggacgagaucgagcaggugauccuggugggcggcgccaccagagugcccagagugcaggaggugcugcugaaggccgugggcaaggaggagcugggcaagaacaucaacgccgacgaggccgccgccaugggcgccguguaccaggccgccgcccugagcaaggccuucaaggugaagcccuucguggugagagacgccgugguguaccccauccugguggaguucaccagagagguggaggaggagcccggcauccacagccugaagcacaacaagagagugcuguucagcagaaugggccccuacccccagagaaaggugaucaccuucaacagauacagccacgacuucaacuuccacaucaacuacggcgaccugggcuuccugggccccgaggaccugagaguguucggcagccagaaccugaccaccgugaagcugaagggcgugggcgacagcuucaagaaguaccccgacuacgagagcaagggcaucaaggcccacuucaaccuggacgagagcggcgugcugagccuggacagaguggagagcguguucgagacccugguggaggacagcgccgaggaggagagcacccugaccaagcugggcaacaccaucagcagccuguucggcggcggcaccacccccgacgccaaggagaacggcaccgacaccgugcaggaggaggaggagagccccgccgagggcagcaaggacgagcccggcgagcagguggagcugaaggaggaggccgaggcccccguggaggacggcagccagccccccccccccgagcccaagggcgacgccacccccgagggcgagaaggccaccgagaaggagaacggcgacaagagcgaggcccagaagcccagcgagaaggccgaggccggccccgagggcguggcccccgcccccgagggcgagaagaagcagaagcccgccagaaagagaagaaugguggaggagaucggcguggagcugguggugcuggaccugcccgaccugcccgaggacaagcuggcccagagcgugcagaagcugcaggaccugacccugagagaccuggagaagcaggagagagagaaggccgccaacagccuggaggccuucaucuucgagacccaggacaagcuguaccagcccgaguaccaggaggugagcaccgaggagcagagagaggagaucagcggcaagcugagcgccgccagcaccuggcuggaggacgagggcgugggcgccaccaccgugaugcugaaggagaagcuggccgagcugagaaagcugugccagggccuguucuucagaguggaggagagaaagaaguggcccgagagacugagcgcccuggacaaccugcugaaccacagcagcauguuccugaagggcgccagacugauccccgagauggaccagaucuucaccgagguggagaugaccacccuggagaaggugaucaacgagaccugggccuggaagaacgccacccuggccgagcaggccaagcugcccgccaccgagaagcccgugcugcugagcaaggacaucgaggccaagaugauggcccuggacagagaggugcaguaccugcugaacaaggccaaguucaccaagcccagacccagacccaaggacaagaacggcaccagagccgagcccccccugaacgccagcgccagcgaccagggcgagaaggugaucccccccgccggccagaccgaggacgccgagcccaucagcgagcccgagaagguggagaccggcagcgagcccggcgacaccgagccccuggagcugggcggccccggcgccgagcccgagcagaaggagcagagcaccggccagaagagaccccugaagaacgacgagcuguga

SEQ ID NO: 568 - RNA, 2199 nt, Artificial Sequence
  derived and/or modified CDS sequence (opt4) from Homo sapiens__NP_005339.3 __HsHSP90AA1
augcccgaggagacccagacccaggaccagcccauggaggaggaggagguggagaccuucgccuuccaggccgagaucgcccagcugaugagccugaucaucaacaccuucuacagcaacaaggagaucuuccugagagagcugaucagcaacagcagcgacgcccuggacaagaucagauacgagagccugaccgaccccagcaagcuggacagcggcaaggagcugcacaucaaccugauccccaacaagcaggacagaacccugaccaucguggacaccggcaucggcaugaccaaggccgaccugaucaacaaccugggcaccaucgccaagagcggcaccaaggccuucauggaggcccugcaggccggcgccgacaucagcaugaucggccaguucggcgugggcuucuacagcgccuaccugguggccgagaaggugaccgugaucaccaagcacaacgacgacgagcaguacgccugggagagcagcgccggcggcagcuucaccgugagaaccgacaccggcgagcccaugggcagaggcaccaaggugauccugcaccugaaggaggaccagaccgaguaccuggaggagagaagaaucaaggagaucgugaagaagcacagccaguucaucggcuaccccaucacccuguucguggagaaggagagagacaaggaggugagcgacgacgaggccgaggagaaggaggacaaggaggaggagaaggagaaggaggagaaggagagcgaggacaagcccgagaucgaggacgugggcagcgacgaggaggaggagaagaaggacggcgacaagaagaagaagaagaagaucaaggagaaguacaucgaccaggaggagcugaacaagaccaagcccaucuggaccagaaaccccgacgacaucaccaacgaggaguacggcgaguucuacaagagccugaccaacgacugggaggaccaccuggccgugaagcacuucagcguggagggccagcuggaguucagagcccugcuguucgugcccagaagagcccccuucgaccuguucgagaacagaaagaagaagaacaacaucaagcuguacgugagaagaguguucaucauggacaacugcgaggagcugauccccgaguaccugaacuucaucagaggcgugguggacagcgaggaccugccccugaacaucagcagagagaugcugcagcagagcaagauccugaaggugaucagaaagaaccuggugaagaagugccuggagcuguucaccgagcuggccgaggacaaggagaacuacaagaaguucuacgagcaguucagcaagaacaucaagcugggcauccacgaggacagccagaacagaaagaagcugagcgagcugcugagauacuacaccagcgccagcggcgacgagauggugagccugaaggacuacugcaccagaaugaaggagaaccagaagcacaucuacuacaucaccggcgagaccaaggaccagguggccaacagcgccuucguggagagacugagaaagcacggccuggaggugaucuacaugaucgagcccaucgacgaguacugcgugcagcagcugaaggaguucgagggcaagacccuggugagcgugaccaaggagggccuggagcugcccgaggacgaggaggagaagaagaagcaggaggagaagaagaccaaguucgagaaccugugcaagaucaugaaggacauccuggagaagaagguggagaaggugguggugagcaacagacuggugaccagccccugcugcaucgugaccagcaccuacggcuggaccgccaacauggagagaaucaugaaggcccaggcccugagagacaacagcaccaugggcuacauggccgccaagaagcaccuggagaucaaccccgaccacagcaucaucgagacccugagacagaaggccgaggccgacaagaacgacaagagcgugaaggaccuggugauccugcuguacgagaccgcccugcugagcagcggcuucagccuggaggacccccagacccacgccaacagaaucuacagaaugaucaagcugggccugggcaucgacgaggacgaccccaccgccgacgacaccagcgccgccgugaccgaggagaugcccccccuggagggcgacgacgacaccagcagaauggaggagguggacuga

SEQ ID NO: 569 - RNA, 339 nt, Artificial Sequence
  derived and/or modified CDS sequence (opt4) from Homo sapiens__NG_005218__HsHSP90AA3P
auggacagcagcaagcuggacagcggcaagggccugcacaucaaccuggugcccaacaagcagaaccagacccugaccaucguggacaccagaaucggcaugaccaagaccgaccugaucaacaaccugggcaccgugaccaagagcggcaccaaggccuucauggaggcccugcaggccgacgccgacaucagcaugaucggccacuucggcgugggcuucuacagcgccuaccugguggccaagaaggugaccgugaucagcaagcacaacaacgacgagcaguacaccugggagagcagcgccggcggcagcuucaccgugagaaccgacgaguga

SEQ ID NO: 570 - RNA, 2175 nt, Artificial Sequence
  derived and/or modified CDS sequence (opt4) from Homo sapiens__NP_031381.2__HsHSP90AB1
augcccgaggaggugcaccacggcgaggaggagguggagaccuucgccuuccaggccgagaucgcccagcugaugagccugaucaucaacaccuucuacagcaacaaggagaucuuccugagagagcugaucagcaacgccagcgacgcccuggacaagaucagauacgagagccugaccgaccccagcaagcuggacagcggcaaggagcugaagaucgacaucauccccaacccccaggagagaacccugacccugguggacaccggcaucggcaugaccaaggccgaccugaucaacaaccugggcaccaucgccaagagcggcaccaaggccuucauggaggcccugcaggccggcgccgacaucagcaugaucggccaguucggcgugggcuucuacagcgccuaccugguggccgagaaggugguggugaucaccaagcacaacgacgacgagcaguacgccugggagagcagcgccggcggcagcuucaccgugagagccgaccacggcgagcccaucggcagaggcaccaaggugauccugcaccugaaggaggaccagaccgaguaccuggaggagagaagagugaaggagguggugaagaagcacagccaguucaucggcuaccccaucacccuguaccuggagaaggagagagagaaggagaucagcgacgacgaggccgaggaggagaagggcgagaaggaggaggaggacaaggacgacgaggagaagcccaagaucgaggacgugggcagcgacgaggaggacgacagcggcaaggacaagaagaagaagaccaagaagaucaaggagaaguacaucgaccaggaggagcugaacaagaccaagcccaucuggaccagaaaccccgacgacaucacccaggaggaguacggcgaguucuacaagagccugaccaacgacugggaggaccaccuggccgugaagcacuucagcguggagggccagcuggaguucagagcccugcuguucauccccagaagagcccccuucgaccuguucgagaacaagaagaagaagaacaacaucaagcuguacgugagaagaguguucaucauggacagcugcgacgagcugauccccgaguaccugaacuucaucagaggcgugguggacagcgaggaccugccccugaacaucagcagagagaugcugcagcagagcaagauccugaaggugaucagaaagaacaucgugaagaagugccuggagcuguucagcgagcuggccgaggacaaggagaacuacaagaaguucuacgaggccuucagcaagaaccugaagcugggcauccacgaggacagcaccaacagaagaagacugagcgagcugcugagauaccacaccagccagagcggcgacgagaugaccagccugagcgaguacgugagcagaaugaaggagacccagaagagcaucuacuacaucaccggcgagagcaaggagcagguggccaacagcgccuucguggagagagugagaaagagaggcuucgaggugguguacaugaccgagcccaucgacgaguacugcgugcagcagcugaaggaguucgacggcaagagccuggugagcgugaccaaggagggccuggagcugcccgaggacgaggaggagaagaagaagauggaggagagcaaggccaaguucgagaaccugugcaagcugaugaaggagauccuggacaagaagguggagaaggugaccaucagcaacagacuggugagcagccccugcugcaucgugaccagcaccuacggcuggaccgccaacauggagagaaucaugaaggcccaggcccugagagacaacagcaccaugggcuacaugauggccaagaagcaccuggagaucaaccccgaccaccccaucguggagacccugagacagaaggccgaggccgacaagaacgacaaggccgugaaggaccugguggugcugcuguucgagaccgcccugcugagcagcggcuucagccuggaggacccccagacccacagcaacagaaucuacagaaugaucaagcugggccugggcaucgacgaggacgagguggccgccgaggagcccaacgccgccgugcccgacgagauccccccccuggagggcgacgaggacgccagcagaauggaggagguggacuga

SEQ ID NO: 571 - RNA, 2412 nt, Artificial Sequence
  derived and/or modified CDS sequence (opt4) from Homo sapiens__NP_003290.1__HsHSP90B1
augagagcccugugggugcugggccugugcugcgugcugcugaccuucggcagcgugagagccgacgacgagguggacguggacggcaccguggaggaggaccugggcaagagcagagagggcagcagaaccgacgacgagguggugcagagagaggaggaggccauccagcuggacggccugaacgccagccagaucagagagcugagagagaagagcgagaaguucgccuuccaggccgaggugaacagaaugaugaagcugaucaucaacagccuguacaagaacaaggagaucuuccugagagagcugaucagcaacgccagcgacgcccuggacaagaucagacugaucagccugaccgacgagaacgcccugagcggcaacgaggagcugaccgugaagaucaagugcgacaaggagaagaaccugcugcacgugaccgacaccggcgugggcaugaccagagaggagcuggugaagaaccugggcaccaucgccaagagcggcaccagcgaguuccugaacaagaugaccgaggcccaggaggacggccagagcaccagcgagcugaucggccaguucggcgugggcuucuacagcgccuuccugguggccgacaaggugaucgugaccagcaagcacaacaacgacacccagcacaucugggagagcgacagcaacgaguucagcgugaucgccgaccccagaggcaacacccugggcagaggcaccaccaucacccuggugcugaaggaggaggccagcgacuaccuggagcuggacaccaucaagaaccuggugaagaaguacagccaguucaucaacuuccccaucuacguguggagcagcaagaccgagaccguggaggagcccauggaggaggaggaggccgccaaggaggagaaggaggagagcgacgacgaggccgccguggaggaggaggaggaggagaagaagcccaagaccaagaagguggagaagaccgugugggacugggagcugaugaacgacaucaagcccaucuggcagagacccagcaaggagguggaggaggacgaguacaaggccuucuacaagagcuucagcaaggagagcgacgaccccauggccuacauccacuucaccgccgagggcgaggugaccuucaagagcauccuguucgugcccaccagcgcccccagaggccuguucgacgaguacggcagcaagaagagcgacuacaucaagcuguacgugagaagaguguucaucaccgacgacuuccacgacaugaugcccaaguaccugaacuucgugaagggcgugguggacagcgacgaccugccccugaacgugagcagagagacccugcagcagcacaagcugcugaaggugaucagaaagaagcuggugagaaagacccuggacaugaucaagaagaucgccgacgacaaguacaacgacaccuucuggaaggaguucggcaccaacaucaagcugggcgugaucgaggaccacagcaacagaaccagacuggccaagcugcugagauuccagagcagccaccaccccaccgacaucaccagccuggaccaguacguggagagaaugaaggagaagcaggacaagaucuacuucauggccggcagcagcagaaaggaggccgagagcagccccuucguggagagacugcugaagaagggcuacgaggugaucuaccugaccgagcccguggacgaguacugcauccaggcccugcccgaguucgacggcaagagauuccagaacguggccaaggagggcgugaaguucgacgagagcgagaagaccaaggagagcagagaggccguggagaaggaguucgagccccugcugaacuggaugaaggacaaggcccugaaggacaagaucgagaaggccguggugagccagagacugaccgagagccccugcgcccugguggccagccaguacggcuggagcggcaacauggagagaaucaugaaggcccaggccuaccagaccggcaaggacaucagcaccaacuacuacgccagccagaagaagaccuucgagaucaaccccagacacccccugaucagagacaugcugagaagaaucaaggaggacgaggacgacaagaccgugcuggaccuggccguggugcuguucgagaccgccacccugagaagcggcuaccugcugcccgacaccaaggccuacggcgacagaaucgagagaaugcugagacugagccugaacaucgaccccgacgccaagguggaggaggagcccgaggaggagcccgaggagaccgccgaggacaccaccgaggacaccgagcaggacgaggacgaggagauggacgugggcaccgacgaggaggaggagaccgccaaggagagcaccgccgagaaggacgagcuguga

SEQ ID NO: 572 - RNA, 2115 nt, Artificial Sequence
  derived and/or modified CDS sequence (opt4) from Homo sapiens__NP_057376.2__HsTRAP1
auggccagagagcugagagcccugcugcuguggggcagaagacugagaccccugcugagagcccccgcccuggccgccgugcccggcggcaagcccauccugugccccagaagaaccaccgcccagcugggccccagaagaaaccccgccuggagccugcaggccggcagacuguucagcacccagaccgccgaggacaaggaggagccccugcacagcaucaucagcagcaccgagagcgugcagggcagcaccagcaagcacgaguuccaggccgagaccaagaagcugcuggacaucguggccagaagccuguacagcgagaaggagguguucaucagagagcugaucagcaacgccagcgacgcccuggagaagcugagacacaagcuggugagcgacggccaggcccugcccgagauggagauccaccugcagaccaacgccgagaagggcaccaucaccauccaggacaccggcaucggcaugacccaggaggagcuggugagcaaccugggcaccaucgccagaagcggcagcaaggccuuccuggacgcccugcagaaccaggccgaggccagcagcaagaucaucggccaguucggcgugggcuucuacagcgccuucaugguggccgacagaguggagguguacagcagaagcgccgcccccggcagccugggcuaccaguggcugagcgacggcagcggcguguucgagaucgccgaggccagcggcgugagaaccggcaccaagaucaucauccaccugaagagcgacugcaaggaguucagcagcgaggccagagugagagacguggugaccaaguacagcaacuucgugagcuucccccuguaccugaacggcagaagaaugaacacccugcaggccaucuggaugauggaccccaaggacgugagagaguggcagcacgaggaguucuacagauacguggcccaggcccacgacaagcccagauacacccugcacuacaagaccgacgccccccugaacaucagaagcaucuucuacgugcccgacaugaagcccagcauguucgacgugagcagagagcugggcagcagcguggcccuguacagcagaaaggugcugauccagaccaaggccaccgacauccugcccaaguggcugagauucaucagaggcgugguggacagcgaggacaucccccugaaccugagcagagagcugcugcaggagagcgcccugaucagaaagcugagagacgugcugcagcagagacugaucaaguucuucaucgaccagagcaagaaggacgccgagaaguacgccaaguucuucgaggacuacggccuguucaugagagagggcaucgugaccgccaccgagcaggaggugaaggaggacaucgccaagcugcugagauacgagagcagcgcccugcccagcggccagcugaccagccugagcgaguacgccagcagaaugagagccggcaccagaaacaucuacuaccugugcgcccccaacagacaccuggccgagcacagccccuacuacgaggccaugaagaagaaggacaccgaggugcuguucugcuucgagcaguucgacgagcugacccugcugcaccugagagaguucgacaagaagaagcugaucagcguggagaccgacaucgugguggaccacuacaaggaggagaaguucgaggacagaagccccgccgccgagugccugagcgagaaggagaccgaggagcugauggccuggaugagaaacgugcugggcagcagagugaccaacgugaaggugacccugagacuggacacccaccccgccauggugaccgugcuggagaugggcgccgccagacacuuccugagaaugcagcagcuggccaagacccaggaggagagagcccagcugcugcagcccacccuggagaucaaccccagacacgcccugaucaagaagcugaaccagcugagagccagcgagcccggccuggcccagcugcugguggaccagaucuacgagaacgccaugaucgccgccggccugguggacgaccccagagccauggugggcagacugaacgagcugcuggugaaggcccuggagagacacuga

SEQ ID NO: 573 - RNA, 462 nt, Artificial Sequence
  derived and/or modified CDS sequence (opt4) from Homo sapiens__NP_000609.1__HsIGF1
augggcaagaucagcagccugcccacccagcuguucaagugcugcuucugcgacuuccugaaggugaagaugcacaccaugagcagcagccaccuguucuaccuggcccugugccugcugaccuucaccagcagcgccaccgccggccccgagacccugugcggcgccgagcugguggacgcccugcaguucgugugcggcgacagaggcuucuacuucaacaagcccaccggcuacggcagcagcagcagaagagccccccagaccggcaucguggacgagugcugcuucagaagcugcgaccugagaagacuggagauguacugcgccccccugaagcccgccaagagcgccagaagcgugagagcccagagacacaccgacaugcccaagacccagaaggaggugcaccugaagaacgccagcagaggcagcgccggcaacaagaacuacagaauguga

SEQ ID NO: 574 - RNA, 543 nt, Artificial Sequence
  derived and/or modified CDS sequence (opt4) from Homo sapiens__NP_000603.1__HsIGF2
augggcauccccaugggcaagagcaugcuggugcugcugaccuuccuggccuucgccagcugcugcaucgccgccuacagacccagcgagacccugugcggcggcgagcugguggacacccugcaguucgugugcggcgacagaggcuucuacuucagcagacccgccagcagagugagcagaagaagcagaggcaucguggaggagugcugcuucagaagcugcgaccuggcccugcuggagaccuacugcgccacccccgccaagagcgagagagacgugagcaccccccccaccgugcugcccgacaacuuccccagauaccccgugggcaaguucuuccaguacgacaccuggaagcagagcacccagagacugagaagaggccugcccgcccugcugagagccagaagaggccacgugcuggccaaggagcuggaggccuucagagaggccaagagacacagaccccugaucgcccugcccacccaggaccccgcccacggcggcgccccccccgagauggccagcaacagaaaguga

SEQ ID NO: 575 - RNA, 639 nt, Artificial Sequence
  derived and/or modified CDS sequence (opt4) from Homo sapiens__NP_000591.1__HsIL6
augaacagcuucagcaccagcgccuucggccccguggccuucagccugggccugcugcuggugcugcccgccgccuuccccgcccccgugccccccggcgaggacagcaaggacguggccgccccccacagacagccccugaccagcagcgagagaaucgacaagcagaucagauacauccuggacggcaucagcgcccugagaaaggagaccugcaacaagagcaacaugugcgagagcagcaaggaggcccuggccgagaacaaccugaaccugcccaagauggccgagaaggacggcugcuuccagagcggcuucaacgaggagaccugccuggugaagaucaucaccggccugcuggaguucgagguguaccuggaguaccugcagaacagauucgagagcagcgaggagcaggccagagccgugcagaugagcaccaaggugcugauccaguuccugcagaagaaggccaagaaccuggacgccaucaccacccccgaccccaccaccaacgccagccugcugaccaagcugcaggcccagaaccaguggcugcaggacaugaccacccaccugauccugagaagcuucaaggaguuccugcagagcagccugagagcccugagacagauguga

SEQ ID NO: 576 - RNA, 1281 nt, Artificial Sequence
  derived and/or modified CDS sequence (opt4) from Homo sapiens__NP_002183.1__HsINHBA
augccccugcuguggcugagaggcuuccugcuggccagcugcuggaucaucgugagaagcagccccacccccggcagcgagggccacagcgccgcccccgacugccccagcugcgcccuggccgcccugcccaaggacgugcccaacagccagcccgagaugguggaggccgugaagaagcacauccugaacaugcugcaccugaagaagagacccgacgugacccagcccgugcccaaggccgcccugcugaacgccaucagaaagcugcacgugggcaaggugggcgagaacggcuacguggagaucgaggacgacaucggcagaagagccgagaugaacgagcugauggagcagaccagcgagaucaucaccuucgccgagagcggcaccgccagaaagacccugcacuucgagaucagcaaggagggcagcgaccugagcgugguggagagagccgagguguggcuguuccugaaggugcccaaggccaacagaaccagaaccaaggugaccaucagacuguuccagcagcagaagcacccccagggcagccuggacaccggcgaggaggccgaggaggugggccugaagggcgagagaagcgagcugcugcugagcgagaaggugguggacgccagaaagagcaccuggcacguguuccccgugagcagcagcauccagagacugcuggaccagggcaagagcagccuggacgugagaaucgccugcgagcagugccaggagagcggcgccagccuggugcugcugggcaagaagaagaagaaggaggaggagggcgagggcaagaagaagggcggcggcgagggcggcgccggcgccgacgaggagaaggagcagagccacagacccuuccugaugcugcaggccagacagagcgaggaccacccccacagaagaagaagaagaggccuggagugcgacggcaaggugaacaucugcugcaagaagcaguucuucgugagcuucaaggacaucggcuggaacgacuggaucaucgcccccagcggcuaccacgccaacuacugcgagggcgagugccccagccacaucgccggcaccagcggcagcagccugagcuuccacagcaccgugaucaaccacuacagaaugagaggccacagccccuucgccaaccugaagagcugcugcgugcccaccaagcugagacccaugagcaugcuguacuacgacgacggccagaacaucaucaagaaggacauccagaacaugaucguggaggagugcggcugcagcuga

SEQ ID NO: 577 - RNA, 1224 nt, Artificial Sequence
  derived and/or modified CDS sequence (opt4) from Homo sapiens__NP_002184.2__HsINHBB
auggacggccugcccggcagagcccugggcgccgccugccugcugcugcuggccgccggcuggcugggccccgaggccuggggcagccccacccccccccccacccccgccgcccccccccccccccccccccccggcagccccggcggcagccaggacaccugcaccagcugcggcggcuucagaagacccgaggagcugggcagaguggacggcgacuuccuggaggccgugaagagacacauccugagcagacugcagaugagaggcagacccaacaucacccacgccgugcccaaggccgccauggugaccgcccugagaaagcugcacgccggcaaggugagagaggacggcagaguggagaucccccaccuggacggccacgccagccccggcgccgacggccaggagagagugagcgagaucaucagcuucgccgagaccgacggccuggccagcagcagagugagacuguacuucuucaucagcaacgagggcaaccagaaccuguucguggugcaggccagccuguggcuguaccugaagcugcugcccuacgugcuggagaagggcagcagaagaaaggugagagugaagguguacuuccaggagcagggccacggcgacagauggaacaugguggagaagagaguggaccugaagagaagcggcuggcacaccuucccccugaccgaggccauccaggcccuguucgagagaggcgagagaagacugaaccuggacgugcagugcgacagcugccaggagcuggccguggugcccguguucguggaccccggcgaggagagccacagacccuucgugguggugcaggccagacugggcgacagcagacacagaaucagaaagagaggccuggagugcgacggcagaaccaaccugugcugcagacagcaguucuucaucgacuucagacugaucggcuggaacgacuggaucaucgcccccaccggcuacuacggcaacuacugcgagggcagcugccccgccuaccuggccggcgugcccggcagcgccagcagcuuccacaccgccguggugaaccaguacagaaugagaggccugaaccccggcaccgugaacagcugcugcauccccaccaagcugagcaccaugagcaugcuguacuucgacgacgaguacaacaucgugaagagagacgugcccaacaugaucguggaggagugcggcugcgccuga

SEQ ID NO: 578 - RNA, 3459 nt, Artificial Sequence
  derived and/or modified CDS sequence (opt4) from Homo sapiens__NP_000623.2__HsITGAM
auggcccugagagugcugcugcugaccgcccugacccugugccacggcuucaaccuggacaccgagaacgccaugaccuuccaggagaacgccagaggcuucggccagagcguggugcagcugcagggcagcagagugguggugggcgccccccaggagaucguggccgccaaccagagaggcagccuguaccagugcgacuacagcaccggcagcugcgagcccaucagacugcaggugcccguggaggccgugaacaugagccugggccugagccuggccgccaccaccagccccccccagcugcuggccugcggccccaccgugcaccagaccugcagcgagaacaccuacgugaagggccugugcuuccuguucggcagcaaccugagacagcagccccagaaguuccccgaggcccugagaggcugcccccaggaggacagcgacaucgccuuccugaucgacggcagcggcagcaucaucccccacgacuucagaagaaugaaggaguucgugagcaccgugauggagcagcugaagaagagcaagacccuguucagccugaugcaguacagcgaggaguucagaauccacuucaccuucaaggaguuccagaacaaccccaaccccagaagccuggugaagcccaucacccagcugcugggcagaacccacaccgccaccggcaucagaaagguggugagagagcuguucaacaucaccaacggcgccagaaagaacgccuucaagauccugguggugaucaccgacggcgagaaguucggcgacccccugggcuacgaggacgugauccccgaggccgacagagagggcgugaucagauacgugaucggcgugggcgacgccuucagaagcgagaagagcagacaggagcugaacaccaucgccagcaagccccccagagaccacguguuccaggugaacaacuucgaggcccugaagaccauccagaaccagcugagagagaagaucuucgccaucgagggcacccagaccggcagcagcagcagcuucgagcacgagaugagccaggagggcuucagcgccgccaucaccagcaacggcccccugcugagcaccgugggcagcuacgacugggccggcggcguguuccuguacaccagcaaggagaagagcaccuucaucaacaugaccagaguggacagcgacaugaacgacgccuaccugggcuacgccgccgccaucauccugagaaacagagugcagagccuggugcugggcgcccccagauaccagcacaucggccugguggccauguucagacagaacaccggcaugugggagagcaacgccaacgugaagggcacccagaucggcgccuacuucggcgccagccugugcagcguggacguggacagcaacggcagcaccgaccuggugcugaucggcgccccccacuacuacgagcagaccagaggcggccaggugagcgugugcccccugcccagaggcagagccagauggcagugcgacgccgugcuguacggcgagcagggccagcccuggggcagauucggcgccgcccugaccgugcugggcgacgugaacggcgacaagcugaccgacguggccaucggcgcccccggcgaggaggacaacagaggcgccguguaccuguuccacggcaccagcggcagcggcaucagccccagccacagccagagaaucgccggcagcaagcugagccccagacugcaguacuucggccagagccugagcggcggccaggaccugaccauggacggccugguggaccugaccgugggcgcccagggccacgugcugcugcugagaagccagcccgugcugagagugaaggccaucauggaguucaaccccagagagguggccagaaacguguucgagugcaacgaccagguggugaagggcaaggaggccggcgaggugagagugugccugcacgugcagaagagcaccagagacagacugagagagggccagauccagagcguggugaccuacgaccuggcccuggacagcggcagaccccacagcagagccguguucaacgagaccaagaacagcaccagaagacagacccaggugcugggccugacccagaccugcgagacccugaagcugcagcugcccaacugcaucgaggaccccgugagccccaucgugcugagacugaacuucagccuggugggcaccccccugagcgccuucggcaaccugagacccgugcuggccgaggacgcccagagacuguucaccgcccuguuccccuucgagaagaacugcggcaacgacaacaucugccaggacgaccugagcaucaccuucagcuucaugagccuggacugccugguggugggcggccccagagaguucaacgugaccgugaccgugagaaacgacggcgaggacagcuacagaacccaggugaccuucuucuucccccuggaccugagcuacagaaaggugagcacccugcagaaccagagaagccagagaagcuggagacuggccugcgagagcgccagcagcaccgaggugagcggcgcccugaagagcaccagcugcagcaucaaccaccccaucuuccccgagaacagcgaggugaccuucaacaucaccuucgacguggacagcaaggccagccugggcaacaagcugcugcugaaggccaacgugaccagcgagaacaacaugcccagaaccaacaagaccgaguuccagcuggagcugcccgugaaguacgccguguacaugguggugaccagccacggcgugagcaccaaguaccugaacuucaccgccagcgagaacaccagcagagugaugcagcaccaguaccaggugagcaaccugggccagagaagccugcccaucagccugguguuccuggugcccgugagacugaaccagaccgugaucugggacagaccccaggugaccuucagcgagaaccugagcagcaccugccacaccaaggagagacugcccagccacagcgacuuccuggccgagcugagaaaggcccccguggugaacugcagcaucgccgugugccagagaauccagugcgacauccccuucuucggcauccaggaggaguucaacgccacccugaagggcaaccugagcuucgacugguacaucaagaccagccacaaccaccugcugaucgugagcaccgccgagauccuguucaacgacagcguguucacccugcugcccggccagggcgccuucgugagaagccagaccgagaccaagguggagcccuucgaggugcccaacccccugccccugaucgugggcagcagcgugggcggccugcugcugcuggcccugaucaccgccgcccuguacaagcugggcuucuucaagagacaguacaaggacaugaugagcgagggcggcccccccggcgccgagccccaguga

SEQ ID NO: 579 - RNA, 1404 nt, Artificial Sequence
  derived and/or modified CDS sequence (opt4) from Homo sapiens__NP_002415.1__HsMMP8
auguucagccugaagacccugcccuuccugcugcugcugcacgugcagaucagcaaggccuuccccgugagcagcaaggagaagaacaccaagaccgugcaggacuaccuggagaaguucuaccagcugcccagcaaccaguaccagagcaccagaaagaacggcaccaacgugaucguggagaagcugaaggagaugcagagauucuucggccugaacgugaccggcaagcccaacgaggagacccuggacaugaugaagaagcccagaugcggcgugcccgacagcggcggcuucaugcugacccccggcaaccccaagugggagagaaccaaccugaccuacagaaucagaaacuacaccccccagcugagcgaggccgagguggagagagccaucaaggacgccuucgagcuguggagcguggccagcccccugaucuucaccagaaucagccagggcgaggccgacaucaacaucgccuucuaccagagagaccacggcgacaacagccccuucgacggccccaacggcauccuggcccacgccuuccagcccggccagggcaucggcggcgacgcccacuucgacgccgaggagaccuggaccaacaccagcgccaacuacaaccuguuccugguggccgcccacgaguucggccacagccugggccuggcccacagcagcgaccccggcgcccugauguaccccaacuacgccuucagagagaccagcaacuacagccugccccaggacgacaucgacggcauccaggccaucuacggccugagcagcaaccccauccagcccaccggccccagcacccccaagcccugcgaccccagccugaccuucgacgccaucaccacccugagaggcgagauccuguucuucaaggacagauacuucuggagaagacacccccagcugcagagaguggagaugaacuucaucagccuguucuggcccagccugcccaccggcauccaggccgccuacgaggacuucgacagagaccugaucuuccuguucaagggcaaccaguacugggcccugagcggcuacgacauccugcagggcuaccccaaggacaucagcaacuacggcuuccccagcagcgugcaggccaucgacgccgccguguucuacagaagcaagaccuacuucuucgugaacgaccaguucuggagauacgacaaccagagacaguucauggagcccggcuaccccaagagcaucagcggcgccuuccccggcaucgagagcaagguggacgccguguuccagcaggagcacuucuuccacguguucagcggccccagauacuacgccuucgaccugaucgcccagagagugaccagaguggccagaggcaacaaguggcugaacugcagauacggcuga

SEQ ID NO: 580 - RNA, 2124 nt, Artificial Sequence
  derived and/or modified CDS sequence (opt4) from Homo sapiens__NP_004985.2__HsMMP9
augagccuguggcagccccuggugcuggugcugcuggugcugggcugcugcuucgccgcccccagacagagacagagcacccuggugcuguuccccggcgaccugagaaccaaccugaccgacagacagcuggccgaggaguaccuguacagauacggcuacaccagaguggccgagaugagaggcgagagcaagagccugggccccgcccugcugcugcugcagaagcagcugagccugcccgagaccggcgagcuggacagcgccacccugaaggccaugagaacccccagaugcggcgugcccgaccugggcagauuccagaccuucgagggcgaccugaaguggcaccaccacaacaucaccuacuggauccagaacuacagcgaggaccugcccagagccgugaucgacgacgccuucgccagagccuucgcccuguggagcgccgugaccccccugaccuucaccagaguguacagcagagacgccgacaucgugauccaguucggcguggccgagcacggcgacggcuaccccuucgacggcaaggacggccugcuggcccacgccuucccccccggccccggcauccagggcgacgcccacuucgacgacgacgagcuguggagccugggcaagggcgugguggugcccaccagauucggcaacgccgacggcgccgccugccacuuccccuucaucuucgagggcagaagcuacagcgccugcaccaccgacggcagaagcgacggccugcccuggugcagcaccaccgccaacuacgacaccgacgacagauucggcuucugccccagcgagagacuguacacccaggacggcaacgccgacggcaagcccugccaguuccccuucaucuuccagggccagagcuacagcgccugcaccaccgacggcagaagcgacggcuacagauggugcgccaccaccgccaacuacgacagagacaagcuguucggcuucugccccaccagagccgacagcaccgugaugggcggcaacagcgccggcgagcugugcguguuccccuucaccuuccugggcaaggaguacagcaccugcaccagcgagggcagaggcgacggcagacuguggugcgccaccaccagcaacuucgacagcgacaagaaguggggcuucugccccgaccagggcuacagccuguuccugguggccgcccacgaguucggccacgcccugggccuggaccacagcagcgugcccgaggcccugauguaccccauguacagauucaccgagggccccccccugcacaaggacgacgugaacggcaucagacaccuguacggccccagacccgagcccgagcccagaccccccaccaccaccaccccccagcccaccgccccccccaccgugugccccaccggcccccccaccgugcaccccagcgagagacccaccgccggccccaccggcccccccagcgccggccccaccggcccccccaccgccggccccagcaccgccaccaccgugccccugagccccguggacgacgccugcaacgugaacaucuucgacgccaucgccgagaucggcaaccagcuguaccuguucaaggacggcaaguacuggagauucagcgagggcagaggcagcagaccccagggccccuuccugaucgccgacaaguggcccgcccugcccagaaagcuggacagcguguucgaggagagacugagcaagaagcuguucuucuucagcggcagacagguguggguguacaccggcgccagcgugcugggccccagaagacuggacaagcugggccugggcgccgacguggcccaggugaccggcgcccugagaagcggcagaggcaagaugcugcuguucagcggcagaagacuguggagauucgacgugaaggcccagaugguggaccccagaagcgccagcgagguggacagaauguuccccggcgugccccuggacacccacgacguguuccaguacagagagaaggccuacuucugccaggacagauucuacuggagagugagcagcagaagcgagcugaaccagguggaccaggugggcuacgugaccuacgacauccugcagugccccgaggacuga

SEQ ID NO: 581 - RNA, 1416 nt, Artificial Sequence
  derived and/or modified CDS sequence (opt4) from Homo sapiens__NP_002418.1__HsMMP13
augcaccccggcgugcuggccgccuuccuguuccugagcuggacccacugcagagcccugccccugcccagcggcggcgacgaggacgaccugagcgaggaggaccugcaguucgccgagagauaccugagaagcuacuaccaccccaccaaccuggccggcauccugaaggagaacgccgccagcagcaugaccgagagacugagagagaugcagagcuucuucggccuggaggugaccggcaagcuggacgacaacacccuggacgugaugaagaagcccagaugcggcgugcccgacgugggcgaguacaacguguuccccagaacccugaaguggagcaagaugaaccugaccuacagaaucgugaacuacacccccgacaugacccacagcgagguggagaaggccuucaagaaggccuucaagguguggagcgacgugaccccccugaacuucaccagacugcacgacggcaucgccgacaucaugaucagcuucggcaucaaggagcacggcgacuucuaccccuucgacggccccagcggccugcuggcccacgccuucccccccggccccaacuacggcggcgacgcccacuucgacgacgacgagaccuggaccagcagcagcaagggcuacaaccuguuccugguggccgcccacgaguucggccacagccugggccuggaccacagcaaggaccccggcgcccugauguuccccaucuacaccuacaccggcaagagccacuucaugcugcccgacgacgacgugcagggcauccagagccuguacggccccggcgacgaggaccccaaccccaagcaccccaagacccccgacaagugcgaccccagccugagccuggacgccaucaccagccugagaggcgagaccaugaucuucaaggacagauucuucuggagacugcacccccagcagguggacgccgagcuguuccugaccaagagcuucuggcccgagcugcccaacagaaucgacgccgccuacgagcaccccagccacgaccugaucuucaucuucagaggcagaaaguucugggcccugaacggcuacgacauccuggagggcuaccccaagaagaucagcgagcugggccugcccaaggaggugaagaagaucagcgccgccgugcacuucgaggacaccggcaagacccugcuguucagcggcaaccagguguggagauacgacgacaccaaccacaucauggacaaggacuaccccagacugaucgaggaggacuuccccggcaucggcgacaagguggacgccguguacgagaagaacggcuacaucuacuucuucaacggccccauccaguucgaguacagcaucuggagcaacagaaucgugagagugaugcccgccaacagcauccuguggugcuga

SEQ ID NO: 582 - RNA, 1068 nt, Artificial Sequence
  derived and/or modified CDS sequence (opt4) from Homo sapiens__NP_001286.1__HsCCR1
auggagacccccaacaccaccgaggacuacgacaccaccaccgaguucgacuacggcgacgccacccccugccagaaggugaacgagagagccuucggcgcccagcugcugcccccccuguacagccugguguucgugaucggccuggugggcaacauccugguggugcuggugcuggugcaguacaagagacugaagaacaugaccagcaucuaccugcugaaccuggccaucagcgaccugcuguuccuguucacccugcccuucuggaucgacuacaagcugaaggacgacuggguguucggcgacgccaugugcaagauccugagcggcuucuacuacaccggccuguacagcgagaucuucuucaucauccugcugaccaucgacagauaccuggccaucgugcacgccguguucgcccugagagccagaaccgugaccuucggcgugaucaccagcaucaucaucugggcccuggccauccuggccagcaugcccggccuguacuucagcaagacccagugggaguucacccaccacaccugcagccugcacuucccccacgagagccugagagaguggaagcuguuccaggcccugaagcugaaccuguucggccuggugcugccccugcuggugaugaucaucugcuacaccggcaucaucaagauccugcugagaagacccaacgagaagaagagcaaggccgugagacugaucuucgugaucaugaucaucuucuuccuguucuggacccccuacaaccugaccauccugaucagcguguuccaggacuuccuguucacccacgagugcgagcagagcagacaccuggaccuggccgugcaggugaccgaggugaucgccuacacccacugcugcgugaaccccgugaucuacgccuucgugggcgagagauucagaaaguaccugagacagcuguuccacagaagaguggccgugcaccuggugaaguggcugcccuuccugagcguggacagacuggagagagugagcagcaccagccccagcaccggcgagcacgagcugagcgccggcuucuga

SEQ ID NO: 583 - RNA, 636 nt, Artificial Sequence
  derived and/or modified CDS sequence (opt4) from Homo sapiens__NP_002598.4__HsPDGFA
augagaacccuggccugccugcugcugcugggcugcggcuaccuggcccacgugcuggccgaggaggccgagauccccagagaggugaucgagagacuggccagaagccagauccacagcaucagagaccugcagagacugcuggagaucgacagcgugggcagcgaggacagccuggacaccagccugagagcccacggcgugcacgccaccaagcacgugcccgagaagagaccccugcccaucagaagaaagagaagcaucgaggaggccgugcccgccgugugcaagaccagaaccgugaucuacgagauccccagaagccagguggaccccaccagcgccaacuuccugaucuggccccccugcguggaggugaagagaugcaccggcugcugcaacaccagcagcgugaagugccagcccagcagagugcaccacagaagcgugaagguggccaagguggaguacgugagaaagaagcccaagcugaaggaggugcaggugagacuggaggagcaccuggagugcgccugcgccaccaccagccugaaccccgacuacagagaggaggacaccggcagacccagagagagcggcaagaagagaaagagaaagagacugaagcccaccuga

SEQ ID NO: 584 - RNA, 726 nt, Artificial Sequence
  derived and/or modified CDS sequence (opt4) from Homo sapiens__NP_002599.1__HsPDGFB
augaacagaugcugggcccuguuccugagccugugcugcuaccugagacuggugagcgccgagggcgaccccauccccgaggagcuguacgagaugcugagcgaccacagcaucagaagcuucgacgaccugcagagacugcugcacggcgaccccggcgaggaggacggcgccgagcuggaccugaacaugaccagaagccacagcggcggcgagcuggagagccuggccagaggcagaagaagccugggcagccugaccaucgccgagcccgccaugaucgccgagugcaagaccagaaccgagguguucgagaucagcagaagacugaucgacagaaccaacgccaacuuccugguguggccccccugcguggaggugcagagaugcagcggcugcugcaacaacagaaacgugcagugcagacccacccaggugcagcugagacccgugcaggugagaaagaucgagaucgugagaaagaagcccaucuucaagaaggccaccgugacccuggaggaccaccuggccugcaagugcgagaccguggccgccgccagacccgugaccagaagccccggcggcagccaggagcagagagccaagaccccccagaccagagugaccaucagaaccgugagagugagaagaccccccaagggcaagcacagaaaguucaagcacacccacgacaagaccgcccugaaggagacccugggcgccuga

SEQ ID NO: 585 - RNA, 1038 nt, Artificial Sequence
  derived and/or modified CDS sequence (opt4) from Homo sapiens__NP_057289.1__HsPDGFC
augagccuguucggccugcugcugcugaccagcgcccuggccggccagagacagggcacccaggccgagagcaaccugagcagcaaguuccaguucagcagcaacaaggagcagaacggcgugcaggacccccagcacgagagaaucaucaccgugagcaccaacggcagcauccacagccccagauucccccacaccuaccccagaaacaccgugcugguguggagacugguggccguggaggagaacguguggauccagcugaccuucgacgagagauucggccuggaggaccccgaggacgacaucugcaaguacgacuucguggagguggaggagcccagcgacggcaccauccugggcagauggugcggcagcggcaccgugcccggcaagcagaucagcaagggcaaccagaucagaaucagauucgugagcgacgaguacuuccccagcgagcccggcuucugcauccacuacaacaucgugaugccccaguucaccgaggccgugagccccagcgugcugccccccagcgcccugccccuggaccugcugaacaacgccaucaccgccuucagcacccuggaggaccugaucagauaccuggagcccgagagauggcagcuggaccuggaggaccuguacagacccaccuggcagcugcugggcaaggccuucguguucggcagaaagagcagagugguggaccugaaccugcugaccgaggaggugagacuguacagcugcacccccagaaacuucagcgugagcaucagagaggagcugaagagaaccgacaccaucuucuggcccggcugccugcuggugaagagaugcggcggcaacugcgccugcugccugcacaacugcaacgagugccagugcgugcccagcaaggugaccaagaaguaccacgaggugcugcagcugagacccaagaccggcgugagaggccugcacaagagccugaccgacguggcccuggagcaccacgaggagugcgacugcgugugcagaggcagcaccggcggcuga

SEQ ID NO: 586 - RNA, 1095 nt, Artificial Sequence
  derived and/or modified CDS sequence (opt4) from Homo sapiens__NP_149126.1__HsPDGFD
augcacagacugaucuucguguacacccugaucugcgccaacuucugcagcugcagagacaccagcgccaccccccagagcgccagcaucaaggcccugagaaacgccaaccugagaagagacgaccuguacagaagagacgagaccauccaggugaagggcaacggcuacgugcagagccccagauuccccaacagcuaccccagaaaccugcugcugaccuggagacugcacagccaggagaacaccagaauccagcugguguucgacaaccaguucggccuggaggaggccgagaacgacaucugcagauacgacuucguggagguggaggacaucagcgagaccagcaccaucaucagaggcagauggugcggccacaaggaggugccccccagaaucaagagcagaaccaaccagaucaagaucaccuucaagagcgacgacuacuucguggccaagcccggcuucaagaucuacuacagccugcuggaggacuuccagcccgccgccgccagcgagaccaacugggagagcgugaccagcagcaucagcggcgugagcuacaacagccccagcgugaccgaccccacccugaucgccgacgcccuggacaagaagaucgccgaguucgacaccguggaggaccugcugaaguacuucaaccccgagagcuggcaggaggaccuggagaacauguaccuggacacccccagauacagaggcagaagcuaccacgacagaaagagcaagguggaccuggacagacugaacgacgacgccaagagauacagcugcacccccagaaacuacagcgugaacaucagagaggagcugaagcuggccaacgugguguucuuccccagaugccugcuggugcagagaugcggcggcaacugcggcugcggcaccgugaacuggagaagcugcaccugcaacagcggcaagaccgugaagaaguaccacgaggugcugcaguucgagcccggccacaucaagagaagaggcagagccaagaccauggcccugguggacauccagcuggaccaccacgagagaugcgacugcaucugcagcagcagaccccccagauga

SEQ ID NO: 587 - RNA, 678 nt, Artificial Sequence
  derived and/or modified CDS sequence (opt4) from Homo sapiens__NP_003946.3__HsSOCS3
auggugacccacagcaaguuccccgccgccggcaugagcagaccccuggacaccagccugagacugaagaccuucagcagcaagagcgaguaccagcugguggugaacgccgugagaaagcugcaggagagcggcuucuacuggagcgccgugaccggcggcgaggccaaccugcugcugagcgccgagcccgccggcaccuuccugaucagagacagcagcgaccagagacacuucuucacccugagcgugaagacccagagcggcaccaagaaccugagaauccagugcgagggcggcagcuucagccugcagagcgaccccagaagcacccagcccgugcccagauucgacugcgugcugaagcuggugcaccacuacaugcccccccccggcgcccccagcuuccccagcccccccaccgagcccagcagcgaggugcccgagcagcccagcgcccagccccugcccggcagcccccccagaagagccuacuacaucuacagcggcggcgagaagaucccccuggugcugagcagaccccugagcagcaacguggccacccugcagcaccugugcagaaagaccgugaacggccaccuggacagcuacgagaaggugacccagcugcccggccccaucagagaguuccuggaccaguacgacgccccccuguga

SEQ ID NO: 588 - RNA, 483 nt, Artificial Sequence
  derived and/or modified CDS sequence (opt4) from Homo sapiens__NP_003227.1__HsTGFA
auggugcccagcgccggccagcuggcccuguucgcccugggcaucgugcuggccgccugccaggcccuggagaacagcaccagcccccugagcgccgacccccccguggccgccgccguggugagccacuucaacgacugccccgacagccacacccaguucugcuuccacggcaccugcagauuccuggugcaggaggacaagcccgccugcgugugccacagcggcuacgugggcgccagaugcgagcacgccgaccugcuggccgugguggccgccagccagaagaagcaggccaucaccgcccuggugguggugagcaucguggcccuggccgugcugaucaucaccugcgugcugauccacugcugccaggugagaaagcacugcgaguggugcagagcccugaucugcagacacgagaagcccagcgcccugcugaagggcagaaccgccugcugccacagcgagaccgugguguga

SEQ ID NO: 589 - RNA, 1173 nt, Artificial Sequence
  derived and/or modified CDS sequence (opt4) from Homo sapiens__NP_000651.3__HsTGFB1
augccccccagcggccugagacugcugccccugcugcugccccugcuguggcugcuggugcugacccccggcagacccgccgccggccugagcaccugcaagaccaucgacauggagcuggugaagagaaagagaaucgaggccaucagaggccagauccugagcaagcugagacuggccagcccccccagccagggcgaggugccccccggcccccugcccgaggccgugcuggcccuguacaacagcaccagagacagaguggccggcgagagcgccgagcccgagcccgagcccgaggccgacuacuacgccaaggaggugaccagagugcugaugguggagacccacaacgagaucuacgacaaguucaagcagagcacccacagcaucuacauguucuucaacaccagcgagcugagagaggccgugcccgagcccgugcugcugagcagagccgagcugagacugcugagacugaagcugaagguggagcagcacguggagcuguaccagaaguacagcaacaacagcuggagauaccugagcaacagacugcuggcccccagcgacagccccgaguggcugagcuucgacgugaccggcguggugagacaguggcugagcagaggcggcgagaucgagggcuucagacugagcgcccacugcagcugcgacagcagagacaacacccugcagguggacaucaacggcuucaccaccggcagaagaggcgaccuggccaccauccacggcaugaacagacccuuccugcugcugauggccaccccccuggagagagcccagcaccugcagagcagcagacacagaagagcccuggacaccaacuacugcuucagcagcaccgagaagaacugcugcgugagacagcuguacaucgacuucagaaaggaccugggcuggaaguggauccacgagcccaagggcuaccacgccaacuucugccugggccccugccccuacaucuggagccuggacacccaguacagcaaggugcuggcccuguacaaccagcacaaccccggcgccagcgccgcccccugcugcgugccccaggcccuggagccccugcccaucguguacuacgugggcagaaagcccaagguggagcagcugagcaacaugaucgugagaagcugcaagugcagcuga

SEQ ID NO: 590 - RNA, 1245 nt, Artificial Sequence
  derived and/or modified CDS sequence (opt4) from Homo sapiens__NP_003229.1__HsTGFB2
augcacuacugcgugcugagcgccuuccugauccugcaccuggugaccguggcccugagccugagcaccugcagcacccuggacauggaccaguucaugagaaagagaaucgaggccaucagaggccagauccugagcaagcugaagcugaccagcccccccgaggacuaccccgagcccgaggaggugccccccgaggugaucagcaucuacaacagcaccagagaccugcugcaggagaaggccagcagaagagccgccgccugcgagagagagagaagcgacgaggaguacuacgccaaggagguguacaagaucgacaugccccccuucuuccccagcgagaacgccaucccccccaccuucuacagacccuacuucagaaucgugagauucgacgugagcgccauggagaagaacgccagcaaccuggugaaggccgaguucagaguguucagacugcagaaccccaaggccagagugcccgagcagagaaucgagcuguaccagauccugaagagcaaggaccugaccagccccacccagagauacaucgacagcaagguggugaagaccagagccgagggcgaguggcugagcuucgacgugaccgacgccgugcacgaguggcugcaccacaaggacagaaaccugggcuucaagaucagccugcacugccccugcugcaccuucgugcccagcaacaacuacaucauccccaacaagagcgaggagcuggaggccagauucgccggcaucgacggcaccagcaccuacaccagcggcgaccagaagaccaucaagagcaccagaaagaagaacagcggcaagaccccccaccugcugcugaugcugcugcccagcuacagacuggagagccagcagaccaacagaagaaagaagagagcccuggacgccgccuacugcuucagaaacgugcaggacaacugcugccugagaccccuguacaucgacuucaagagagaccugggcuggaaguggauccacgagcccaagggcuacaacgccaacuucugcgccggcgccugccccuaccuguggagcagcgacacccagcacagcagagugcugagccuguacaacaccaucaaccccgaggccagcgccagccccugcugcgugagccaggaccuggagccccugaccauccuguacuacaucggcaagacccccaagaucgagcagcugagcaacaugaucgugaagagcugcaagugcagcuga

SEQ ID NO: 591 - RNA, 1239 nt, Artificial Sequence
  derived and/or modified CDS sequence (opt4) from Homo sapiens__NP_003230.1__HsTGFB3
augaagaugcaccugcagagagcccugguggugcuggcccugcugaacuucgccaccgugagccugagccugagcaccugcaccacccuggacuucggccacaucaagaagaagagaguggaggccaucagaggccagauccugagcaagcugagacugaccagcccccccgagcccaccgugaugacccacgugcccuaccaggugcuggcccuguacaacagcaccagagagcugcuggaggagaugcacggcgagagagaggagggcugcacccaggagaacaccgagagcgaguacuacgccaaggagauccacaaguucgacaugauccagggccuggccgagcacaacgagcuggccgugugccccaagggcaucaccagcaagguguucagauucaacgugagcagcguggagaagaacagaaccaaccuguucagagccgaguucagagugcugagagugcccaaccccagcagcaagagaaacgagcagagaaucgagcuguuccagauccugagacccgacgagcacaucgccaagcagagauacaucggcggcaagaaccugcccaccagaggcaccgccgaguggcugagcuucgacgugaccgacaccgugagagaguggcugcugagaagagagagcaaccugggccuggagaucagcauccacugccccugccacaccuuccagcccaacggcgacauccuggagaacauccacgaggugauggagaucaaguucaagggcguggacaacgaggacgaccacggcagaggcgaccugggcagacugaagaagcagaaggaccaccacaacccccaccugauccugaugaugauccccccccacagacuggacaaccccggccagggcggccagagaaagaagagagcccuggacaccaacuacugcuucagaaaccuggaggagaacugcugcgugagaccccuguacaucgacuucagacaggaccugggcuggaagugggugcacgagcccaagggcuacuacgccaacuucugcagcggccccugccccuaccugagaagcgccgacaccacccacagcaccgugcugggccuguacaacacccugaaccccgaggccagcgccagccccugcugcgugccccaggaccuggagccccugaccauccuguacuacgugggcagaacccccaagguggagcagcugagcaacaugguggugaagagcugcaagugcagcuga

SEQ ID NO: 592 - RNA, 1386 nt, Artificial Sequence
  derived and/or modified CDS sequence (opt4) from Homo sapiens__NP_001057.1__HsTNFRSF1B
auggcccccguggccgugugggccgcccuggccgugggccuggagcugugggccgccgcccacgcccugcccgcccagguggccuucacccccuacgcccccgagcccggcagcaccugcagacugagagaguacuacgaccagaccgcccagaugugcugcagcaagugcagccccggccagcacgccaagguguucugcaccaagaccagcgacaccgugugcgacagcugcgaggacagcaccuacacccagcuguggaacugggugcccgagugccugagcugcggcagcagaugcagcagcgaccagguggagacccaggccugcaccagagagcagaacagaaucugcaccugcagacccggcugguacugcgcccugagcaagcaggagggcugcagacugugcgccccccugagaaagugcagacccggcuucggcguggccagacccggcaccgagaccagcgacguggugugcaagcccugcgcccccggcaccuucagcaacaccaccagcagcaccgacaucugcagaccccaccagaucugcaacgugguggccauccccggcaacgccagcauggacgccgugugcaccagcaccagccccaccagaagcauggcccccggcgccgugcaccugccccagcccgugagcaccagaagccagcacacccagcccacccccgagcccagcaccgcccccagcaccagcuuccugcugcccaugggccccagcccccccgccgagggcagcaccggcgacuucgcccugcccgugggccugaucgugggcgugaccgcccugggccugcugaucaucggcguggugaacugcgugaucaugacccaggugaagaagaagccccugugccugcagagagaggccaaggugccccaccugcccgccgacaaggccagaggcacccagggccccgagcagcagcaccugcugaucaccgcccccagcagcagcagcagcagccuggagagcagcgccagcgcccuggacagaagagcccccaccagaaaccagccccaggcccccggcguggaggccagcggcgccggcgaggccagagccagcaccggcagcagcgacagcagccccggcggccacggcacccaggugaacgugaccugcaucgugaacgugugcagcagcagcgaccacagcagccagugcagcagccaggccagcagcaccaugggcgacaccgacagcagccccagcgagagccccaaggacgagcaggugcccuucagcaaggaggagugcgccuucagaagccagcuggagacccccgagacccugcugggcagcaccgaggagaagccccugccccugggcgugcccgacgccggcaugaagcccagcuga

SEQ ID NO: 593 - RNA, 513 nt, Artificial Sequence
  derived and/or modified CDS sequence (opt4) from Homo sapiens__NP_002623.2__HsPGF
augcccgugaugagacuguuccccugcuuccugcagcugcuggccggccuggcccugcccgccgugcccccccagcagugggcccugagcgccggcaacggcagcagcgagguggagguggugcccuuccaggagguguggggcagaagcuacugcagagcccuggagagacugguggacguggugagcgaguaccccagcgagguggagcacauguucagccccagcugcgugagccugcugagaugcaccggcugcugcggcgacgagaaccugcacugcgugcccguggagaccgccaacgugaccaugcagcugcugaagaucagaagcggcgacagacccagcuacguggagcugaccuucagccagcacgugagaugcgagugcagaccccugagagagaagaugaagcccgagagaagaagacccaagggcagaggcaagagaagaagagagaagcagagacccaccgacugccaccugugcggcgacgccgugcccagaagauga

SEQ ID NO: 594 - RNA, 1239 nt, Artificial Sequence
  derived and/or modified CDS sequence (opt4) from Homo sapiens__NP_001020537.2__HsVEGFA
augaccgacagacagaccgacaccgcccccagccccagcuaccaccugcugcccggcagaagaagaaccguggacgccgccgccagcagaggccagggccccgagcccgcccccggcggcggcguggagggcgugggcgccagaggcguggcccugaagcuguucgugcagcugcugggcugcagcagauucggcggcgccguggugagagccggcgaggccgagcccagcggcgccgccagaagcgccagcagcggcagagaggagccccagcccgaggagggcgaggaggaggaggagaaggaggaggagagaggcccccaguggagacugggcgccagaaagcccggcagcuggaccggcgaggccgccgugugcgccgacagcgcccccgccgccagagccccccaggcccuggccagagccagcggcagaggcggcagaguggccagaagaggcgccgaggagagcggccccccccacagccccagcagaagaggcagcgccagcagagccggccccggcagagccagcgagaccaugaacuuccugcugagcugggugcacuggagccuggcccugcugcuguaccugcaccacgccaaguggagccaggccgcccccauggccgagggcggcggccagaaccaccacgagguggugaaguucauggacguguaccagagaagcuacugccaccccaucgagacccugguggacaucuuccaggaguaccccgacgagaucgaguacaucuucaagcccagcugcgugccccugaugagaugcggcggcugcugcaacgacgagggccuggagugcgugcccaccgaggagagcaacaucaccaugcagaucaugagaaucaagccccaccagggccagcacaucggcgagaugagcuuccugcagcacaacaagugcgagugcagacccaagaaggacagagccagacaggagaagaagagcgugagaggcaagggcaagggccagaagagaaagagaaagaagagcagauacaagagcuggagcguguacgugggcgccagaugcugccugaugcccuggagccugcccggcccccaccccugcggccccugcagcgagagaagaaagcaccuguucgugcaggacccccagaccugcaagugcagcugcaagaacaccgacagcagaugcaaggccagacagcuggagcugaacgagagaaccugcagaugcgacaagcccagaagauga

SEQ ID NO: 595 - RNA, 699 nt, Artificial Sequence
  derived and/or modified CDS sequence (opt4) from Homo sapiens__NP_001165094.1__HsVEGFA
augaacuuccugcugagcugggugcacuggagccuggcccugcugcuguaccugcaccacgccaaguggagccaggccgcccccauggccgagggcggcggccagaaccaccacgagguggugaaguucauggacguguaccagagaagcuacugccaccccaucgagacccugguggacaucuuccaggaguaccccgacgagaucgaguacaucuucaagcccagcugcgugccccugaugagaugcggcggcugcugcaacgacgagggccuggagugcgugcccaccgaggagagcaacaucaccaugcagaucaugagaaucaagccccaccagggccagcacaucggcgagaugagcuuccugcagcacaacaagugcgagugcagacccaagaaggacagagccagacaggagaagaagagcgugagaggcaagggcaagggccagaagagaaagagaaagaagagcagauacaagagcuggagcguguacgugggcgccagaugcugccugaugcccuggagccugcccggcccccaccccugcggccccugcagcgagagaagaaagcaccuguucgugcaggacccccagaccugcaagugcagcugcaagaacaccgacagcagaugcaaggccagacagcuggagcugaacgagagaaccugcagaugcgacaagcccagaagauga

SEQ ID NO: 596 - RNA, 624 nt, Artificial Sequence
  derived and/or modified CDS sequence (opt4) from Homo sapiens__NP_003368.1__HsVEGFB
augagcccccugcugagaagacugcugcuggccgcccugcugcagcuggcccccgcccaggcccccgugagccagcccgacgcccccggccaccagagaaagguggugagcuggaucgacguguacaccagagccaccugccagcccagagaggugguggugccccugaccguggagcugaugggcaccguggccaagcagcuggugcccagcugcgugaccgugcagagaugcggcggcugcugccccgacgacggccuggagugcgugcccaccggccagcaccaggugagaaugcagauccugaugaucagauaccccagcagccagcugggcgagaugagccuggaggagcacagccagugcgagugcagacccaagaagaaggacagcgccgugaagcccgacagagccgccaccccccaccacagaccccagcccagaagcgugcccggcugggacagcgcccccggcgcccccagccccgccgacaucacccaccccacccccgcccccggccccagcgcccacgccgcccccagcaccaccagcgcccugacccccggccccgccgccgccgccgccgacgccgccgccagcagcguggccaagggcggcgccuga

SEQ ID NO: 597 - RNA, 1260 nt, Artificial Sequence
  derived and/or modified CDS sequence (opt4) from Homo sapiens__NP_005420.1__HsVEGFC
augcaccugcugggcuucuucagcguggccugcagccugcuggccgccgcccugcugcccggccccagagaggcccccgccgccgccgccgccuucgagagcggccuggaccugagcgacgccgagcccgacgccggcgaggccaccgccuacgccagcaaggaccuggaggagcagcugagaagcgugagcagcguggacgagcugaugaccgugcuguaccccgaguacuggaagauguacaagugccagcugagaaagggcggcuggcagcacaacagagagcaggccaaccugaacagcagaaccgaggagaccaucaaguucgccgccgcccacuacaacaccgagauccugaagagcaucgacaacgaguggagaaagacccagugcaugcccagagaggugugcaucgacgugggcaaggaguucggcguggccaccaacaccuucuucaagccccccugcgugagcguguacagaugcggcggcugcugcaacagcgagggccugcagugcaugaacaccagcaccagcuaccugagcaagacccuguucgagaucaccgugccccugagccagggccccaagcccgugaccaucagcuucgccaaccacaccagcugcagaugcaugagcaagcuggacguguacagacaggugcacagcaucaucagaagaagccugcccgccacccugccccagugccaggccgccaacaagaccugccccaccaacuacauguggaacaaccacaucugcagaugccuggcccaggaggacuucauguucagcagcgacgccggcgacgacagcaccgacggcuuccacgacaucugcggccccaacaaggagcuggacgaggagaccugccagugcgugugcagagccggccugagacccgccagcugcggcccccacaaggagcuggacagaaacagcugccagugcgugugcaagaacaagcuguuccccagccagugcggcgccaacagagaguucgacgagaacaccugccagugcgugugcaagagaaccugccccagaaaccagccccugaaccccggcaagugcgccugcgagugcaccgagagcccccagaagugccugcugaagggcaagaaguuccaccaccagaccugcagcugcuacagaagacccugcaccaacagacagaaggccugcgagcccggcuucagcuacagcgaggaggugugcagaugcgugcccagcuacuggaagagaccccagaugagcuga

SEQ ID NO: 598 - RNA, 1065 nt, Artificial Sequence
  derived and/or modified CDS sequence (opt4) from Homo sapiens__NP_004460.1__HsVEGFD
auguacagagagugggugguggugaacguguucaugaugcuguacgugcagcuggugcagggcagcagcaacgagcacggccccgugaagagaagcagccagagcacccuggagagaagcgagcagcagaucagagccgccagcagccuggaggagcugcugagaaucacccacagcgaggacuggaagcuguggagaugcagacugagacugaagagcuucaccagcauggacagcagaagcgccagccacagaagcaccagauucgccgccaccuucuacgacaucgagacccugaaggugaucgacgaggaguggcagagaacccagugcagccccagagagaccugcguggagguggccagcgagcugggcaagagcaccaacaccuucuucaagccccccugcgugaacguguucagaugcggcggcugcugcaacgaggagagccugaucugcaugaacaccagcaccagcuacaucagcaagcagcuguucgagaucagcgugccccugaccagcgugcccgagcuggugcccgugaagguggccaaccacaccggcugcaagugccugcccaccgcccccagacaccccuacagcaucaucagaagaagcauccagauccccgaggaggacagaugcagccacagcaagaagcugugccccaucgacaugcugugggacagcaacaagugcaagugcgugcugcaggaggagaacccccuggccggcaccgaggaccacagccaccugcaggagcccgcccugugcggcccccacaugauguucgacgaggacagaugcgagugcgugugcaagacccccugccccaaggaccugauccagcaccccaagaacugcagcugcuucgagugcaaggagagccuggagaccugcugccagaagcacaagcuguuccaccccgacaccugcagcugcgaggacagaugccccuuccacaccagacccugcgccagcggcaagaccgccugcgccaagcacugcagauuccccaaggagaagagagccgcccagggcccccacagcagaaagaaccccuga

SEQ ID NO: 599 - RNA, 72 nt, Artificial Sequence
  derived and/or modified CDS sequence (opt5) from Homo sapiens__AAA59606.1__signal peptide-HLA-A2-SP
auggccgugauggcucccagaacccugguccuccugcuuagcggcgcccuggcgcucacacagacgugggcu

SEQ ID NO: 600 - RNA, 69 nt, Artificial Sequence
  derived and/or modified CDS sequence (opt5) from Homo sapiens__AAA61213.1__signal peptide-HsPLAT
auggacgccaugaagagaggccugugcugugugcuccugcuuugcggggcugucuucguuagccccucc

SEQ ID NO: 601 - RNA, 81 nt, Artificial Sequence
  derived and/or modified CDS sequence (opt5) from Homo sapiens__NP_000790.2__signal peptide-HsEPO
augggcgugcacgagugccccgccuggcuguggcuccugcuuagccugcucucccugccucuugggcugccgguccucgga

SEQ ID NO: 602 - RNA, 54 nt, Artificial Sequence
  derived and/or modified CDS sequence (opt5) from Homo sapiens__NP_000468.1__signal peptide-HsALB
augaagugggugaccuucaucagccugcucuuucuguucuccucugccuacagc

SEQ ID NO: 603 - RNA, 18 nt, Artificial Sequence
  derived and/or modified CDS sequence (opt5) from Artificial____cleavage site-Furin
agacggcgcagaaagcgg

SEQ ID NO: 604 - RNA, 630 nt, Artificial Sequence
  derived and/or modified CDS sequence (opt5) from Homo sapiens__NP_061986.1__HsFGF21
auggacagcgaugagaccggcuucgaacacuccgggcugugggugucuguccucgccggacugcuucugggcgcuugccaggcccaucccaucccugacagcuccccgcuccugcaauuugggggacagguuagacagcgguaccuuuauacagaugacgcgcagcaaacggaggcucaccuggaaauucgcgaggauggcaccgugggcggagccgccgaccagucucccgaaagccuccugcagcugaaggcucucaaaccuggcgugauccagauucugggcgucaagacauccagauuccuuugucaacggcccgauggggcccuguacggaucucuccauuuugacccugaggcuugcagcuuccgcgagcugcuucuggaagauggcuauaacguguaccaguccgaggcccacgggcucccccugcaucugccuggaaauaaaagcccgcacagagaccccgcgccucggggccccgcccgcuuucucccucugcccgggcuuccgccugcucugcccgaaccucccggaauccucgcuccccagccuccggauguugggucuuccgacccccugagcauggugggcccuucucaggggagaucccccagcuaugccucuuga

SEQ ID NO: 605 - RNA, 1410 nt, Artificial Sequence
  derived and/or modified CDS sequence (opt5) from Homo sapiens__NP_002412.1__HsMMP1
augcacagcuuucccccucugcuccugcuucuguucuggggcguggucucccauucuuucccggccacccucgagacacaggaacaagacguugaucuggugcagaaguaccuugagaaauauuacaaccugaagaaugacgggagacagguggaaaaacggcgcaacagcggacccgucguggagaagcucaaacagaugcaagaauuuuucggccugaagguuacggggaagccugaugcugagacccugaaagugaugaagcagcccagaugcggagucccugacguggcccaguuuguucucacagagggcaauccccggugggaacagacccaccugacauaucgcaucgagaacuacaccccugaucuuccgagagcggacguggaucaugcuauugaaaaagccuuccaacugugguccaaugucacaccccucaccuuuacgaaggugucugaggggcaggccgacaucaugauuagcuucgugcggggagaucaccgcgacaacuccccuuuugauggccccggcgggaaucuggcucaugccuuccagccuggacccggcaucgggggagacgcucacuuugaugaggacgaaagauggaccaacaauuuccgggaguauaaccuucaccgcgucgccgcgcaugaacugggccacucucucgggcugagccauuccacagacauuggagcccugauguacccgagcuauaccuuuucuggcgauguucagcucgcucaagacgauaucgacggcauccaggccauuuacgggagaucccagaauccugugcaacccaucggaccucagacacccaaggcuugugauagcaaacugaccuucgacgccauuacgacaauccggggcgaggugauguucuuuaaggaucgcuucuacaugagaaccaaccccuuuuauccugaagucgagcuuaauuucauuucuguguuuuggccgcagcugcccaacgggcucgaggcggccuacgaguucgcugaccgggaugaaguucgcuuuuucaaaggaaauaaguauugggccgugcagggccaaaacguccugcacggguacccuaaagacaucuauuccagcuuuggauuccccagaacagugaagcacauugaugcugcccuuucugaagagaacaccggcaaaaccuacuuuuucguugccaauaaguauuggcgguacgacgaauacaaaagauccauggacccuggcuaucccaagaugaucgcucaugauuuuccggggaucggacacaagguggacgcggucuucaugaaagauggcuucuuuuacuucuuucaugggacacgccaguauaaguucgacccuaaaacgaagcggauucugacccuccagaaagccaacagcugguuuaauugcagaaagaacuga

SEQ ID NO: 606 - RNA, 1170 nt, Artificial Sequence
  derived and/or modified CDS sequence (opt5) from Homo sapiens__NP_002412.1__HsMMP1(1-19,100-469)
augcacagcuuucccccucugcuccugcuucuguucuggggcguggucucccauucuuucguucucaccgaggggaacccgagaugggaacagacacaccugacguaccggauugagaauuauacccccgaccuuccucgcgccgauguggaccaugcuauugaaaaggccuuucaacuguggagcaacgugacaccccucaccuucacaaaagucuccgagggacaggcggauaucaugauuucuuuugugagaggcgaccaccgggauaauagcccuuucgacgggcccggaggcaaccuggcucaugccuuucagccugggccgggaaucggcggcgaugcccacuucgacgaagaugagcgcuggaccaauaacuuuagagaguacaaucugcaccggguugcugcccaugaacucgggcacucccugggacuuucucauagcacagacauuggcgcucugauguaucccuccuacaccuucagcggggaugugcagcucgcccaagacgauaucgacggaauccaggcgauuuauggccgcucucagaacccuguccagcccaucgggccucaaacgcccaaggccugcgacuccaaacugaccuuugaugcuauuacaaccaucagaggagaggugauguucuuuaaggaccgguucuacaugcgcacaaauccguucuauccugaaguugagcuuaacuuuauuagcguguucuggccccagcugccuaauggccucgaggccgcuuacgaauuugccgauagagacgagguccgguucuuuaaaggcaacaaguacugggcggugcaggggcagaaugugcugcacggauaucccaaggauaucuacucuuccuucggcuuuccccgcaccgucaaacacauugacgccgcucugagcgaagagaacacggggaagacauauuucuuuguugccaauaaauacuggagauaugaugaauacaagcggucuauggacccuggauauccgaaaaugaucgcucaugauuuccccggcaucgggcacaagguggacgccguguuuaugaaggauggauucuuuuacuucuuccauggcacccgccaauacaaauuugacccuaagacaaaaagaauccucacccugcagaaggccaacuccugguucaacugucggaaaaauuga

SEQ ID NO: 607 - RNA, 3357 nt, Artificial Sequence
  derived and/or modified CDS sequence (opt5) from Clostridium histolyticum__BAA77453.1__ColG
augaagaaaaacauccugaagauucucauggacagcuacuccaaagagucuaagauccagaccgugagacgggucacaagcguuucccugcuugccguguaucugacgaugaauaccucuagccucgugcuggcuaaacccauugaaaacacaaaugauaccuccaucaagaacgucgagaaacuucgcaaugccccuaacgaagaaaauucuaaaaagguggaagacagcaaaaacgauaagguugagcacgugaaaaauauugaggaagcgaaggucgagcaaguggcuccggaaguuaaguccaaaagcacacugagaucugccuccaucgccaacaccaauagcgagaaguacgacuucgaguaucucaacggccugucuuacacagaacugaccaaucucaucaaaaacauuaaguggaaucagaucaacgggcuguuuaacuauuccacgggaagccagaaauucuuuggcgauaagaaucgggugcaggcuauuaucaacgcccuucaagagucugggcgcaccuacacagcuaaugacaugaaaggaauugaaaccuucacagagguccugagagccggcuuuuaucucggguacuacaacgauggacuguccuaucuuaaugaccggaacuuccaggauaagugcauccccgcgaugauugccauccagaagaauccuaacuuuaaacugggcaccgcugugcaggacgaagugaucacgagccucggcaagcugauugggaaugccuccgcuaacgccgaggucguuaauaacugugugcccgugcugaaacaauuccgcgagaaucucaaccaguacgcgccugauuaugucaagggaacagccgugaaugaacugaucaaaggcauugaguuugacuucucuggggcugccuacgaaaaggauguuaagaccaugcccugguauggaaaaaucgacccuuuuauuaacgagcuuaaggcucugggccucuacgggaacaucacaagcgccaccgaaugggccuccgacgugggaaucuauuaccugagcaaauucggccuuuacucuaccaauagaaacgauauuguccagucccuggagaaggcuguggacauguauaaauacggcaagaucgcguuuguugccauggagcggauuacaugggauuaugacgggaucggaagcaauggcaagaaaguggaucaugacaaguuccucgaugacgcugaaaaacacuaccugccgaagacguauaccuucgauaacgggacauuuauuauccgcgccggagacaaagucucugaggaaaagaucaagagacuguacugggccagccgggaggugaaaucccaguuccaucgcgucgugggcaaugauaaggcucucgaaguugggaacgccgacgacgugcugaccaugaaaauuuuuaauucucccgaggaguauaaguucaacacaaauaucaacggagucagcaccgauaauggcggccuuuacauugaaccuagagggacguuuuacacauaugagcggacaccccaacaguccaucuucagccuggaggagcucuuucgccacgaguacacccauuaucugcaggcgagauaccuuguggacggacuguggggccaagggccuuucuaugagaaaaaccggcucaccugguuugaugaaggaaccgcugaguucuuugccggcucuacaagaacguccgggguucugccccgcaagagcauucugggcuaccucgccaaagacaagguggaucaccgguauucucugaagaaaacccuuaauuccggauacgacgauagcgacuggauguucuacaacuauggcuuugcugucgcccacuaccuguaugaaaaggauaugccgacauucaucaaaaugaauaaggcuauucucaacaccgacgugaaauccuacgaugaaaucaucaagaagcugucugacgaugccaacaaaaauacagaguaucagaaccauauucaggagcuggcggacaaguaccagggggccggaaucccucuugugagcgacgauuaucucaaagaccacggcuacaagaaggcuuccgaaguuuacucugagauuagcaaggccgcuucccugaccaauacgagcgucaccgccgaaaagucucaauauuucaacacauuuacccugagagggacauacaccggagagacguccaaaggcgaguucaaggauugggacgaaaugagcaaaaagcucgaugggacacuggagucucuugcgaaaaauuccuggagcggcuauaagacccugacagccuacuuuaccaacuaucgcgugaccucugacaauaaggugcaguacgaugucguguuccauggaguucucacagacaacgcugauaucagcaauaacaaagcccccauugcuaaggugacgggcccuuccaccggggccgucggacggaauaucgaauuuagcggcaaagacucuaaggaugaggacgggaaaaucguguccuaugauugggacuucggagacggcgccacaagcagagggaagaacuccguucacgcuuacaaaaaggcgggcaccuacaaugugacacugaaggucaccgaugacaaaggagccacggcuacagaaucuuuuaccauugagaucaagaacgaagauaccacaacccccauuacaaaagagauggagcccaaugacgauaucaaggaagccaacggcccuauuguggaggggguuacggugaaaggagaccugaacggcagcgaugacgccgauaccuucuauuuugacgucaaggaagauggggacgugacaaucgagcuuccguacuccggaucuagcaauuucaccuggcucguguauaaggagggcgacgaucagaaccacaucgcuuccgggauugacaaaaauaacucuaaggucggcacauuuaaaagcaccaagggacgccauuacguuuucaucuauaaacacgauuccgccagcaauauuucuuacucccugaacaucaagggccuggggaaugaaaagcucaaagagaaggaaaacaaugacagcucugauaaagcgacggugauucccaacuuuaauaccacaaugcagggaucccugcuuggcgacgauagccgggacuauuacucuuucgaggugaaggaagagggggaggucaacaucgaacuggauaaaaaggacgaguucggagugaccuggacacuccauccugaauccaauaucaacgauagaauuaccuacggccaaguugacggcaauaaggugagcaacaaagucaagcugcgccccgggaaauauuaccugcuuguguauaaguacuccggaagcggcaauuaugagcuccggguuaacaaauga

SEQ ID NO: 608 - RNA, 3081 nt, Artificial Sequence
  derived and/or modified CDS sequence (opt5) from Clostridium histolyticum__BAA77453.1__HsALB(1-18)_ColG(111-1118)
augaagugggugaccuucaucagccugcucuuucuguucuccucugccuacagcauugcuaacacaaauuccgagaaauaugacuuugaauaccuuaacggccugucuuauacggagcucaccaaucugaucaagaacauuaaauggaaucagaucaacgggcuuuucaauuacagcacaggaucccaaaaguuuuucggcgauaaaaacagaguccaggccauuaucaaugcgcugcaggaaucugggcggaccuauacagcuaacgacaugaagggaaucgagaccuuuacagaaguucuccgcgccggcuucuaccugggguauuacaaugauggacugagcuaccucaacgacagaaauuuucaggauaagugcauucccgccaugaucgcuauucagaaaaacccuaauuucaagcugggcaccgccgugcaagacgaggugaucacgucccuuggcaaacugauugggaacgcuagcgccaacgcggaggucgugaauaacuguguuccggugcucaagcaguuucgggaaaaucugaaccaguaugcccccgauuacgucaaaggaaccgcugugaaugagcuuaucaagggcauugaguucgacuuuucuggggccgcuuaugaaaaggauguuaaaacaaugccuugguacggaaagaucgaccccuucaucaacgagcugaaagcccucggccuguaugggaauauuaccuccgcgacagaaugggccagcgaugugggaaucuacuaucugucuaaguucggccucuacuccaccaaccgcaaugacauuguccaaagccuggagaaagcuguggauauguacaaguauggcaaaaucgccuuuguggcuauggaaagaauuacgugggacuacgacgggaucggaucuaacggcaagaaggucgaucacgacaaauuccuugaugacgccgagaagcauuaucugccuaaaacauacaccuuugauaaugggacauucaucauucgggccggagacaagguuuccgaagagaaaaucaagcgccucuauugggcuagcagagaggugaagucccaguuucaccggguggucggcaacgauaaagcgcuggaaguggggaaugccgacgauguucuuaccaugaagauuuucaacucucccgaggaauacaaauuuaauaccaacaucaacggagugagcacagacaauggcggccuguauauugagccucgcgggacguucuacaccuacgaaagaacaccgcagcaguccaucuuuagccucgaggagcuguuccggcaugaauauacccacuaccugcaagcucgcuaucucgucgauggacuguggggccaggggcccuuuuacgagaagaacagacuuacaugguucgacgaaggaaccgccgaguuuuucgccggcucuacgcggacauccggggugcugccucgcaaaagcauccucggcuaucuggcuaaggacaagguugaucauagauacucucuuaaaaagacccugaauagcggauaugacgauuccgacuggauguucuacaacuacggcuuugccguggcgcacuaucucuacgaaaaagauaugcccaccuucauuaagaugaauaaagcuauccugaacacagacgucaagucuuaugaugagauuaucaagaaacugagcgacgaugccaauaagaacaccgaguaccagaaucacauucaagaacucgccgacaaauaucagggggcuggaaucccucugguguccgaugacuaccuuaaggaucauggcuauaaaaaggccagcgaggucuacucugaaauuuccaaagcugccagccugacaaacacgucugugaccgcggagaagucccaguacuuuaauacauucacccuccgggggacauauaccggagagacgagcaagggcgaauuuaaagacugggacgagauguccaagaaacuggaugggacccuggaaucucuugccaagaacagcugguccggcuacaaaacacucaccgcuuauuucacaaauuacagaguuaccucugacaacaaggugcaguaugaugucguguuucacggaguucugacggacaaugccgauaucagcaacaacaaggcucccaucgccaaagugacaggcccguccaccggggcggucggacgcaauauugaguucagcggcaaggacucuaaagaugaagacgggaagaucguguccuacgauugggacuuuggagauggcgccacaagccgggggaaaaacucugugcaugcuuauaagaaggccggcaccuacaauguuacccugaaagucacagacgauaagggagcuacggccaccgaguccuucacaauugagaucaaaaacgaagacaccacaaccccuauuacgaaggagauggaacccaaugacgauaucaaagaggccaacggcccuaucguggaaggggugacagucaagggagaccucaauggcagcgaugacgcugauaccuuuuacuucgacgugaaggaggauggggacguuaccauugagcugcccuauucuggaagcuccaacuuuacauggcuuguguacaaagaaggcgaugaccaaaaucacaucgcgagcgggauugauaagaacaauucuaaagucggcaccuucaaguccacaaaaggaagacacuauguguucaucuacaagcaugacagcgccuccaacauuucuuauagccugaauaucaaaggccucgggaacgagaagcugaaggaaaaagagaauaacgacuccucugauaaggcuacgguuauccccaacuuuaauaccacaaugcagggaagccugcuuggcgacgauucccgcgacuacuauucuuucgaagugaaagaggagggggaagucaacauugagcucgauaagaaagacgaauuuggagugaccuggacacugcacccugagagcaauaucaacgaucggauuaccuacggccagguugacggcaauaagguguccaacaaggucaaacugagaccggggaaguacuaucuccugguguacaaauauagcggaucuggcaauuacgagcuucgcgugaacaaguga

SEQ ID NO: 609 - RNA, 3429 nt, Artificial Sequence
  derived and/or modified CDS sequence (opt5) from Clostridium histolyticum__BAA77453.1__HsALB(1-18)_ColG(1-110)_CS-F_ColG(111-1 118)
augaagugggugaccuucaucagccugcucuuucuguucuccucugccuacagcaugaaaaagaacauucuuaaaauccugauggacuccuauucuaaggagagcaaaauucagacagucagacggguuacguccgugucucuccuggcuguguaccuuaccaugaauacaagcucccugguccucgccaagcccaucgaaaacaccaaugauacaagcauuaagaacguggagaaacugcgcaaugcgccuaacgaagaaaauucuaagaaaguugaagacuccaagaacgauaaaguggagcacgucaagaauaucgaggaagcuaagguggagcaaguugccccggaagugaaaagcaagucuacccugagauccgccagccggcgcagacggaaacgcaucgcuaacacaaauucugagaaguaugacuuugaguaccucaacggccuguccuauaccgaacuuacgaaucugauuaaaaacaucaaguggaaucagauuaacggacucuucaacuacagcaccggaucccagaaauuuuucggcgauaagaauagaguccaggccaucauuaacgcucugcaagagucugggcggacauauaccgccaaugacaugaagggaaucgaaacauuuaccgaggugcuucgcgcgggcuucuaccugggguacuauaacgauggacucagcuaccugaaugacagaaacuuucaggauaaaugcauucccgccaugaucgcuauccagaagaauccuaacuucaaacugggcacggccgugcaggacgaagucauuacaucccucggcaagcugaucgggaaugcuagcgccaacgcggagguugugaauaacugugugcccguccuuaaacaauuucgggagaaucugaaccaguaugccccugauuacgugaagggaaccgcuguuaaugaacucauuaagggcaucgaguucgacuuuucuggggccgcuuaugaaaaagaugugaagacaaugcccugguacggaaaaauugacccuuucaucaacgagcugaaggcccuuggccuguaugggaacaucaccuccgccaccgaaugggcuagcgacgucggaauuuacuaccucucuaaauucggccuguauagcacaaaucgcaacgauaucgugcagucccuggagaaggcgguugacauguacaaguauggcaaaauugccuuuguggcuauggagagaaucacgugggauuacgacgggauuggaucuaauggcaagaaagucgaucaugacaaguuccucgaugacgccgaaaaacacuaucugccgaagaccuacacauuugauaacgggaccuucaucauccgggccggagacaaggugagcgaggaaaagauuaagcgccuuuauugggcuuccagagaggucaaaagccaguuucaucgggugguuggcaaugauaaggcccuggaaguggggaacgcggacgacguccucacaaugaaaaucuucaauucucccgaggaguacaaguuuaacaccaauauuaacggaguguccacggauaauggcggccuguacaucgaaccuagagggacauucuauaccuacgagcgcacaccccaacagagcauuuuuagccuugaggagcuguuccggcacgaguauacccauuaccuccaggcuagauaucugguugacggacuguggggccaagggccuuuuuacgagaaaaaccgccucaccugguucgaugaaggaacagccgaauuuuucgccggcuccacgcggaccagcggggugcugcccagaaaguccauccuuggcuaucuggcuaaggacaaagucgaucaccgcuacucucucaagaaaacacugaauagcggauacgacgauuccgacuggauguucuauaacuacggcuuugccguggcucacuaucuguacgagaaggauaugccgaccuucauuaaaaugaauaaggccauccuuaacacagacgugaagucuuaugaugaaaucauuaaaaagcucagcgacgaugcgaacaaaaauaccgaguaccagaaccauauccaggagcuggccgacaaguaucagggggcugggauuccucugguuuccgacgauuaccucaaagaccacggcuacaagaaggccagcgaagucuauucugagaucuccaaagcugccagccugacgaauaccucugugacagcggaaaagucccaauacuuuaacaccuucacacuucgggggaccuauacgggagagacaagcaaaggcgaauuuaaggauugggacgagaugucuaaaaagcuggaugggacccucgagagccuggccaaaaauuccuggagcggcuacaaaacacugaccgcuuauuucaccaacuacagagugacaucugacaauaagguccaguaugaugugguuuuucauggagugcuuacggacaacgccgauauuuccaauaacaaagcucccaucgccaaggucaccggcccuagcacaggggccgugggacgcaauaucgaguucuccggcaaagacucuaaggaugaagacgggaaaauuguuagcuacgauugggacuuuggagacggcgcuaccucccgggggaagaacucugugcacgcguacaagaaagccggcacauauaaugucacccucaaggugacggaugacaaaggagcuacagccaccgaaucuuucaccaucgagauuaagaacgaagauacaaccacacccaucacgaaagagauggagcccaaugacgauauuaaggaagccaacggcccuaucguugagggggugaccgucaagggagaccugaacggcuccgaugacgcugauacauuuuacuucgacgugaaagaagauggggacgugaccaucgagcugccguauucuggaagcuccaauuuuacauggcucgucuacaaggagggcgacgaucagaaccacauugccagcgggaucgacaaaaauaacucuaagguuggcaccuucaaauccacgaagggaagacauuauguguucauuuacaagcacgauagcgcgucuaauaucuccuauagccugaacauuaaaggccuugggaaugaaaagcugaaagagaaggaaaacaaugacucuuccgauaaagcuaccgugauccccaacuuuaauacaaccaugcagggaagccuccugggcgacgauucccgcgacuacuacagcuucgaggucaaggaagagggggaggugaacaucgaacuggauaagaaagacgaguuuggaguuacauggacccuucauccugaaucuaauauuaacgaucggaucacauauggccaaguggacggcaauaaggucagcaacaaagugaagcucagacccgggaaauacuaucugcugguuuacaaguauuccggaucuggcaauuacgagcuccgggugaacaaguga

SEQ ID NO: 610 - RNA, 3105 nt, Artificial Sequence
  derived and/or modified CDS sequence (opt5) from Clostridium histolyticum__BAA34542.1__ColH
augaacuuccugaagaucauucucaauagaggcaaaaccaugaagcggaaaugccugagcaagcgccuuaugcuggccaucacaauggcuacgauuuuuaccgugaacuccacacuccccaucuacgccgcggucgacaaaaauaacgcuaccgccgccguucagaaugagucuaagagauauacagugagcuaccugaagacccuuaacuauuacgaucugguggaccuccuggucaaaacagaaauugagaaucugccugaucucuuccaauauuccucugacgcuaaggaauuuuacgggaacaaaacccggaugagcuucaucauggaugagaucggacgcagagccccgcaguauacggaaauugaccacaagggcauccccacccugguggagguugugcgggcuggguuuuaccuuggauuccauaauaaagagcugaacgaaauuaauaagcgcuccuuuaaggagagagucaucccuucuauucucgccauccagaaaaaccccaauuucaagcugggcacagaagugcaggauaaaauuguuagcgcgaccgggcuucuggccggaaacgagacagcuccucccgagguggucaauaacuuuaccccuauccuccaagacuguaucaagaacauugaucgguacgcccuggacgaucugaaauccaaggcucucuucaaugugcuggccgcgccgacguaugacaucacagaauaccuucgcgccaccaaagagaagcccgaaaacacaccuugguauggcaagauugauggcuuuaucaaugagcugaaaaagcucgcucuguacgggaaaauuaacgacaauaacagcuggaucaucgacaauggaauuuaucacaucgcuccccuuggcaagcugcauucuaacaauaaaauugggaucgaaacccucaccgaggugaugaaggucuacccuuaucuguccaugcagcaccuucagagcgccgaucagauuaagagacauuacgacucuaaagaugccgagggaaacaagaucccccucgacaaauucaagaaagaaggcaaggagaaguacugcccgaaaacauauacguuugaugacgggaagguuaucauuaaagccggagcucggguggaagaggaaaaggugaaacgccuguacugggcguccaaggaggucaauagccaauucuucagaguguauggcaucgauaagccucuugaggaaggcaaccccgacgauauucugaccaugguuaucuacaauucuccugaggaauauaaacucaacuccgugcuguacggguaugacacaaauaacggaggcauguacauugagcccgaagggaccuuuuucacauacgagcgggaggcccaggaaagcaccuauacgcuugaggaacuguuucgccacgaguacacacacuaucuccagggaagauacgcuguccccggccagugggggcggaccaagcuguaugauaacgacagacugaccugguacgaggaaggaggcgccgaacucuucgccggcuccacacgcaccucugggauccugccucggaaaagcauuguguccaauauccauaacacaacgagaaauaaccgcuauaagcugagcgacaccguucacucuaaauacggagcuuccuuugaguucuacaauuaugccuguauguuuauggauuacauguauaacaaggacaugggcauccugaauaaacucaacgaucuggcgaagaauaacgacguggauggguacgacaauuauauucgggaucugagcucuaacuacgcucuuaaugacaaguaucaagaucauaugcaggagagaaucgacaacuacgaaaaucucacagucccguucguggccgaugacuaccugguccgccacgccuauaaaaaccccaacgagauuuacagcgagaucuccgaaguggcuaagcugaaagaugccaagucugagguuaaaaagagccaguauuuuuccaccuucacacuccggggaagcuacaccggcggggcuucuaagggcaaacuggaagaccaaaaggccaugaauaaauuuauugacgauucccuuaagaaacuggacacguauagcuggucuggauacaagacccucacagcguauuucaccaacuacaagguggauuccagcaauagagucacauacgacgugguuuuucacggcuaucugccuaacgagggggauuccaaaaauucucugcccuacggaaagaucaacggcaccuauaaagggacggaaaaggagaaaaucaaguucagcuccgagggaucuuucgacccugauggcaagauugugagcuacgaaugggacuuuggggauggcaauaaauccaacgaggaaaaucccgagcauagcuaugacaaggucggaacauacaccgugaaacuuaaggugacagaugacaaaggcgaaucuuccguuagcaccaccacagccgagaucaaggaucucucugagaacaaacugccggucauuuauaugcacgugccuaaguccggggcucugaaucagaagguggucuucuacggaaaaggcacguacgaccccgacgggagcaucgccggauaucagugggauuuuggcgacgggucugauuucagcuccgaacagaacccuagccauguguacaccaagaaaggcgaguauacaguuacccuccgcgugauggacucuuccggacaaaugagcgaaaagacaaugaaaauuaagaucaccgaucccgucuacccuaucggcacggagaaggagcccaauaacuccaaagaaacagcuucugggccgauugugccuggaauccccguuagcggcaccauugagaauaccuccgaccaggauuauuuuuacuucgacgugaucacacccggggaagucaagauugauaucaacaaacugggauauggcggggccaccugggugguuuacgacgagaacaauaacgcggugucuuacgccacagaugacggccagaaucuuagcggaaaguuuaaagcugacaagccuggccgguauuacauccaccuguauauguucaacggguccuacaugccguauagaauuaauaucgaaggaucugucggccgcuga

SEQ ID NO: 611 - RNA, 3066 nt, Artificial Sequence
  derived and/or modified CDS sequence (opt5) from Clostridium histolyticum__BAA34542.1__ColH
augaagagaaaaugccugagcaagcggcucaugcuggccaucaccauggcuacaauuuucacggugaacuccacccuucccaucuacgccgcggucgacaaaaauaacgcuacagccgccguucagaaugagucuaagcgcuauaccgugagcuaccugaaaacacucaacuauuacgaucugguggaccuucuggucaagaccgaaauugagaaucucccugaucuguuucaauauuccucugacgcuaaggaguucuacggcaacaaaacaagaaugagcuuuaucauggaugaaauugggcggcgcgccccgcaguauaccgaaaucgaccacaagggaauccccacgcugguggagguugugagagcuggcuucuaccucggguuucauaauaaagagcugaacgaaauuaauaagcgguccuucaaagagcgcgucaucccuucuauucuugccauccagaagaaccccaauuuuaagcugggaaccgaagugcaggauaaaauuguuagcgcgacaggccuccuggccgggaacgagaccgcuccucccgagguggucaauaacuucacaccuauccuucaagacuguauuaagaauaucgauagauacgcccuggacgaucucaaauccaaggcucuguuuaacgugcuggccgcgccgaccuaugacaucacggaauaccuccgggccacaaaagagaagcccgaaaacaccccuugguauggaaaaauugauggcuucaucaaugagcugaagaaacuugcucuguacggcaagauuaacgacaauaacagcuggaucauugacaaugggaucuaucacaucgcuccccucggaaagcugcauucuaacaauaaaauuggcaucgaaacacuuaccgaggugaugaaggucuacccuuaucuguccaugcagcaccuccagagcgccgaucagauuaaacgccauuacgacucuaaggaugccgaggggaacaagaucccccuggacaaauuuaagaaagaaggaaaggagaaauacugcccgaagaccuauacauucgaugacggcaagguuauuaucaaagccggggcuagaguggaagaggaaaaggugaaacggcuguacugggcguccaaggaggucaauagccaauuuuuccgcguguauggaaucgauaaaccucucgaggaaggcaaccccgacgauauucugacgaugguuaucuacaauucuccugaggaauauaaacuuaacuccgugcuguacggcuaugacaccaauaacgggggaauguacauugagcccgaaggcacauucuuuaccuacgagagagaggcccaggaaagcacauauacccucgaggaacuguuccggcacgaguacacgcacuaucuucaggggcgcuacgcuguccccggacaguggggcagaacaaagcuguaugauaaugaccggcucaccugguacgaggaagggggagccgagcuguuugccggcuccaccagaacaucuggcauccugccucgcaagagcauuguguccaacauccauaacaccacacggaauaacagauauaagcucagcgacacgguucacucuaaauacggggcuuccuucgaauuuuacaauuaugccuguauguucauggauuacauguauaacaaggacaugggcauucugaauaaacuuaacgaucuggcgaagaauaacgacguggauggauacgacaauuauauccgcgaucucagcucuaacuacgcucugaaugacaaauaucaagaucauaugcaggagcggaucgacaacuacgaaaaucugaccgucccguuuguggccgaugacuaccuugucagacacgccuauaagaaccccaaugagauuuacagcgagaucuccgaaguggcuaagcucaaagaugccaagucugagguuaaaaagagccaguauuucuccacauuuacccugcgcgggagcuacacaggaggcgcuucuaaagggaagcuggaagaccaaaaggccaugaacaaauucauugacgauucccucaagaaacuggacaccuauagcuggucuggcuacaagacgcuuaccgcguauuuuacaaacuacaaaguggauuccagcaaucgggucaccuacgacgugguuuuccacggauaucugccuaacgagggcgauuccaaaaauucucuccccuacgggaagaucaacggaacauauaagggcaccgaaaaggagaaaauuaaguuuagcuccgaggggucuuucgacccugauggaaaaaucgugagcuacgaaugggacuucggcgaugggaauaaguccaacgaggaaaaucccgagcauagcuaugacaaggucggcacguacacagugaaacugaaggugaccgaugacaaaggagaaucuuccguuagcacaaccaccgccgagaucaaggaucugucugagaacaaacuuccggucauuuauaugcacgugccuaaguccggcgcucucaaucagaaaguggucuuuuacgggaagggaacauacgaccccgacggcagcaucgccggguaucagugggauuucggagacggcucugauuuuagcuccgaacagaacccuagccauguguacacgaagaaaggggaguauaccguuacacugagagugauggacucuuccggccaaaugagcgaaaagaccaugaaaauuaagaucacagaucccgucuacccuauuggaaccgagaaagagcccaauaacuccaaggaaacggcuucuggcccgaucgugccugggauccccguuagcggaacaauugagaauaccuccgaccaggauuauuucuacuuugacgugaucacccccggcgaagucaagauugauaucaacaaacugggguauggaggcgccacaugggugguuuacgacgagaauaacaacgcggugucuuacgccaccgaugacgggcagaaucucagcggcaaguucaaagcugacaagccuggacgcuauuacauucaccuguauauguuuaacggcuccuacaugccguaucggaucaauaucgaagggucugucggaagauga

SEQ ID NO: 612 - RNA, 3000 nt, Artificial Sequence
  derived and/or modified CDS sequence (opt5) from Clostridium histolyticum__BAA34542.1__HsALB(1-18)_ColH(41-1021)
augaagugggugaccuucaucagccugcucuuucuguucuccucugccuacagcguccagaacgaguccaaaagauauacaguuucuuaccuuaagacgcugaauuauuacgaccucguggaucugcuugugaaaaccgaaauugagaaccugcccgaccucuuucaauauagcuccgaugcuaaggaguucuacggcaauaaaacacggaugucuuuuaucauggacgaaauugggcgcagagccccucaguauaccgaaaucgaucacaagggcauuccgacacuggucgaggugguucgggcgggauucuaccugggguuucauaacaaggagcucaaugaaaucaacaaacgcagcuucaaggagagagugauccccuccauucuggcuauccagaaaaauccuaacuuuaagcugggaaccgaaguccaggacaaaauugugagcgccacaggccugcucgccgggaaugagaccgcucccccugagguugugaacaauuucacgcccauccugcaagauugcauuaagaacaucgaccgguacgcccuugaugaccugaagucuaaagcucucuuuaauguccuggccgcgccuaccuaugauauuacagaauaccugcgcgccaccaaggagaaaccggaaaacacacccugguauggaaagaucgacggcuucaucaaugagcucaaaaagcuggcucuuuacggcaaaauuaacgauaacaauuccuggaucauugacaacgggaucuaucacauugccccucugggaaagcuccauagcaauaacaagaucggcaucgaaacccugacggaggugaugaaaguguaccccuaucuuucuaugcagcaccuucaguccgcugaccagauuaagagacauuacgauagcaaagacgccgaggggaauaagaucccucucgauaaauuuaagaaggaaggaaaagagaaguacugucccaaaacauauaccuucgacgauggcaaggucauuaucaaagcgggggcccggguugaagaggaaaaggugaagcgccuguacugggcuucuaaagaggugaacucccaauucuuuagagucuauggaauugacaagccgcuggaggaaggcaauccugaugacauccucacaauggugaucuacaacagccccgaggaauauaaacuuaauuccguucuuuacggcuaugauaccaacaaugggggaauguacauugagccugaaggcaccuucuuuacauacgagcgggaggcccaggaaucuacguauacccuggaggaacucuuccgccacgaguacacacacuaucugcaggggagauacgcugugcccggacaguggggccggaccaagcuguaugacaacgaucgccugacaugguacgaggaagggggagccgagcucuuugccggcagcaccagaacguccggcauccugccccggaaaagcauugucucuaauauccauaacacaaccagaaauaaccgcuauaagcuguccgacaccgugcacagcaaguacggggcuucuuucgaauuuuacaacuaugcgugcauguucauggacuacauguauaauaaagauaugggcauucucaacaagcugaaugaccuugccaaaaacaaugauguugacggauacgauaacuauauccgggaccugagcuccaauuacgcucucaacgauaaguaucaagaccauaugcaggagagaauugauaauuacgaaaaccugacagugccuuuugucgccgacgauuaccuggugcgccacgccuauaaaaauccgaacgagaucuacucugagaucagcgaagucgcuaaacuuaaggacgccaaguccgaggugaagaaaagccaguauuucucuaccuuuacacuccggggguccuacacgggaggcgcgagcaaggggaaacuggaagaucaaaaggcuaugaauaaauucauugacgacucucugaagaagcucgauaccuauuccuggagcggcuacaaaacacugaccgccuauuuuacaaacuacaagguugacuccucuaauagagugaccuacgaugucguguuccacggauaucuucccaacgagggcgacagcaaaaacucccugccuuacgggaagaucaauggaacguauaaaggcaccgaaaaggagaagauuaaauucucuagcgagggguccuuugaucccgacggaaagaucguuagcuacgaaugggauuucggcgacgggaacaaaucuaaugaggaaaacccugagcauuccuaugauaaggugggcacauacaccgucaaacucaaggugacagacgauaagggagaaagcucuguguccaccacgacagccgagauuaaagaccugagcgagaauaagcugcccguuaucuauaugcacgucccgaaaucuggcgcucuuaaccagaaggugguguuuuacgggaaaggaaccuacgauccugacggcagcaucgccggguaucagugggacuucggagauggcuccgacuuuagcucugaacagaaucccucccaugucuacacaaagaaaggggaguauaccgugacccuccgcguuauggauagcuccggccaaaugucugaaaagacaaugaagauuaaaaucacggacccuguguaccccauuggaaccgagaaggagccuaacaauagcaaagaaacagcuuccggccccaucgucccggggauuccugugucuggaaccaucgagaacacaagcgaucaggacuauuucuacuuugauguuaucacccccggcgaagugaagauugacaucaauaaacugggguauggaggcgccacgugggucguguacgaugagaacaauaacgcgguuuccuacgccacagacgaugggcagaaucugucuggcaaguucaaggcugacaaacccggacgguauuacauucaccucuauauguuuaacggcagcuacaugccuuauagaaucaacauugaaggguccgugggacgcuga

SEQ ID NO: 613 - RNA, 3138 nt, Artificial Sequence
  derived and/or modified CDS sequence (opt5) from Clostridium histolyticum__BAA34542.1__HsALB(1-18)_ColH(1-40)_CS-F_ColH(41-102 1)
augaagugggugaccuucaucagccugcucuuucuguucuccucugccuacagcaugaaaagaaagugccuuuccaaacggcugaugcucgcuauuacaauggccacgaucuuuaccgucaacucuacacugcccauuuaugcggcuguugacaagaauaacgccaccgccgcucgcagacggcgcaaaagagugcagaaugagagcaagcgguacacaguguccuaucuuaagacccugaacuacuaugaucucgucgaccugcuggugaaaacagaaaucgagaaucucccugaucuguuccaauacucuagcgacgccaaggaauuuuauggcaacaaaacccgcauguccuucauuauggaugagaucgggagacgggcuccgcaguacacggaaaucgaccacaagggcauucccacccuuguugaggugguccgcgccggauuuuaccugggguuccauaauaaagagcucaacgaaaucaauaagagauccuuuaaggagcgggugauuccuucuauccuggcgauucagaaaaaccccaauuucaaacuuggaacagaaguucaggauaagaucguguccgccaccggccugcucgcugggaacgagacagccccucccgaggucgugaauaacuuuaccccuauucugcaagacuguaucaagaauaucgaucgcuaugcucuggacgaucucaaaagcaaggcccuguucaacgugcuugcggccccgacguacgacauuacagaauaucugagagcuaccaaagagaagcccgaaaacacaccuugguacggaaagaucgauggcuuuauuaaugagcucaaaaagcuggcccuuuauggcaaaaucaacgacaauaacucuuggauuaucgacaaugggaucuaccacauugcuccccugggaaagcuccauuccaacaauaaaaucggcauugaaacccugaccgaggucaugaagguuuauccuuaccugagcaugcagcaccuccagucugccgaucagaucaagcggcauuacgacuccaaagaugccgaggggaacaagauuccccuggacaaauucaagaaagaaggaaaggagaaguauugcccgaaaacauacacguucgaugacggcaaggugaucaucaaagcuggggcgcgcguggaagaggaaaaggucaaaagacuuuauugggccagcaaggaggugaauagccaauuuuuccggguuuacggaauugauaagccucuggaggaaggcaaccccgacgauauccucaccauggugauuuauaauucuccugaggaauacaaacugaacagcguccuuuauggcuacgacacaaauaacgggggaauguacaucgagcccgaaggcaccuuuuucacauaugagagagaggcucaggaauccaccuacacgcuggaggaacucuuucgccacgaguauacacacuaccugcaggggcgguaugccgugcccggacaguggggcagaaccaagcuguacgauaaugaccgccucaccugguaugaggaagggggagccgagcuguucgcuggcagcacacggaccucuggcauucuuccuagaaaauccaucguuagcaacauucauaacacaacgcgcaauaaccgguacaagcugucugacaccgugcacagcaaauacggggccuccuuugaguucuauaauuacgcguguauguuuauggauuauauguacaacaaggacaugggaauccucaauaaacugaacgaucuggcuaagaauaacgacgucgauggcuaugacaauuacaucagagaucuuucuagcaacuaugcccucaaugacaaguaccaagaucauaugcaggaacgcauugacaacuacgaaaaucugacagugccguucgucgccgaugacuaucuggugcggcacgcuuacaaaaaccccaaugagaucuauuccgagauuagcgaaguugccaagcucaaagaugcuaagucugaggugaaaaagucccaguacuuuagcaccuucacacugagagggucuuauaccggaggcgccuccaaggggaaacuugaagaccaaaaggcgaugaacaaauuuaucgacgauagccugaagaaacucgacacguacuccuggucuggcuauaagacccugacagccuacuucaccaacuacaaggucgauagcuccaaucgcgugacauaugacguuguguuccacggauaccugccuaacgagggcgauucuaaaaauagccuucccuaugggaagauuaacggaaccuacaaaggcacggaaaaggagaaaaucaaguuuuccagcgaggggucuuucgacccugauggaaagaucgucuccuaugaaugggacuuuggcgaugggaauaaaagcaacgaggaaaaucccgagcauucuuacgacaaggugggcacauauaccgugaaacucaagguuacagaugacaaaggagaauccagcgucucuaccaccacagcugagauuaaggaucugagcgagaacaaacugccggugaucuacaugcacgugccuaaguccggcgcccucaaucagaaggucguguucuacgggaaaggaacguaugaccccgacggcagcauugcuggguaccagugggauuuuggagacggcucugauuucuccagcgaacagaacccuucccauguuuauaccaagaaaggggaguacacagugacccugcgggucauggacucuagcggccaaauguccgaaaagacaaugaaaaucaagauuaccgaucccguguauccuaucggaacggagaaggagcccaauaacucuaaagaaacagccagcggcccgaucguuccugggauucccguguccggaaccaucgagaauaccucugaccaggauuacuuuuauuucgacgucauuacacccggcgaagugaagaucgauauuaacaaacuuggguacggaggcgcgaccuggguuguguacgacgagaauaacaacgccgucagcuaugcuacagaugacgggcagaaucuguccggcaaguuuaaagccgacaagccuggaagauacuauauccaccucuacauguucaacggcagcuauaugccguaccggaucaauauugaagggucugugggacgcuga

SEQ ID NO: 614 - RNA, 576 nt, Artificial Sequence
  derived and/or modified CDS sequence (opt5) from Homo sapiens__NP_001133.1__HsAMELX
augggcaccuggauccuguucgccugccuccugggggcugccuuugcgaugccccuuccuccgcaccccggacauccuggcuacauuaacuucagcuaugaggugcugacaccccucaagugguaccaguccaucagaccucccuauccuucuuacggguaugaaccgaugggaggcuggcugcaccaucaaauuauccccguccuuagccagcagcacccucccacgcauacccugcagccucaccaccauauucccguugugccggcucaacagccugugaucccccagcagccuaugaugcccguccccgggcaacacuccaugacaccuauccagcaucaccagccgaaucugcccccucccgcccagcaaccuuaccagccccagccggugcaaccucagccccaccagccuaugcagccccaaccucccguucauccgaugcagccucucccuccccagcccccgcugcccccuauguuucccaugcagccucugcccccuaugcuccccgaccuuacccuggaggccuggccgucuacagauaaaaccaagcgggaagagguggacuga

SEQ ID NO: 615 - RNA, 135 nt, Artificial Sequence
  derived and/or modified CDS sequence (opt5) from Homo sapiens__NP_001133.1__HsAMELX-TRAP
augccccugccuccgcaccccggccauccuggguacaucaacuucagcuaugaggugcucaccccucugaagugguaccaguccauuagaccucccuaucccucuuacggauaugaaccgaugggcgggugguga

SEQ ID NO: 616 - RNA, 168 nt, Artificial Sequence
  derived and/or modified CDS sequence (opt5) from Homo sapiens__NP_001133.1__HsAMELX-LRAP
augccccugccuccgcaccccggccauccuggguacaucaacuucagcuaugaggugcucacaccccugaagugguaccaguccauuagaccucccccuaugcuuccggaccugacccucgaagccuggcccucuacggauaaaaccaagcgggaggaagucgacuga

SEQ ID NO: 617 - RNA, 207 nt, Artificial Sequence
  derived and/or modified CDS sequence (opt5) from Homo sapiens__NP_001133.1__HLA-A2-SP_HsAMELX(17-60)
auggccgugauggcucccagaacccugguccuccugcuuagcggcgcccuggcgcucacacagacgugggcuaugccucugccgccccacccugggcaucccggauacaucaacuucuccuaugagguucuuaccccucugaagugguaccaaucuauucggcccccuuauccgagcuacggcuaugaacccaugggagggugguga

SEQ ID NO: 618 - RNA, 240 nt, Artificial Sequence
  derived and/or modified CDS sequence (opt5) from Homo sapiens__NP_001133.1__HLA-A2-SP_HsAMELX(17-47,168-191)
auggccgugauggcucccagaacccugguccuccugcuuagcggcgcccuggcgcucacacagacgugggcuaugccucugccgccccacccugggcaucccggauacaucaacuucuccuaugagguucuuaccccucugaagugguaccaaucuauucggcccccuccgaugcuccccgaccugacacuggaagccuggccuagcaccgauaaaacaaagcgcgaggaaguggacuga

SEQ ID NO: 619 - RNA, 579 nt, Artificial Sequence
  derived and/or modified CDS sequence (opt5) from Homo sapiens__NP_001134.1__HsAMELY
augggcaccuggauccuguucgccugccucgugggggcugccuuugcgaugccccugccuccgcaccccggacauccuggcuacauuaacuucagcuaugagguccuuacaccccugaagugguaccaguccaugaucagaccucccuauucuagcuacggguaugaaccuaugggaggcuggcuccaccaucaaauuaucccgguugugucccagcagcacccccugacgcauacccuucagucucaccaccauauuccugugguccccgcucaacagccucgggugcgccagcaggcccugaugcccguuccggggcaacagagcaugacaccuacccagcaccaucagcccaaucucccucugcccgcccaacagcccuuucagccucaaccggugcagccccagccucaccagcccaugcaaccucagcccccgguccagccuaugcagccccugcucccucaacccccucugcccccgauguucccucuuagaccccugcccccuauccucccggaccugcaccuugaggcuuggcccgccacagauaaaaccaagcaggaagagguggacuga

SEQ ID NO: 620 - RNA, 138 nt, Artificial Sequence
  derived and/or modified CDS sequence (opt5) from Homo sapiens__NP_001134.1__HsAMELY-TRAP
augccccugccuccgcaccccggccauccuggguacaucaacuucagcuaugaggugcucaccccucugaagugguaccaguccaugauuagaccucccuauucuagcuacggauaugaacccaugggcgggugguga

SEQ ID NO: 621 - RNA, 171 nt, Artificial Sequence
  derived and/or modified CDS sequence (opt5) from Homo sapiens__NP_001134.1__HsAMELY-LRAP
augccccugccuccgcaccccggccauccuggguacaucaacuucagcuaugaggugcucacaccccugaagugguaccaguccaugauuagaccucccccuauccuuccggaccugcaccucgaagccuggcccgcuaccgauaaaacgaagcaagaggaagucgacuga

SEQ ID NO: 622 - RNA, 210 nt, Artificial Sequence
  derived and/or modified CDS sequence (opt5) from Homo sapiens__NP_001134.1__HLA-A2-SP_HsAMELY(17-61)
auggccgugauggcucccagaacccugguccuccugcuuagcggcgcccuggcgcucacacagacgugggcuaugccucugccgccccacccugggcaucccggauacaucaacuucuccuaugagguucuuaccccucugaagugguaccaaucuaugauucggcccccuuauagcuccuacggcuaugaaccgaugggagggugguga

SEQ ID NO: 623 - RNA, 243 nt, Artificial Sequence
  derived and/or modified CDS sequence (opt5) from Homo sapiens__NP_001134.1__HLA-A2-SP_HsAMELY(17-48,169-192)
auggccgugauggcucccagaacccugguccuccugcuuagcggcgcccuggcgcucacacagacgugggcuaugccucugccgccccacccugggcaucccggauacaucaacuucuccuaugagguucuuaccccucugaagugguaccaaucuaugauucggcccccuccgauccuccccgaccugcaccuggaagccuggccugccacagauaaaaccaagcaggaggaaguggacuga

SEQ ID NO: 624 - RNA, 570 nt, Artificial Sequence
  derived and/or modified CDS sequence (opt5) from Sus scrofa__NP_999071.1__SsAMELX-001-1
augggcaccuggauccuguucgccugccuccugggggcugccuuuagcaugccccuuccuccgcaccccggacauccuggcuacauuaacuucuccuaugaggugcugacaccccucaagugguaccagaauaugaucagacacccuuauacgucuuacggguaugaacccaugggaggcuggcugcaucaccaaauuaucccugucguuagccagcagaccccgcagucccaugcgcuucaaccccaccaccauauuccuauggugcccgcucagcagccugggaucccccagcaaccgaugaugccucugcccggacagcacucuaugacaccuacccagcaucaccagcccaaccucccccugccugcccaacagccguuucagccccaaccugugcagccccagccucaccagccccugcaaccgcagagcccuaugcaucccauccagccucuccugccccagccuccccuuccgccuauguucuccaugcaaucucugcuccccgaccugccccuugaggccuggccugcuacagauaaaaccaagcgggaagaggucgacuga

SEQ ID NO: 625 - RNA, 138 nt, Artificial Sequence
  derived and/or modified CDS sequence (opt5) from Sus scrofa__NP_999071.1__SsAMELX-TRAP
augccccugccuccgcaccccggccauccuggguacaucaacuucagcuaugaggugcucacaccccugaagugguaccagaauaugauuagacacccuuauaccuccuacggauaugaacccaugggcgggugguga

SEQ ID NO: 626 - RNA, 171 nt, Artificial Sequence
  derived and/or modified CDS sequence (opt5) from Sus scrofa__NP_999071.1__SsAMELX-LRAP
augccccugccuccgcaccccggccauccuggguacaucaacuucagcuaugaggugcucacaccccugaagugguaccagaauaugauuagacacccuucccuucugcccgaccucccucuggaagccuggccggcuaccgauaaaacgaagcgggaggaagucgacuga

SEQ ID NO: 627 - RNA, 210 nt, Artificial Sequence
  derived and/or modified CDS sequence (opt5) from Sus scrofa__NP_999071.1__HLA-A2-SP_SsAMEL(17-61)
auggccgugauggcucccagaacccugguccuccugcuuagcggcgcccuggcgcucacacagacgugggcuaugccucugccgccccacccugggcaucccggauacaucaacuucuccuaugagguucuuaccccucugaagugguaccaaaauaugauucggcaccccuauacaucuuacggcuaugaaccuaugggagggugguga

SEQ ID NO: 628 - RNA, 243 nt, Artificial Sequence
  derived and/or modified CDS sequence (opt5) from Sus scrofa__NP_999071.1__HLA-A2-SP_SsAMEL(17-49,167-189)
auggccgugauggcucccagaacccugguccuccugcuuagcggcgcccuggcgcucacacagacgugggcuaugccucugccgccccacccugggcaucccggauacaucaacuucuccuaugagguucuuaccccucugaagugguaccaaaauaugauucggcaccccucucuccugccugaccugccgcucgaagccuggcccgccacagauaaaaccaagcgcgaggaaguggacuga

SEQ ID NO: 629 - RNA, 534 nt, Artificial Sequence
  derived and/or modified CDS sequence (opt5) from Sus scrofa__P45561-2__SsAMELX-001-2
augggcaccuggauccuguucgccugccuccugggggcugccuuuagcaugccccuuccuccgcaccccggacauccuggcuacauuaacuucuccuauaucagacaccccuacacaucuuauggguacgagccuaugggaggcuggcugcaucaccagauuauccccguggucagccaacagacgccucagucccaugcgcuccagccgcaccaccauauucccaugguuccugcucaacagcccgggaucccucagcagcccaugaugccgcugccuggacaacacucuaugacccccacacagcaucaccagccuaaucuuccccugcccgcccagcaaccuuuucagccgcagcccgugcaaccucagccccaccagccucuccagccccaaagcccgaugcauccuauccagccccugcugccucagcccccucugcccccgauguucuccaugcagucucuccuuccugaccugccccucgaagccuggcccgcuaccgauaagacaaaacgggaggaaguggacuga

SEQ ID NO: 630 - RNA, 570 nt, Artificial Sequence
  derived and/or modified CDS sequence (opt5) from Sus scrofa__NP_998965.1__SsAMELX-001-3
augggcaccuggaucuucuuugccugccugcucggggcuagccuggccaugccccuuccuccgcaccccggacauccuggcuacauuaacuucuccuaugaggugcugacaccccucaagugguaccagaauaugaucagacacccuuauacgucuuacggguaugaacccaugggaggcuggcugcaucaccaaauuaucccugucguuagccagcagaccccgcagucccaugcgcuucaaccccaccaccauauuccuauggugcccgcucagcagccugggaucccccagcaaccgaugaugccucugcccggacagcacucuaugacaccuacccagcaucaccagcccaaccucccccugccugcccaacagccguuucagccccaaccugugcagccccagccucaccagccccugcaaccgcagagcccuaugcaucccauccagccucuccugccccagccuccccuuccgccuauguucuccaugcaaucucugcuccccgaccugccccuugaggccuggccugcuacagauaaaaccaagcgggaagaggucgacuga

SEQ ID NO: 631 - RNA, 219 nt, Artificial Sequence
  derived and/or modified CDS sequence (opt5) from Sus scrofa__K7GPB2__SsAMELX-002
augggcaccuggauccuguucgccugccuccugggggcugccuuuagcaugccccuuccuccgcaccccggacauccuggcuacauuaacuucuccuaugaggugcugacaccccucaagugguaccagaauaugaucagacacccuucucugcuucccgaccugccucucgaagcguggccggcuacggauaaaaccaagcgggaggaagucgacuga

SEQ ID NO: 632 - RNA, 612 nt, Artificial Sequence
  derived and/or modified CDS sequence (opt5) from Sus scrofa__K7GLD0__SsAMELX-003
augggcaccuggauccuguucgccugccuccugggggcugccuuuagcaugccccuuccuccgcaccccggacauccuggcuacauuaacuucuccuaugaggaccuguaccucgaagcgaucagaauugaucggacagcuuuugugcugacgccccuuaagugguaucagaauaugauccgccacccuuacaccucuuauggguacgagcccaugggaggcuggcugcaucaccaaauuaucccugucguuagccagcagacaccgcagucccaugcccuccaaccccaccaccauaucccuauggugcccgcccagcagccugggauuccccagcaaccgaugaugccucugcccggacagcacucuaugaccccuacacagcaucaccagcccaaccugccccucccugcucaacagccguuccagccccaaccugugcagccccagccucaccagccccugcaaccgcagagcccuaugcaucccauccagccucuucugccccagccuccccucccgccuauguuuuccaugcaaucucugcuucccgaccugccccucgaagccuggccugcuaccgauaaaacaaagagagaggaagucgacuga

SEQ ID NO: 633 - RNA, 498 nt, Artificial Sequence
  derived and/or modified CDS sequence (opt5) from Sus scrofa__K7GPE9__SsAMELX-004
augggcaccuggauccuguucgccugccuccugggggcugccuuuagcaugccccuuccuccgcaccccggacauccuggcuacauuaacuucuccuaugaggugcugacaccccucaagugguaccagaauaugaucagacacccuacgccccaaucucaugcgcugcagccucaccaucacauuccgaugguccccgcucagcagccugggaucccccaacagccuaugaugccccuuccgggacagcacagcaugaccccuacacagcaucaccaacccaaccugccucuccccgcccagcagcccuuucagccucaaccgguucagccccagccucaucaaccccugcagccucagucccccaugcacccgauucagccucugcucccccaaccuccccugccucccauguucucuaugcagagccuucugccggaccucccucuggaagccuggcccgcuaccgauaaaacaaagcgggaggaaguggacuga

SEQ ID NO: 634 - RNA, 522 nt, Artificial Sequence
  derived and/or modified CDS sequence (opt5) from Sus scrofa__J9JIM4__SsAMELX-201
augccccugccuccgcaccccggccauccuggguacaucaacuucagcuaugaggugcucacaccccugaagugguaccagaauaugauuagacacccuuauaccuccuacggauaugaacccaugggcggguggcuucaucaccaaaucauuccugucguuucucagcagacgccgcagagccaugcccugcaaccccaccaccauaucccuauggugcccgcucagcagccuggcauuccccagcaaccgaugaugccucuccccggacagcacuccaugaccccuacacagcaucaccagcccaaccugccccuuccugcccaacagccguuucagccccaaccugugcagccccagccucaccagccccugcaaccgcagucuccuaugcaucccauccagccucuccugccccagccuccccugccgccuauguucagcaugcaaucccuccugcccgaccuuccccuggaggcguggccugcuaccgauaaaacaaagcgggaagaggucgacuga

SEQ ID NO: 635 - RNA, 2961 nt, Artificial Sequence
  derived and/or modified CDS sequence (opt5) from Homo sapiens__NP_006120.1__HsBMP1
augcccggcguggccagacugccucuccugcuugggcugcuccugcuuccgcggcccggacgcccucuggaccucgcugauuacaccuaugaccuggccgaggaagaugacagcgagccccugaacuacaaggauccuugcaaagcggcugccuuccucggcgacaucgcccuggaugaagaggaccuuagagcuuuucagguccaacaggccguugaucugcggcgccacacagcuagaaaguccucuauuaaagccgcggugcccgggaauacgagcaccccuuccugucagucuacaaacggacagccgcaacggggcgccugcgggcgcuggagaggacggagccgcuccagacgggcugccaccucucgccccgaaagaguguggccugacggcgucauccccuucgugauuggcgggaauuuuacaggaagccagcgggcuguuuuccgccaggccaugagacauugggagaagcacaccugugugacauuucucgagcggaccgaugaagacuccuauaucgucuucacguacagaccuugcggcuguugcagcuauguggggcgccggggaggcgggccccaggcgauuucuaucggaaagaacugugauaaguuuggcaucguugugcaugagcugggccacgucgugggguucuggcaugaacacaccagaccggaccgcgaccggcacguguccauugucagagagaauauccaaccuggacaggaguacaacuuucuuaagauggaaccccaggagguugaaagccugggcgagacauaugauuucgacucuauuaugcauuacgcccgcaauaccuuuucccgggggaucuuccucgauacaauugugccuaaauacgaagugaacggagucaagccucccaucggccagagaacccgccugagcaaaggggacauugcucaagcccggaagcuguauaaaugccccgcuuguggagagacgcuccaggauucuacaggcaauuuuuccagcccggaguaccccaacggcuauuccgcccacaugcauugcguguggagaaucucuguuaccccuggggaaaagaucauucugaauuucacaagccuugaccuguaccgcucccggcucuguugguaugauuacguggaggucagagacggauucuggcggaaggcuccccugcgcggcagauuuugcgggagcaaacuuccugaacccaucgugucuaccgauucccggcuguggguugaguucagaagcucuagcaacugggugggaaagggcuuuuucgccgucuaugaagcgauuugcgggggcgacgugaaaaaggauuacggacacauccaguccccgaauuacccugacgacuaucgccccucuaaagucuguauuuggcggauccaagugagcgagggcuuucacguugggcucaccuuccaguccuuugagaucgaaagacaugauagcugcgccuacgacuaucuggaggugcgcgauggacacucugaauccagcacacugauuggcagauacuguggguaugagaagccugacgauaucaaaucuacguccagccggcucuggcugaaguucgucuccgacggaucuauuaacaaggcuggcuuugccgugaauuucuuuaaagaaguugaugagugcagccgccccaacagagggggcugugagcagcggugccuuaacacccugggauccuacaaguguucuugcgacccuggcuaugaacucgcccccgauaaacgcagaugugaggcugccugcgggggauuccugacaaaacuuaauggcagcaucaccuccccgggguggccuaaagaauacccucccaacaagaauuguauuuggcagcugguggcgcccacacaauaccggaucagccuccaguuugacuucuucgagaccgagggaaacgaugucugcaaguaugacuuuguggaagugcgcucuggccugacggcugauuccaaacugcaugggaaguucugcggcagcgagaaaccggaaguuaucacaucucaguacaauaacaugagagucgaguuuaaguccgacaauaccgugagcaaaaagggauucaaggcccacuuuuucucugacaaagaugaauguagcaaggacaacggcgggugccagcaagauugugugaauaccuuuggauccuaugagugccagugucggagcggcuucguccuccaugacaacaaacacgauugcaaggaggccgggugugaccacaaagugacaucuaccuccggaacaauuacgagccccaauuggccugauaaguaccccuccaagaaagaaugcaccugggcuaucucuagcacaccuggccaucgcguuaagcugaccuuuauggagauggacauugaaucccagcccgagugugccuaugaucaccuugaaguguucgacgggagagaugcuaaagccccuguccugggccgguuuugcggaucuaagaaacccgagccggugcucgcgacaggcagcagaauguuccugcgcuuuuacuccgacaacucuguucagcggaagggguuccaagccagccaugcuaccgaguguggaggccaggugagagccgaugucaaaacgaaggaccuguauucccacgcucaguucggggacaauaacuacccuggaggcguggauugcgaauggguuaucguggccgaggaaggcuacggggucgagcuuguguuucagaccuucgaaguggaggaggaaacagacugcggauaugauuacauggagcucuuugacggcuaugauagcaccgcgccccgccuggggcgguacuguggaucuggcccucccgaagaggucuauuccgccggggacagcguucuggugaaguuccacucugaugacacaauuaccaaaaagggauuucaucucagauacacguccacaaaauuccaagauacccugcacagccgcaaguga

SEQ ID NO: 636 - RNA, 1191 nt, Artificial Sequence
  derived and/or modified CDS sequence (opt5) from Homo sapiens__NP_001191.1__HsBMP2
augguggccggcaccagaugccugcucgcucugcuucugccccagguccuccuugggggagccgcgggccugguuccugagcuggggcggcgcaaguucgcugccgccagcuccggaagaccgucuagccaacccuccgacgaagugcucucugaguuugaacugcggcugcucagcauguucggccugaaacagcgcccuacacccuccagagaugcuguggucccucccuacaugcuugaccuguaucggcgccacucugggcagccuggaagcccggcccccgaucauagacucgagcgggcugccucccgcgcgaacacggugagaucuuuucaccaugaagagucucuggaggaacuuccugagaccuccggcaagacaacccggcgcuucuuuuucaaucugagcucuauccccacagaagaguuuauuaccuccgccgagcuccagguuuucagagaacaaaugcaggacgcucugggcaacaauagcucuuuucaccaucggaucaacauuuacgagaucauuaaaccugccacagcuaauuccaaguuccccgugacccgccugcucgauacgagacuggucaaccagaaugccagccggugggaauccuuugacgugaccccggcgguuaugagauggacagcccaggggcacgcuaaccacggauucguggucgagguggcccaucuugaagagaaacaaggcgugucuaagcgccacguccggaucagcagaucccugcaucaggaugagcacagcuggucucagauccgcccucuccugguuaccuuugggcacgacggaaagggccauccccuucacaaacgggaaaagagacaggcuaaacauaagcaacgcaaacggcugaaguccagcuguaagagacacccucucuauguggauuucucugacgugggguggaaugauuggauugucgccccucccggauaccaugccuucuauugccacggcgagugucccuuuccgcuggcugaccaccugaacagcacaaaucaugcgaucgugcagacccucguuaacuccgugaauagcaaaauucccaaggccugcugugucccuacggaacugagcgcuaucuccaugcuuuaccuggaugagaacgaaaaagugguucucaagaauuaucaggacaugguggucgagggcugcgggugucgcuga

SEQ ID NO: 637 - RNA, 1227 nt, Artificial Sequence
  derived and/or modified CDS sequence (opt5) from Homo sapiens__NP_001193.2__HsBMP4
augauccccggcaacagaaugcugauggugguccuccugugccagguucuucucgggggagccagccacgcuucccugauuccugagaccggcaagaaaaagguggccgaaauccaagggcaugcgggaggccggcgcucugggcagagccacgagcugcuuagagacuucgaagcuacacugcuccagauguuuggacugcggcgcagaccgcagcccuccaaaucugccgugauuccugauuacaugcgggaccuguaucgccuccaaagcggcgaggaagaggaggaacagauccauuccacgggccuggaguaccccgaaagaccugccucucgggcuaauaccguccgcagcuuccaccaugaggagcaccuugaaaacauucccgggacauccgagaauagcgccuuuagauuccuguuuaaccucucuuccaucccugaaaaugaggugaucagcucugcugaacugcggcuuuuccgcgagcagguugaucagggaccggacugggagagaggcuuucaccggauuaacaucuaugaagugaugaagcccccugccgaggucgugcccgggcaucugauuacccgccuccuggauacaagacugguucaccauaaugugacccggugggaaacauucgacgucuccccugcggugcucagauggacccgcgagaaacaacccaacuacggacuggccaucgaagugacgcaccuucaccagacccggacacaucagggccagcacgucagaauuagccgcucucugccgcaaggguccggaaauugggcucagcuccggccucugcuuguuaccuuuggccaugauggcagagggcacgcccugacacgccggagacgcgcuaagcggagccccaagcaucacucccagagagcccgcaaaaagaacaaaaauugucggagacacucucucuauguggacuucagcgaugugggauggaacgacuggaucgucgcgccucccggcuaccaagccuuuuauugccauggggauugucccuucccucuggcugaccaccucaauuccaccaaccaugccauugugcagacgcugguuaauagcgugaacucuuccaucccgaaggcuugcuguguccccacagagcugagcgccaucucuaugcuuuaccuggaugaguacgacaaagugguucucaagaacuaucaggaaaugguggucgagggaugcggcugucgguga

SEQ ID NO: 638 - RNA, 1542 nt, Artificial Sequence
  derived and/or modified CDS sequence (opt5) from Homo sapiens__NP_001709.1__HsBMP6
augcccggccuggggagacgggcccaguggcucugcuggugguggggacugcuuuguagcugcuguggcccuccgccccugcgcccuccccucccugcugccgcggcugccgccgcugggggacaacugcuuggcgacgggggaucccccggcagaaccgagcagccuccgcccucuccucagagcuccucuggcuuccuguaccggcgccucaagacacaggagaaaagagaaaugcaaaaggaaauccugagcgugcuggggcucccccaccggccucgcccccugcauggacuucagcagccgcagccucccgcccugagacaacaggaggaacagcagcaacagcagcaacucccucggggcgagcccccucccgggcgccugaaauccgcuccgcuuuuuaugcuggaucucuauaacgcccugucugcggacaaugaugaggacggagccagcgaaggcgagagacagcaguccuggccccacgaagcugccuccucuucccagcggcgccaaccucccccuggggcugcccauccccugaacagaaagagccuccuggcgccgggaucuggcuccggcggggccagcccucuuacgucugcucaggauuccgccuuccugaaugacgcugauauggucaugagcuuuguuaaccucguggaguacgacaaagaguucagcccccggcagcgccaccauaaggaauuuaaguucaaucugucucagauuccugagggagaaguggucaccgccgccgaguuuagaaucuauaaagauugcgugaugggcagcuucaagaaccaaacauuucuuauuuccaucuaccagguucugcaggaacaccagcaccgggacagcgaucucuuccugcuggacaccagaguggucugggcuucugaggagggguggcucgaauuugauauuacagcgaccuccaaucugugggugguuacaccccaacauaacaugggacuucagcugagcguggucacccgcgacggcgugcacgugcauccucgggccgcugggcucgucggaagagacggccccuaugauaaacagccguucaugguugccuuuuucaaggugucugaggugcacguccgcacgacccggagcgccuccucuagacgccggcagcaaagcagaaaucgcuccacacagagccaggacguggcucggguuucuuccgccagcgauuacaacucuuccgaacugaaaaccgcguguagaaagcacgagcuuuaugugagcuuccaagaccugggcuggcaggauuggaucaucgcuccuaagggguacgccgccaauuacugcgacggagaauguuccuuuccccucaacgcucauaugaaugccacaaaccacgcuauuguccagacccuggugcaucugaugaaucccgaguauguuccuaaaccgugcugugcccccacgaagcucaacgcgaucucugugcuguacuucgaugacaacagcaaugucauucuuaaaaaguaucgcaacauggugguccgggccugcggcugucacuga

SEQ ID NO: 639 - RNA, 1296 nt, Artificial Sequence
  derived and/or modified CDS sequence (opt5) from Homo sapiens__NP_001710.1__HsBMP7
augcacgugagaagccugcgggccgcugcuccccauuccuucgucgcgcucugggcuccucuguuucuucugcgcucugcccucgccgacuucagccuggauaacgagguucacuccucuuuuauccauagacggcuucgcagccaggaaagacgggagaugcaacgcgaaauucuguccauccucggccugccgcacagaccccggccucaucugcaggggaagcacaauucugcucccauguucaugcucgaccuguacaacgccauggcuguggaggaaggaggcgggccuggaggccagggguuuagcuaucccuacaaagccguguucuccacccagggaccuccgcuugcgagccugcaagauucucacuuucucacagacgccgauauggucauguccuucgugaaucugguugagcaugacaaggaguuuuuccacccccgcuaucaucacagagaauuucgguucgaucuuagcaaaauuccugagggcgaagcugugacggccgcugaguuucgcaucuacaaggacuauauuagagagcgguucgauaacgaaaccuuccgcaucucugucuaccaggugcugcaggagcaccucggcagagaauccgaccuguuucugcucgauagccggacacugugggccucugaggaaggguggcuuguuuucgacaucaccgcgacauccaaucauuggguggucaaccccagacacaaucugggacuccagcugagcguggagacccuugauggccaauccauuaacccuaaacuggccgggcucaucggacgccauggcccccagaauaagcagccguuuaugguggcuuucuuuaaggccacagagguccacuuccggucuauuagaagcaccggguccaaacagcgcagccaaaaccggucuaagacgccuaaaaaucaggaagcucugagaauggccaacguugccgaaaauuccagcucugaccagcgccaagccugcaagaaacaugagcuguaugugagcuuucgggaccucggauggcaggauuggaucauugcgcccgagggcuacgccgcuuacuauugugaaggcgagugcgccuucccucugaacuccuacaugaaugccaccaaccacgcuaucgugcagacacuuguccacuuuauuaaccccgagaccgugcccaagccuuguugcgccccgacacagcugaaugcgaucucuguucucuauuucgacgauagcuccaacgugauccugaagaaauacagaaauauggucgugcgcgcuugugggugccauuga

SEQ ID NO: 640 - RNA, 300 nt, Artificial Sequence
  derived and/or modified CDS sequence (opt5) from Homo sapiens__NP_006264.2__HsCCL7
augaaggccagcgcugcccugcucugccugcuucugaccgcggcugccuucucuccccagggccucgcccaaccuguggggaucaacacauccacgaccuguugcuacagauuuauuaauaaaaagaucccgaaacagcggcuggagagcuaucgcagaacaaccuccucucacuguccccgggaagcugucauuuucaagacaaaacuugacaaggagaucugcgccgauccuacccagaaguggguucaggacuuuaugaaacaucuggauaagaaaacacaaacccccaagcucuga

SEQ ID NO: 641 - RNA, 3624 nt, Artificial Sequence
  derived and/or modified CDS sequence (opt5) from Homo sapiens__NP_001954.2__HsEGF
augcugcucacccugaucauucuucugcccguggucagcaaguucuccuuuguuucucucagcgccccucagcacugguccugcccggagggcacacuggcugggaacggaaauucuacgugugugggccccgccccuuuccuuaucuuuagccaugggaacuccauuuucagaaucgacaccgaaggaacaaauuacgagcaacugguggucgaugcgggcgugucuguuauuauggacuuucacuauaacgaaaaacggaucuacuggguggaucucgagcgccagcugcugcagagagucuuccucaaugggagccggcaggaacgcgugugcaacaucgagaagaauguuuccggaauggcuauuaacuggaucaaugaggaagugauuuggagcaaccaacaggagggcaucauuaccgucacagacaugaaaggcaauaacucucauauccugcuuuccgcccugaaguaucccgccaauguggcuguggauccugucgaaagauuuauuuucuggagcucugagguugccgggucccucuaccgggcugaccuggauggagugggcgugaaagcccuucuggagaccagcgaaaagaucacagcggucucucucgacgugcuggauaagcgccuguuuuggauccaguauaacagagagggguccaauagccucauuuguuccugcgacuacgauggaggcucuguucacaucagcaaacaucccacccagcacaaccuguucgccaugucccuuuuuggggaccggauuuucuauagcacguggaagaugaaaaccaucuggauugcuaacaagcacacaggaaaagauauggugcgcaucaaucugcauucuuccuuugucccucucggcgaacugaaggugguucacccgcuugcccaacccaaggcugaggacgacaccugggaaccugagcagaaacuguguaagcucagaaaaggcaacugcagcucuacagugugugggcaggaucugcagagccaucugugcaugugugccgagggauacgcgcucucccgggaccgcaaguacugcgaagaugucaaugagugugccuucuggaaccacggcugcacccuggggugcaaaaauacgcccggaucuuauuacuguacaugcccugugggcuucguccuucugcccgacgggaagagaugucaccaacucgugagcugcccgcggaacguuuccgaauguagccaugauugcgugcugaccucugagggaccucuuuguuuuugccccgaaggcuccguccuggagcgcgacggcaaaacauguagcggguguucuuccccugauaauggaggcugcagccagcucugcgugccccugucccccguuucuugggagugcgacuguuucccuggguaugaucugcagcucgacgaaaagagcugcgcugccuccggaccgcaacccuuucugcuuuucgcuaacucucaggauaucagacacaugcauuuugacggcaccgacuacgggacccugcucagccagcagaugggcaugguguaugcccuggaucacgacccugucgagaauaagauuuacuucgcccauacagcucugaaauggaucgaacgggcgaacauggauggaucccaaagagagcgccuuauugaagagggcguggacgugcccgaggggcucgccguugauuggaucggacggagauuuuauuggacggaccgcggcaagagccugauugggcggucugaucugaauggaaaaagauccaagaucaucaccaaagaaaacauuagccagccucgcggcaucgcuguccaccccauggccaagcggcuuuucuggacagacaccgggauuaauccgagaaucgagucuuccagccugcagggccuuggacgccuggugauugccucuagcgaucucaucuggccuuccggcauuacaaucgacuuucugaccgauaagcuguacuggugugacgcuaaacagagcgugaucgaaauggccaaccuugaugggucuaagcggagacgccucacgcaaaaugacgucggacaccccuucgcgguggcuguuuuugaggacuacgugugguucuccgauugggccaugccuagcgucaugcgggugaacaaaagaacaggcaaggaccggguucgccugcagggguccaugcugaaacccucuagccucguggucgugcauccucuggccaagcccggagcugauccgugccuuuaucagaacggcgggugugagcacauuugcaagaaaagacugggcaccgccugguguuccugccgggaaggauuuaugaaggcuucugacggcaaaaccugucucgcccuggaugggcaucagcugcuugcgggaggcgagguugaccucaagaaucaagugacaccucuggauauccugagcaaaaccagagucuccgaagacaacauuacagagucucagcacaugcucguggccgaaaucauggugagcgaucaggacgauugcgcucccgucggguguuccauguacgcccgcugcauuagcgagggagaggacgcuacgugccagugucugaagggcuucgccggggauggcaagcucugcucugacaucgacgaaugugagaugggaguucccgugugcccuccggcguccagcaaauguaucaauaccgaaggcggguaugugugccgguguucugagggauaccaaggcgaugggauucacugccuggacaucgaugaaugucagcucggagagcauuccugcggcgagaacgccagcuguacaaauaccgaaggcggguauacaugcaugugcgcuggaagacugucugagcccggccugauuuguccugacuccacgcccccuccccaccuucgcgaagaugaccaucacuacagcgucagaaacuccgauagcgagugcccucucucucaugacggguauugucugcacgauggagugugcauguacaucgaagcccuggacaaguacgcuuguaauugcguugugggcuauauuggggagcggugucaguaccgcgaucucaaauggugggagcugagacacgccggacauggccaacagcagaaggucaucgugguugccgugugcgucgugguucuugugaugcugcuccugcugagccuuuggggcgcucacuauuaccggacccagaaacugcucuccaagaaccccaaaaauccguaugaagagucuagccgcgacgucagaucccggcgcccugcggacaccgaagaugggaugucuagcuguccccaaccuugguucguggugaucaaggagcaucaggaccugaagaacggaggccagcccgucgccggggaggauggacaggcugccgacggcuccaugcaaccgacaucuuggagacaggaaccucagcucugcgggaugggaaccgagcagggcuguuggauucccguuagcuccgauaaaggcagcugcccucaagugauggaacggucuuuucacaugcccuccuacgggacacagacccuggagggaggcguggaaaagccccauagccuucugucugccaauccucucuggcagcaacgcgcucuggacccgccccaccagauggagcugacgcaguga

SEQ ID NO: 642 - RNA, 510 nt, Artificial Sequence
  derived and/or modified CDS sequence (opt5) from Homo sapiens__NP_001423.1__HsEREG
augaccgccggcagacggauggagaugcugugcgcugggcgcgugcccgcccuccugcuuugucugggauuccaccuccugcaggcgguccuuagcacaacgguuaucccuuccugcauuccgggcgaaucuagcgacaacuguaccgcucuggugcaaacagaggauaaucccagaguggcccaggucuccaucaccaagugcucuagcgacaugaacggguacugucuccauggacagugcauuuaucugguggauaugucccagaauuacugucggugcgaaguuggcuauacaggggugcgcugugagcacuuuuuccugaccguccaucaaccucucucuaaagaauacguggcccugacaguuauccuuauuauccuguuucucaucaccguggucggaagcacguauuacuucugcagaugguaucggaaccgcaaguccaaagagcccaagaaagaguacgaaagagugaccagcggcgacccugagcugccccagguguga

SEQ ID NO: 643 - RNA, 468 nt, Artificial Sequence
  derived and/or modified CDS sequence (opt5) from Homo sapiens__NP_000791.1__HsFGF1
auggccgagggcgaaaucaccacauucacggcucugaccgagaaguuuaaccugcccccugggaauuacaaaaagccgaaacuccuuuauugcagcaacggaggccacuuccugcggauucuccccgacgggacaguggauggaaccagagaccgcuccgaucagcauauccaacugcagcuuucugccgaaagcgucggcgagguuuacauuaaguccacagaaaccgggcaguaucuggcgauggacacagauggacuccuguacggcucucagaccccuaaugaggagugucuguuucucgaaagacuggaggaaaaccacuauaauacguacaucagcaaaaagcaugcugagaagaacugguucgugggccuuaaaaagaauggguccugcaaacggggaccccgcacccacuauggccaaaaggccauucuguuucucccucugcccgugucuagcgacuga

SEQ ID NO: 644 - RNA, 867 nt, Artificial Sequence
  derived and/or modified CDS sequence (opt5) from Homo sapiens__NP_001997.5__HsFGF2
auggugggcgucgggggaggcgacguugaggaugugacccccagaccugggggaugccagaucagcggccgcggggcccggggauguaacggcauuccgggcgcugccgcgugggaagcugcccugcccagacggcgcccuagacggcaccccuccgugaauccucgcucuagagccgcugggagcccccggacacgcggaagacggacggaggaacgcccuuccggcucuagacucggggaccggggacgcggcagagcccugcccgggggacggcuuggcggcagagggcgcggacgggcucccgagagagucggcgggcgcggacggggcagagggaccgccgcgccucgcgccgcucccgccgcucggggaagcagaccuggccccgccggcacaauggcggccggguccaucaccacacugccggcucucccugaagauggaggcucuggggccuucccgccuggacauuuuaaggaccccaaacgccuguacugcaagaacggcggguucuuucuucggauucaccccgauggcagaguggacggaguucgcgagaaaagcgauccucauaucaagcugcaacuccaggcugaggaacggggcguggucuccauuaaaggggugugugccaauagauaucuggccaugaaggaggacggacggcugcucgcuagcaagugcguuaccgaugaauguuucuuuuucgagcgccuggagucuaacaauuacaacacauauagaucccggaaauacaccagcugguauguggcgcuuaagagaacgggccaguacaaacuggggucuaagaccggaccgggccagaaagccauccucuuucugcccauguccgcuaagagcuga

SEQ ID NO: 645 - RNA, 585 nt, Artificial Sequence
  derived and/or modified CDS sequence (opt5) from Homo sapiens__NP_002000.1__HsFGF7
augcacaaguggauccugaccuggauucuccccacacugcuuuacagaagcugcuuccauaucauuugucuggugggcacgaucucccucgccugcaacgacaugaccccugagcagauggcuacaaaugucaacuguucuagcccggaacggcacacccgcuccuaugauuacauggaagggggagacauuagaguucggcgccuguuuugcagaacacaaugguaucuucggaucgauaaacgcggcaaggugaaagggacccaggagaugaagaauaacuacaauaucauggagauuagaacaguggccgucggaaucguggcgauuaaaggcguugaaucugaguucuaucuggcuaugaacaaggaggggaagcucuacgccaaaaaggaauguaaugaggacugcaacuuuaaagaacugauccuggagaaucauuauaacaccuacgccagcgcuaaguggacgcacaauggaggcgagauguucguggcccucaaccagaaaggcauucccguccgggggaagaagaccaaaaaggaacagaaaacagcucauuuucugccuauggccaucaccuga

SEQ ID NO: 646 - RNA, 627 nt, Artificial Sequence
  derived and/or modified CDS sequence (opt5) from Homo sapiens__NP_001936.1__HsHBEGF
augaagcugcuccccagcgugguccugaaacuuuuccuggccgcuguucucuccgcccuggugaccggcgagucucuugaaagacugcggcgcgggcucgcggcuggaacaagcaacccugacccgcccacgguguccaccgaucagcugcugccucucggcgggggaagagaccggaagguccgcgaucugcaagaggccgaccuugaucugcucagagugacacugucuagcaaaccccaggcccuugcuaccccuaauaaggaggaacacggcaaacggaagaagaaagggaagggacugggcaaaaagcgcgaccccugccucagaaaauacaaggauuuuuguauccauggcgaaugcaaguauguuaaagagcugcgggccccuuccuguauuugccacccgggguaccauggagagcgcugucacggccugucucuccccguggaaaacagacuguauacauacgaccauaccacaauccuugcugucguggccguugugcugagcuccgucugccuccuggugauuguggggcuucugauguuccgguaucaccgcagaggaggcuacgaugucgagaaugaagagaagguuaaacucgggaugaccaacagccacuga

SEQ ID NO: 647 - RNA, 2187 nt, Artificial Sequence
  derived and/or modified CDS sequence (opt5) from Homo sapiens__NP_000592.3__HsHGF
augugggugaccaagcugcuccccgcccugcuucugcagcacguccuccugcaucuucugcuccugccuaucgcuauuccguacgccgagggccaaagaaaacggcgcaacacaauccacgaguucaagaaaagcgcgaagacgacccugauuaaaaucgaccccgcucucaagauuaagaccaaaaagguuaauaccgccgaucagugcgccaacagauguacacggaauaaagggcugccuuuuaccugcaaggcuuucguguuugacaaagcccgcaagcagugucuuugguuccccuuuaacuccaugucuagcggagugaagaaagaguucggccaugaauuugaucuguaugagaauaaggacuacaucagaaacugcaucauugggaaaggacgguccuauaagggcacagucucuaucaccaaaagcgggauuaagugucagccuugguccucuaugaucccccacgaacauagcuuccucccuuccagcuaccgcggaaaagaucugcaagagaauuauugcagaaacccgcggggcgaggaaggcgggcccugguguuuuacgucuaauccugaggugcgcuacgaaguuugcgacauuccccaguguuccgagguggagugcaugaccuguaacggagaaagcuauagaggccuuauggaucacacagagucugggaagaucugccagcggugggaccaccagaccccucaucgccacaaguuccugcccgaaagauacccggauaaaggauuugacgauaauuacugccggaacccugacggccaaccccgcccuugguguuauacacucgauccccauacaagaugggaauacugcgcuauuaagacgugugccgacaauacaaugaacgacaccgaugucccccuggaaacaaccgagugcauccaggggcagggagagggcuaucggggcaccgugaauacaaucuggaacgggauuccuugucagagaugggacucccaauacccgcacgaacacgauaugacgcccgagaacuucaaaugcaaggaccugcgcgaaaauuauugucggaacccugauggaagcgagucucccuggugcuuuaccacagacccuaauaucagaguuggcuacuguucccagauucccaacugcgauaugagccaugggcaggacuguuaucgcggaaauggcaaaaacuacauggggaaucucucccaaacccggucuggacugacaugcagcaugugggauaagaacauggaagaccuucacagacauaucuucugggagccggaugcguccaagcugaaugagaacuacugccgcaauccugacgacgaugcccacggccccugguguuauaccggcaacccucucauucccugggacuacugcccuaucagccggugugaaggggauacgacacccaccaucgugaaucuggaccauccggucauuucuugcgcuaaaaccaagcagcuuagaguggugaacggaaucccuacacgcaccaauauuggcuggauggucucccugcgguauagaaacaaacacaucugugggggaagccucauuaaggagucuuggguucugacagcccgccagugcuuccccagccgggaucugaaagacuacgaggcuuggcucggcauccacgaugugcaugggagaggcgacgaaaaguguaaacaggugcugaacgucucccaacuuguguauggacccgaaggcucugaucugguucucaugaagcuggcccggccugcggugcuugacgauuuugucagcacgaucgaccugccgaauuacgggugcaccauucccgagaagacauccuguagcguguauggauggggcuacaccgggcucaucaacuacgauggacugcugcgcguugcccaccucuauauuaugggcaaugagaaaugcucucagcaucacagagggaaggugacacugaacgaauccgagaucugugcuggcgccgagaaaauuggaagcggcccuugcgaaggggacuacggaggcccccuugucugcgagcagcacaagaugcggauggugcugggggucaucgugccuggaagaggcugugcuauucccaaucgcccugggaucuucguucggguggccuauuacgccaaguggauccauaaaauuauccucaccuauaaggucccccagucuuga

SEQ ID NO: 648 - RNA, 1926 nt, Artificial Sequence
  derived and/or modified CDS sequence (opt5) from Homo sapiens__NP_005336.3 __HsHSPA1A
auggccaaggcugccgcgaucggcauugaccuggggaccacauacagcugcgugggagucuuccagcacggcaaaguugagaucauugcuaacgaucaagggaauagaacgacccccuccuauguggccuuuacagacaccgaacggcucaucggagaugccgcuaagaaccagguggcccugaauccucagaacacagucuucgacgcuaaacgccuuauuggcagaaaguuuggggauccggugguucagucugacaugaaacauuggcccuuccaagugaucaaugauggagacaagccuaagguccaggugagcuacaaaggcgagaccaaggccuuuuaucccgaagagaucuccucuaugguucugacaaaaaugaaggaaauugcggaggccuaccucggcuauccugugaccaacgcugucaucacggugcccgccuacuucaaugauagccagcggcaggcuaccaaagacgccggggugauugcgggacugaacguccuucgcaucauuaaugagccuacagccgcugccaucgcuuauggccuggauagaaccgggaagggagaacggaacguucucauuuuugaccugggcgggggaacauucgauguguccauccugaccaucgacgacggcauuuuugaggugaaggccacggccggcgauacacaccucgggggagaagacuucgauaaucgccuggucaaccauuuuguggaggaguucaaaagaaagcacaaaaaggacaucucucaaaauaaacgggcuguucgcagacuucggaccgcgugugaacgcgccaagagaacacugagcuccagcacccaggcuucucucgagauugauucccuguuugaaggcaucgacuucuacaccagcauuacacgggcccgcuucgaggaacuuugcucugaucuguuuagauccacgcucgagccgguggagaaagcccugcgggacgcuaagcuggauaaggcccagauccaugaccucguccugguugggggaagcaccagaauccccaaagugcagaaacuucugcaagauuucuuuaacggccgcgaccucaauaagucuauuaacccugacgaagcgguggcuuacggggccgccguccaggcugccauccugaugggagauaaguccgagaacgugcaggaccuucugcuccuggaugucgcuccccugagccucggccuggaaacagccggcggggugaugaccgcgcuuauuaaacggaauagcacaaucccuaccaagcaaacgcagauuuucacaaccuauucugacaaccagcccggaguucugauccagguguacgagggcgaaagagccaugaccaaggauaauaaccuccuggggcgcuuugagcuuagcggaaucccgccugcuccccggggcgucccucaaauugaggugacauucgacaucgaugccaaugggauucugaacguuaccgcuacagacaaauccacgggcaaggccaauaaaaucaccauuacaaacgauaagggaagacucagcaaagaagagaucgaacgcauggugcaggaggcggaaaaguauaaggccgaggacgagguccagcgggaaagagugucugcuaaaaaugcccuggaguccuacgcuuuuaacaugaaguccgccguggaagaugagggccugaaagggaagauuucugaggccgacaaaaagaagguucucgauaaaugucaggaagucaucagcuggcuggacgcuaauacccuugcggagaaggacgaguucgaacacaaacgcaaggaacuggagcaagugugcaaccccaucauuuccggacucuaucagggcgccgggggacccggcccugggggcuuuggagcucagggcccgaaagggggaucuggcagcgggcccacaaucgaggaaguggauuga

SEQ ID NO: 649 - RNA, 1926 nt, Artificial Sequence; identical to SEQ ID NO: 648
  derived and/or modified CDS sequence (opt5) from Homo sapiens__NP_005337.2 __HsHSPA1B

SEQ ID NO: 650 - RNA, 1926 nt, Artificial Sequence
  derived and/or modified CDS sequence (opt5) from Homo sapiens__NP_005518.3 __HsHSPA1L
auggccaccgcuaagggcaucgccauugggaucgaccugggaacaacguacagcugcgugggcgucuuccagcacgggaagguugagauuaucgcgaacgaucaaggaaauagaaccacacccuccuauguggcuuuuaccgacacagaacggcucauuggcgaugccgccaagaaccagguggcuaugaauccucagaacaccgucuucgacgccaaacgccugaucgggagaaaguuuaaugauccggugguucaggcugacaugaaacuuuggcccuuccaagugaucaacgagggaggcaagccuaagguccuggugucuuacaaaggcgaaaauaaggccuuuuaucccgaggaaauuagcuccaugguucucacaaaacugaaggagaccgcggaggccuuccuugggcauccugugacgaacgcugucaucaccgugcccgccuacuuuaaugauucucagcggcaggcuacaaaagacgccggagugauugcgggccugaacguccuccgcaucauuaaugaaccuaccgccgcugccaucgcuuaugggcuggauaagggaggccagggggagagacacguucugauuuucgaccucggaggcggcacauuugaugugagcauccugaccaucgacgaugggauuuucgaagugaaggccacggccggagacacacaucuuggcggggaggacuuugauaaccggcuggucucccacuucguggaggaauuuaaacgcaagcauaaaaaggacaucucucaaaauaaaagagcuguucggcgccucagaaccgcgugugagcgggccaagcgcacacugagcuccagcacccaggcuaaccuugaaauugauucucuguacgagggaaucgacuucuauaccuccauuacaagagcccgguucgaggaacucugcgccgaucuguuucgcggcacgcuggagccgguggaaaaagcucucagagacgccaagauggauaaggcgaaaauccacgacaucguccugguugggggaagcacccggauucccaaggugcagagacuucugcaggauuacuucaauggccgcgaccucaacaaaucuaucaacccugaugaggcuguggccuacggcgccgcuguccaagccgcuauucugaugggggacaaguccgaaaaagugcaggaccuucugcuccuggaugucgcgccccugagccucggacuggagacagccggcggggugaugaccgcccuuaucaagcggaauagcacaauuccuaccaagcagacgcaaaucuuuacaaccuauuccgacaaccagcccggaguucugauccagguguacgaaggcgagagagcuaugaccaaagauaauaaccuccuggggcgcuucgaccuuacaggcauuccgccugcuccccggggagucccucagaucgaggugaccuuugauauugacgccaauggcauccugaacguuacagccacggauaagagcaccgggaaagugaauaagauuacaaucaccaacgacaaaggaagacucuccaaggaagagauugaacgcaugguccuggaugcggagaaguauaaagccgaagacgaggugcaacgggagaagaucgcugccaaaaaugcucuggaaucuuacgccuucaacaugaagucugugguuuccgaugagggccucaaagggaagaucagcgaaucugacaagaauaaaauucuggauaaguguaacgagcuucuguccuggcucgaggucaaucagcuggccgaaaaagacgaguuugaccacaagagaaaagaacuggagcagaugugcaaccccaucauuacaaaacuuuaucagggaggcuguaccgggcccgcuugcggcacgggauacgugccuggccgcccggcgaccgggcccacaaucgaagagguggauuga

SEQ ID NO: 651 - RNA, 1920 nt, Artificial Sequence
  derived and/or modified CDS sequence (opt5) from Homo sapiens__NP_068814.2 __HsHSPA2
augagcgccagaggccccgcuaucgggauugaccugggaaccacauacuccugcgugggcgucuuccagcacgggaagguugagaucauugccaacgaucaaggaaaucggacgaccccuucuuauguggcguuuacagacaccgaacgccucaucggcgaugcugccaaaaaccagguggccaugaauccgacaaacaccauuuucgacgcuaagagacugaucgggcggaaauuugaggaugccacaguccagagcgacaugaagcauuggcccuuccgcgugguuuccgaaggaggcaaaccuaaggugcaggucgaguacaagggcgaaaccaaaacguuuuuccccgaggagaucucuagcauggugcuuaccaagaugaaagaaauugcugaggccuaucugggaggaaagguucacuccgcggugaucacagucccugccuacuuuaaugauucucaaagacaggcuaccaaagacgccggcacaauuaccgggcucaacgugcugcggaucauuaaugaacccacggcugccgcgaucgccuauggacuugauaagaagggcugugcugggggagagaaaaacgugcugauuuucgaccucggcggcgggacauuugaugucagcauccugaccaucgaggacggaauuuucgaaguuaaguccacagccggcgauacccaucuugggggagaggacuuugacaaucgcauggugagccaccucgcugaagaguucaaaagaaagcauaaaaaggauaucggcccuaacaaacgggccgugcgcagacugcggaccgccugcgaacgcgcuaagagaacacuuucuuccagcacgcaggcgucuauugagaucgacucccuguacgagggggucgauuuuuauaccagcauuacacgggcccgcuucgaggaacucaaugcugaccuguucagaggaacccuugaaccgguggagaaggcccugcgggaugccaaacucgacaagggccagauccaagaaaucguucuggugggcgggucuacacgcauucccaaaauccagaagcugcuccaggacuuuuucaacggaaaagagcugaauaaguccauuaacccugaugaggcugucgccuacggcgcggcugugcaggccgccauccuuauuggggauaagagcgaaaauguucaagaccugcuccugcuugaugugacgccccugucccucggaaucgagaccgcuggcggggucaugacaccucugaucaaaagaaacaccaccauucccacaaagcagacccagacauuuacgaccuacucugacaaccaaagcuccgugcugguccagguguaugaaggcgagcgggccaugacaaaagacaauaaccuccugggaaaguucgaucuuaccggcaucccgccugcucccagagggguuccucagauugaagugacauuugacaucgaugccaaugggauucugaacgucaccgcggccgacaaaagcacgggcaaggagaauaagaucaccauuacaaacgauaaagggcgccucucuaaggacgauaucgaccggauggugcaggaggcugaaagauacaaauccgaggaugaagccaaucgcgaccggguugcugccaagaacgcgcuggagagcuauaccuacaauaucaaacaaacaguggaggaugaaaagcugagaggaaagauuucugagcaggacaaaaacaagauccuggauaaaugucaggaagucauuaauuggcucgaccgcaaccagauggccgagaaggacgaauaugagcacaaacaaaaggagcuggaacgggugugcaaucccaucauuagcaaacuguaccagggcgggcccggcggaggcuccgggggaggcgggucuggagcuagcggcgggccuaccaucgaggaaguggauuga

SEQ ID NO: 652 - RNA, 2523 nt, Artificial Sequence
  derived and/or modified CDS sequence (opt5) from Homo sapiens__NP_002145.3 __HsHSPA4
augagcguggucggcaucgaccugggguuccaguccugcuacguugccguggcuagagccggaggcauugagaccaucgcgaacgaauauucugaucgguguacacccgcuugcauuagcuuugggccuaagaaucgcuccaucggagccgccgcuaaaucucaagugauuagcaacgccaagaauacgguccagggcuucaaaagauuucacgggcgggcuuucuccgacccguuuguggaggccgaaaagucuaaccucgcguacgauaucguucagcugcccaccggacuuacaggcaucaaagugaccuauauggaggaagaacgcaauuucacaaccgagcaggucacagccaugcugcucagcaagcugaaggaaaccgcugaguccgugcuuaaaaagccuguuguggacugugucgugagcgugcccugcuuuuacacggaugccgaaagacggucugucauggacgcuacccaaauugccggccugaacugucuccgccugaugaaugagacaaccgcgguugcccuggcuuaugggaucuacaaacaggaucucccugcccuggaggaaaagcccagaaacgugguguucgucgacaugggacauuccgcuuaucaggugagcguuugcgccuuuaaucggggcaaacuuaaggugcuggccacagcuuucgauaccacgcucgggggacgcaaguuugacgagguccuggugaaccacuucugugaagaguuuggcaaaaaguacaaacuugauauuaagucuaaaaucagagcgcugcuccggcugucccaggaaugcgagaagcugaaaaagcucaugagcgccaaugcuucugaccugccucuuuccauugaguguuucaugaacgauguugacgugagcgggacaaugaaucgcggaaaguuccuggaaaugugcaacgaccuccuggccagagucgagccgccccuucgguccgugcuggaacaaaccaaacucaagaaagaggauaucuacgccgucgaaauugugggcggcgcuacacgcaucccugccguuaaggagaaaaucucuaaguuuuucgggaaggagcugagcaccacccugaaugcggacgaagcugugacaagaggaugugcccuccagugcgccauucugucccccgcuuuuaaaguccgggaguucagcaucacggaugugguuccuuaucccauuucucuuagauggaacuccccggccgaagagggcagcucugacugcgaaguguuuagcaagaaccaugcugccccuuucuccaaaguccugaccuuuuaccgcaaggagcccuucacacucgaggcguauuacucuagcccucaggaucugcccuaucccgacccugccaucgcucaguuuuccgugcaaaaagugaccccgcagagcgaugggucuuccagcaagguuaaggucaaagugcgggugaauguccacggaauuuucucuguguccagcgccucccuuguugaagugcauaagucugaggaaaacgaggagcccauggaaacagaccagaaugcuaaagaggaagagaagaugcaagucgaucaggaggagccucacguggaggaacagcagcaacagacccccgccgagaacaaagcggaaagcgaggaaauggagacgucccaggccggcucuaaggacaagaaaauggaucagccuccccaagcuaagaaagccaagguuaaaacaagcaccguggaccugccgaucgagaaucagcuccuguggcagaucgacagagaaaugcugaaccucuacauugagaaugaagggaagaugaucaugcaggauaaacuggagaaggaacgcaacgacgcuaagaaugccgucgaggaguauguguacgaaaugcgggauaaacuuuccggagaguacgaaaaguuuguuagcgaggacgauagaaacucuuucacccugaaacucgaggacacagaaaauuggcuguaugaggauggcgaagaccaaccuaaacagguguacgucgauaagcuggccgagcuuaagaaccucggccagcccauuaagauccgcuuucaggaauccgaggagcggccuaaacuguucgaggaacuggggaagcaaauucagcaguauaugaaaaucaucagcucuuucaagaauaaagaagaccaauacgaucaccucgacgcugcggauaugaccaagguggagaaguccacaaacgaagccauggaguggaugaauaacaaacugaaccuucagaauaagcagagccugacgauggaccccguggucaaaucuaaggagauugaagcuaaaaucaaggagcucaccagcacauguuccccuauuaucagcaagcccaaaccgaagguugaaccucccaaagaggaacagaagaacgccgagcaaaauggacccguggacggccagggggauaacccuggaccgcaggccgcugagcagggcaccgacacagccgugcccucugauuccgacaaaaagcugccugaaauggauauugacuga

SEQ ID NO: 653 - RNA, 2520 nt, Artificial Sequence
  derived and/or modified CDS sequence (opt5) from Homo sapiens__NP_055093.2 __HsHSPA4L
augagcguggucggcaucgaccugggguuccucaacugcuacauugccguugcuagauccggaggcaucgagaccauugccaaugaauauucugaucgguguacacccgcgugcaucagccuggggucccgcacgagagcuauuggaaacgccgccaagucucagaucgugaccaaugugcggaacacaauccacggcuuuaaaaagcugcaugggcgcagcuucgacgauccuauuguccaaaccgagagaauccggcuuccguacgaacuccagaaaaugcccaauggauccgcuggcgugaagguucgcuaucuggaggaagagagaccuuuugccauugaacaggugacaggcaugcuucuggcuaaacucaaggagaccucugagaacgcccugaagaaacccgucgcggacugugugaucagcauuccuuccuucuuuacagaugccgaacggcgcagcguuauggcugccgcucagguggccgggcugaauugccucagacugaugaacgagaccacggcggucgcccuugcuuacggaaucuauaagcaagaccugcccccucucgaugagaaaccgcggaaugugguguucauugacaugggccacucugccuaccagguccugguuugugcuuuuaacaaggggaaacuuaaggugcuggccaccacauucgaucccuaucucggaggccgcaauuuugacgaagcccugguggauuacuucugcgacgaguuuaagaccaaauacaagaucaacgucaaagaaaauuccagagcucugcuccggcuguaucaggagugugaaaaacuuaagaagcugaugagcgcgaacgccucugaucucccucugaauaucgagugcuucaugaacgaccuugacguguccagcaaaaugaaccgcgcucaguuugagcaacugugugccucucuccuggccagaguugaacccccucugaaggcugugauggagcaggccaaucuccagcgggaagauauuuccagcaucgagauugucgggggagcgacaagaauccccgcugugaaggaacagauuaccaaauucuuccugaaggacaucuccacgacacuuaacgccgaugaggccguugcucgcggcugcgcccugcaaugugcuauccucucuccggccuuuaaagugcgggaguucagcauuaccgaccuggucccuuacuccaucacacuuagauggaagaccagcuuugaagauggcucuggggagugcgaaguguucugcaaaaaucaucccgcgccuuuuuccaaggucauuaccuuccacaagaaagagcccuuugaacuggaggccuucuauacaaaccuccaugaggugcccuacccugacgcucgcaucggcagcuuuacgauucagaauguuuucccgcagucugauggagacagcuccaaggugaaagucaaggugcggguuaacauccacgggaucuuuucuguggccagcgcuuccgucauugaaaaacaaaaucuggagggagaucacagcgacgcccccauggaaaccgagacaucuuucaagaacgagaauaaggauaacauggacaaaaugcaaguggaccaggaagagggccaucagaagugucacgcggaacauaccccugaggaagagaucgaucacacaggggccaaaaccaaguccgcugugagcgacaaacaggauagacugaaucagacgcucaagaagggaaaaguuaagucuauugaccugcccauccaguccagccuuugccgccagcugggccaagaucuccugaacuccuauauugagaaugaaggcaaaaugaucaugcaggacaagcuggagaaagaacggaacgaugccaagaaugcugucgaggaauacguguaugacuuuagagaucgccuugggacaguguacgagaaauucauuaccccugaggaccucucuaagcugagcgccguccuggaagauaccgagaacuggcucuacgaagacggagaggaucagcccaaacagguguauguugacaagcugcaagaacuuaagaaauacggccagccgauccagaugaaguauauggagcacgaggaacggccuaaagcccugaacgaccucgggaagaagauccagcuggugaugaaagucauugaggcuuacagaaauaaggaugaacgcuaugaccaucuggaucccacagagauggagaaaguggaaaaguguaucuccgacgcgaugucuuggcuuaacagcaaaaugaaugcccaaaacaagcucucccugacccaggauccuguugugaaggucagcgagauuguggcuaaaucuaaggaacuggacaauuucugcaaccccaucauuuacaaaccuaagcccaaagccgagguuccggaagauaagccuaaggccaauuccgagcacaacggacccauggacggccagagcgggacagagacgaaaucugauuccaccaaggacagcucucaacauacaaaaagcuccggcgaaauggagguggauuga

SEQ ID NO: 654 - RNA, 1965 nt, Artificial Sequence
  derived and/or modified CDS sequence (opt5) from Homo sapiens__NP_005338.1__HsHSPA5
augaagcugagccucguggccgcuaugcugcuucugcucuccgccgcgagagcugaggaagaggacaaaaaggaagaugucggcaccguuguggggaucgaccugggaacaacguacucuugcgugggcgucuucaaaaacgggcggguggagauuaucgccaaugaucagggaaaccgcauuacccccagcuauguugccuuuacaccugaaggcgagagacuuaucggggacgcugccaagaaucaacugaccuccaacccggagaauacaguguucgaugcuaaacggcucauuggacgcaccuggaacgaccccucuguccagcaggauaucaaguuucugccuuucaaggugguugaaaagaagacaaaacccuacauccagguggacauuggcggcgggcaaaccaagacguuugccccugaggaaaucagcgcgaugguccugaccaaaaugaaggagacagccgaggcuuaucucggaaagaaagugacccacgccguggucacaguucccgcuuacuucaaugaugcccagagacaggcgaccaaggacgccggcacgauugcugggcugaacgugaugcggaucauuaaugaaccuacagccgcugccaucgccuauggacuugauaaacgcgagggcgaaaagaacauucugguguuugaccucgggggaggcaccuucgaugucucccugcuuacaaucgacaauggcguguuugagguuguggcuaccaacggggacacccaucugggaggcgaagauuucgaccagagagucauggagcacuuuaucaaacucuacaagaaaaagacagggaaggaugugcggaaagacaaucgcgcgguucaaaagcugagacgggagguggaaaaagccaagcgcgcucugucuagccagcaucaggccagaauugagaucgaauccuucuaugagggagaagauuuuagcgagacgcucacccgggccaaauucgaggaacugaacauggaccuuuuccgcucuacaaugaagccgguccagaaggugcuggaggauuccgaccucaaaaagagcgauauugacgaaaucguccuggugggcgggucuacccggauucccaaaauccaacagcuuguuaaggaguuuuucaauggaaaagaaccuuccagaggcaucaaccccgaugaggcuguggccuacggcgcggcuguccaggccggggugcugagcggagaccaagacacaggcgaucucguucugcuggacguguguccucucacccuggggauugagacggucggaggcgugaugacaaaacuuauccccagaaacaccgugguuccgaccaagaaaucucagaucuuuuccacagccagcgauaaucagccuaccgucacaauuaagguguacgaaggggagcgcccccugacgaaagacaaccaccuccugggcaccuucgaucuuacaggcauuccucccgcuccccggggagugccucagaucgaagucaccuuugagaucgacgugaaugggauucugagaguuacagccgaggauaagggaaccggcaacaaaaauaagaucacgauuaccaacgaccaaaaucgccucacaccggaagagaucgaacggauggugaacgaugcugagaaguucgccgaagaggacaaaaagcugaaagagagaauugauacccgcaaugaacuggaguccuaugcguacucucucaagaaccagaucggggacaaagaaaagcugggaggcaaacuuagcuccgaggauaaggaaacaauggagaaggccgucgaggagaaaauugaauggcuggaaagccaucaggacgcugacaucgaggauuuuaaggccaaaaagaaagaacucgaggagaucgugcagcccauuaucucuaagcuguauggguccgcuggcccucccccuaccggagaagaggacacggccgaaaaggaugagcuguga

SEQ ID NO: 655 - RNA, 1932 nt, Artificial Sequence
  derived and/or modified CDS sequence (opt5) from Homo sapiens__NP_002146.2__HsHSPA6
augcaggcccccagagagcuggcugugggcaucgaccucgggaccacauacagcugcgucggaguuuuccaacagggccggguggaaauucuggccaacgaucaggggaaucgcacgaccccuuccuauguggcguuuacagacaccgagagacuugucggagaugcugccaagucucaggccgcucugaacccgcacaauacaguguucgacgccaaacggcucaucggccgcaaguuugcugauaccacaguucaaagcgacaugaaacauuggcccuucagaguggucuccgaagggggaaagccuaaagugcggguuuguuaccgcggcgaggauaagaccuuuuaucccgaagagauuucuagcauggugcuguccaagaugaaagagacggccgaagcguaccuuggccagccugucaagcacgccgugaucaccgugcccgcuuauuucaacgacucucagagacaggccacaaaagaugcuggggccauugcgggacugaauguccuccggaucaucaacgagccuaccgccgcugccauugcuuacggccuggaccgcagaggggccggagaacggaauguucugaucuuugaucucggcgggggaacauucgacgugagcgugcuguccauugaugccggcgucuuugaggugaaggcuaccgcgggcgacacgcaucuugggggagaggacuucgauaaccgccugguuaaucacuuuauggaagaguucagacggaaacauggcaaggaccucagcgggaacaagcgcgcccugagacggcuuagaacagcuugcgaacgcgccaaacggacccugucuuccagcacacaagccacccucgagaucgauucucuguuugaaggaguggacuucuauaccuccauuacaagagcucgcuucgaggagcuguguagcgaucucuuucggucuacgcuggaaccggucgagaaggcccuuagagacgcgaaacuggauaaggcucagauccacgacgugguucucgugggcggguccacccgcauucccaaaguccagaagcugcuucaggauuucuuuaauggaaaagaacugaacaagagcaucaauccugacgaggccguggccuacggcgcugccguccaagcugccgugcucaugggcgauaagugcgaaaaaguucaggaccugcugcuccuggacguggcgccccuuucccuggggcucgagacagccggaggcgucaugaccacacugauccagcggaacgcuaccauuccuacgaagcaaacacagaccuucaccacauacucugauaaucagcccgggguguuuauccagguuuaugagggagaaagagccaugaccaaagacaacaaccuucugggccgcuucgagcucagcgggauuccgccugcuccccggggcgugccucaaaucgaagucacauuugauauugacgccaauggaauccuguccgugacggcgaccgauagaagcacaggcaaggccaacaaaaucaccauuacaaaugacaaggggcgccugucuaaggaggaaguggagcggaugguucacgaggcugaacaguacaaagccgaggaugaagcucagagagaccgggucgccgccaagaacucccucgaggcucauguguuccacgugaaaggaagccugcaggaggaaucucuucgcgauaagauccccgaggaagacagacggaaaaugcaagauaaguguagagagguccuggcguggcucgaacauaaucagcuggccgagaaggaggaauaugagcaccagaaacgcgaacuggagcagauuugccggcccaucuuuagcagacuuuacggcgggccuggagugccgggcggguccucuuguggcacccaagcucgccagggagaccccagcacgggcccuauuaucgaagagguugauuga

SEQ ID NO: 656 - RNA, 1104 nt, Artificial Sequence
  derived and/or modified CDS sequence (opt5) from Homo sapiens__P48741__HsHSPA7
augcaggcccccagagagcuggcugugggcaucgaccucgggaccacauacagcugcgucggaguuuuccaacagggccggguggaaauucuggccaacgaucaggggaaucgcacgaccccuuccuauguggcguuuacagacaccgagagacuugucggagaugcugccaagucucaggccgcucugaacccgcacaauacaguguucgacgccaaacggcucaucggccgcaaguuugcugauaccacaguucaaagcgacaugaaacauuggcccuuccagguggucuccgaagggggaaagccuaaagugagaguuuguuaccggggcgaggauaagaccuuuuaucccgaagagauuucuagcauggugcuguccaagaugaaagagacggccgaagcguaccuuggccagccugucaagcacgccgugaucaccgugcccacauauuucucuaacagccagcgccaagcuaccaaagacgccggggcuauugccggacugaagguccucccuaucaucaaugaggcgacagccgcugccauugcuuacggccuggauagacgcggggccggaaaacggaacguucugaucuuugaccucggcgggggaaccuucgauguguccgugcugagcauugacgccggcgucuuugaagugaaggcuacggcgggcgauacacaucuugggggagaggacuucgacaauagacugguuaaccacuuuauggaggaguuccggcgcaagcauggcaaagaucucucugggaauaagagagcccugcggcgccuuagaaccgcuugcgagcgggccaaaagaacaccguccagcucuacccaggccacccuggaaaucgacucccucuuugagggaguggauuucuauaagagcauuacacgcgcucgguucgaagaacuguguucugaccuguuuagauccacgcucgagcccgucgaaaaagcccugcgcgaugcgaaacuugacaaggcucagauccacgauuucgugcugggcgggggacuccacagccauccucagggcgccgagguugccgcuggccugcuucaacggcagggggccgaacaggagcaccaacccuga

SEQ ID NO: 657 - RNA, 1941 nt, Artificial Sequence
  derived and/or modified CDS sequence (opt5) from Homo sapiens__NP_006588.1 __HsHSPA8
augagcaagggccccgccguggggaucgaccugggaaccacauacuccugcgucggcguuuuccagcacgggaaaguggagauuaucgcuaacgaucaaggaaauagaacgaccccuucuuauguggccuuuacagacaccgaacggcucauuggcgaugcggcuaagaaccaggucgccaugaauccgacaaacaccguguucgacgccaaacgccugaucgggagacgguuugaugacgcuguugugcagagcgauaugaagcauuggcccuucauggucgugaaugacgccggacgcccuaaaguucagguggaguacaagggcgaaacaaaguccuuuuaucccgaggaagucucuagcauggugcuuaccaaaaugaaggagauugcugaggccuaccugggcaaaacggugaccaacgcggucguuacagugccugccuauuucaaugauucccaaagacaggcuaccaaggacgccgggacaaucgcuggacucaacgugcugcggaucauuaaugaacccaccgccgcggccaucgcuuacggccuugauaaaaaggucggggccgagcgcaacgugcugauuuuugaccucggaggcgggacguucgauguuucuauccugacaauugaagacggaaucuuugaggugaagucuaccgcuggcgacacacaccugggcggggaggauuucgacaauagaauggucaaccauuuuauugccgaauuuaaacggaagcacaaaaaggauaucuccgagaauaaacgcgccgugagacggcuccgcaccgcuugugaaagagcgaagcggacccugagcagcuccacacaggccagcaucgagauugacucucuuuaugaaggaaucgauuuuuacacguccauuacccgcgcuagauucgaggagcugaacgccgaccucuuccggggcacacuggauccuguugaaaaagcccuuagagacgcuaagcuggauaagagccagauccaugacauugugcucgucgggggaucuacccgcaucccgaaaauccaaaagcugcugcaggauuucuucaauggcaaagagcucaacaaguccauuaaccccgacgaagccguggcguacggggcugccguccaggccgcuauccugagcggagacaaauccgagaaugugcaggaucuucugcuccuggacguuacaccucuuucucugggcauugaaaccgccggcggggugaugacgguccucaucaagcggaacacaaccauucccaccaagcaaacacagaccuuuacaacguauagcgauaaucagccuggagugcugauccaaguuuacgagggcgagagagcuaugaccaaagacaacaaucugcucgggaaguucgaacugacaggaaucccgcccgccccucgcggcgugccccagauugaggucaccuuugauaucgacgcgaacgggauucuuaauguguccgccguggauaaaagcacaggcaaggaaaacaaaaucaccauuacgaaugacaagggacggcugucuaaggaggauaucgaaagaaugguucaggaggcugagaaauauaaggccgaagacgagaaacagcgcgauaaggucuccagcaaaaacucucucgaaagcuacgcuuucaauaugaaggccaccguggaggacgagaagcugcaaggcaaaauuaacgaugaagacaagcagaaaauccuugacaagugcaaugagaucauuaacuggcuggauaaaaaucagacagcggaaaaggaggaauuugagcaccagcaaaaagagcucgaaaagguguguaacccuaucauuaccaagcuguaucaguccgccgggggaaugcccggcgggaugcccggaggcuucccugggggcggagcuccgcccucuggcggggccagcuccggaccuacaaucgaggaagucgacuga

SEQ ID NO: 658 - RNA, 2040 nt, Artificial Sequence
  derived and/or modified CDS sequence (opt5) from Homo sapiens__NP_004125.3 __HsHSPA9
augaucagcgccuccagagcugccgcggcucggcuggugggcgccgccgcuucucgcgggcccaccgccgcuagacaccaggacagcuggaacggacucucccaugaggccuuccggcuggucucucgcagagauuacgcgagcgaagccauuaagggcgcuguuguggggaucgaccuuggaacaacgaauagcugcguggccgucauggagggcaaacaagcuaaggugcuggaaaacgccgagggggcgcggaccacaccuucuguuguggccuuuaccgcugauggagaacgccucgucggcaugccggccaaaagacaggcugugacaaaucccaacaauaccuucuaugccacaaagcggcugauuggccgcagauacgacgauccugagguucagaaagacaucaagaacgugcccuuuaagauuguccgggccagcaauggggaugcuuggguggaggcgcacggaaaacuuuauuccccuagccagaucggcgccuucgugcugaugaagaugaaagaaaccgcugagaacuaccucgggcauacggccaagaaugccgucaucaccguucccgcuuauuuuaacgacucucaacgccaggccacaaaagaugcgggacagauuuccggccugaaugugcugagagugaucaacgaaccuaccgcugccgcccucgcuuacgggcuggacaagagcgaggauaaggucauugccguguaugaccuuggaggcggcacauucgauaucucuauucuggagauccagaaagggguuuuugaagugaaguccaccaauggagacacguuccucggcggggaggacuuugaucaagcucugcuucggcacauugucaaagaguucaagcgcgaaacaggaguggaccugaccaaagauaacauggcccuccagagaguucgggaagcggccgagaaggcuaaaugugagcuguccucuuccgugcagacagacaucaaucugccguaccucaccauggauagcuccggccccaagcaucugaacaugaaacuuaccagagcccaguuugaagggaucgucacagaccugauucgccggacgaucgcuccuugccaaaaggccaugcaggaugcggaggugucuaagagcgacauuggagaagucauccucgugggcggcaugaccagaaugcccaaaguucagcaaacagugcaggaucuguucgggcgcgccccuuccaaggcugucaaccccgacgaggccguggcuauuggagccgccauccagggcgggguucuugcuggagaugugaccgacguccugcuccuggacgugacaccgcugagccucggcaucgaaacccugggcggcguguuuacgaaacuuauuaaucggaacacaaccaucccuaccaagaagucucagguuuucuccacagcggccgauggacaaacccaggucgagauuaaagugugucagggcgagagagaaauggcuggggacaauaagcugcucggacaguucacacugaucggcauucccccugcuccccgcggggugccccaaaucgaggucacguuugauaucgacgccaacggaauugugcacguuagcgccaaagauaagggcaccgggcgggaacagcagaucgugauucagucuagcggcggacuuuccaaagacgauaucgagaauauggucaagaacgccgaaaaguacgcggaggaggacagacgcaaaaaggaacggguggaggcuguuaauauggccgaaggcauuauccacgauacagagaccaaaauggaggaguucaaggaccaacugccugccgaugaaugcaacaaacucaaggaagagauuucuaagaugagagaacugcuggcucgcaaagacagcgagacaggggagaauauccggcaggccgcguccagccuccagcaggcuucucugaaacuuuuugaaauggccuauaagaagauggccuccgagagagaaggaagcgggucuuccgggaccggagagcaaaaagaagaucagaaggaggagaaacaguga

SEQ ID NO: 659 - RNA, 2028 nt, Artificial Sequence
  derived and/or modified CDS sequence (opt5) from Homo sapiens__NP_079291.2__HsHSPA12A
auggccgacaaggaggcuggcgggagcgauggacccagagaaaccgccccuacauccgcguacucuagcccggcucggucccugggcgacacggggaucacaccccucucuccuagccacauugugaacgauaccgacuccaaugucucugagcagcagagcuuccugguugugguggccgucgauuuuggaaccacauccagcggcuaugccuacucuuucaccaaagaacccgagugcauccaugugaugcgcagaugggaagggggagacccuggcguuuccaaccaaaagacacccaccacgauucuucugaccccugagcggaaauuucacagcuucggcuaugcugcccgcgauuuuuaccaugaccucgauccgaaugaggcuaagcaguggcuguaucuugaaaaauucaagaugaagcugcacacaaccggggaccucacaauggauaccgaccugacggccgcgaacggcaaaaaggugaaagcccuggagaucuuugcuuacgcccuccaguauuucaaggaacaagcucugaaagagcuuucugaucaggccggauccgaguuugaaaauagcgacgucagaugggugauuacaguucccgcgaucuggaagcagccugccaagcaguucaugcggcaagcugccuaccaggcugggcuggccucucccgagaacuccgaacagcucaucauugcccuggagccugaagcugcgagcaucuacugucgcaaacuuagacugcaucagaugauugagcucuccucuaaggccgcugugaauggauauagcggcuccgacaccgucggggccggauuuacacaagccaaagagcacauccggcgcaacagacagagccggaccuuccugguggaaaaugugauuggcgagaucuggucugaacuggaggaaggcgauaaguacgucguuguggacuccgggggaggcaccguggaucucacaguccaccagauucgccugcccgaggggcaucuuaaagagcuguauaaggcuacgggaggcccguacgggagccucggaguggacuaugaauuugagaaacugcuuuacaagaucuucggcgaagauuucaucgagcaauuuaagauuaaaagaccugccgcguggguugaccugaugaucgcuuucgaaucucggaagcgcgccgccgcucccgauagaaccaacccucucaauauuacacugcccuuuagcuucaucgacuauuacaaaaaguuucggggccacuccguggagcaugcccugagaaaaucuaacgucgauuucgugaaguggagcucccaggggaugcuccgcaugagccccgacgcuaugaaugcccuguuuaagccuaccauugauucuaucaucgagcaccuucgggaccuguuccagaaaccggaaguuuccacagugaaguuucucuuccuggucggaggcuuugcggaggcuccccuucugcagcaagccgugcaggccgcuuucggggaccagugcagaauuaucauuccucaggaugucggacucaccauccugaaaggcgccgugcuguuugggcucgaccccgcgguuauuaaggugcgccggagcccucugacguacggcgucggagugcuuaacagauauguugaaggcaaacaucccccggagaagcugcucgugaaggaugggacacgcugguguaccgacgucuucgauaaauucaucucugccgaccaauccguggcucugggagagcuggugaagcggagcuacaccccugccaaacccucccagcuuguuaucgucauuaauaucuauucuagcgaacacgauaacguguccuuuauuacagacccuggcgugaagaaaugcgggacccucagacuggaucugacaggaacgucuggcaccgcuguccccgcccgccgggagauccagacacucaugcaguucggggacaccgaaauuaaggccacagcuaucgauauugcgaccagcaaguccgugaaaguuggcaucgacuuucugaacuacuga

SEQ ID NO: 660 - RNA, 2061 nt, Artificial Sequence
  derived and/or modified CDS sequence (opt5) from Homo sapiens__NP_443202.3 __HsHSPA12B
augcuggccgugcccgagaugggccuccaggggcuguacaucggaagcuccccugaaagaucuccgguccccagcccucccggcuccccucggacccaagagucuugcgggauugcuccccuuacaccuagccaguccccgaagcccgaaguucgcgccccucagcaggcgucuuucagcgugguggucgcuaucgacuuuggaacgaccuccagcggcuaugccuucucuuuugccuccgaucccgaggcuauucacaugaugagaaaaugggaagggggagacccuggcguggcccaucaaaagacacccaccugucugcuccugacaccggagggcgcuuuccacagcuuuggguacaccgcccgggauuauuaccaugaccuugauccugaggaagcgcgcgacuggcuguauuucgagaaauuuaagaugaaaauccacucugccacagaucucacccugaagacgcagcuggaagcuguuaacggaaagaccaugcccgcccucgagguguucgcucaugcccugagauuuuuccgggagcacgcgcuucaggaacugcgcgagcaguccccuagccuccccgaaaaagacacagucagaugggugcugaccguucccgccauuuggaagcaaccugcuaaacaguuuaugcgggaggccgcuuaccuugccggccuggugucucgcgaaaaugccgagcagcuccugaucgcucuggagccggaagcggccuccgucuauugcagaaagcuccggcugcaccagcuucuggaucucagcgggcgcgcucccggaggcgggagacugggagagcggcgcuccaucgacucuagcuucagacaagcccgggaacagcuuagacgcucccggcauagcagaacauuucugguggagucuggcgugggcgaacucugggccgagaugcaggcuggggaucgcuacgucguugccgacuguggaggcgggaccguggaucugacggugcaccaacuggagcagccucauggaacacucaaagaacuguacaaggcguccggcgggcccuauggagcugucggcguggaccuugccuucgagcagcugcucugccggauuuucggcgaagacuuuaucgccaccuucaagagacagcgcccugcugccuggguugaucugacaauugcuuuugaggcccggaaaagaaccgcggggccccaccgcgccggagcucuuaacaucagccugccguucucuuuuauugacuucuaccggaagcaaagaggccacaauguggaaaccgcccuccgccggagcuccgucaacuuugugaaauggucuagccaggggaugcugagaauguccugugaggcuaugaaugagcuguuccagccuacaguuagcggaaucauucagcauaucgaagcccuccuggcgcggcccgaggugcaaggcgucaaacuucuguuucucgucgggggcuucgccgaaucugcugugcugcagcacgccgugcaggcugcccugggagcccgcggccuuagaguuguggucccucaugauguggggcucacgauccugaagggagcuguucuguuuggccaggcgcccggggugguccgggugagacgcuccccucucaccuauggagugggcguucugaaccgguucguccccgggagacacccgccugagaaacuucuggugcgcgacggcagacgguggugcacagauguguuugagcgcuucgucgccgcugaacaaagcguggcccucggagaggaaguuagacggucuuacugucccgcccgccccggccagagacgggugcugauuaaucuguauugcugugcugccgaggacgcgcgcuucaucaccgauccuggggucagaaagugcggagcucuuucccucgaacuggagccggccgacuguggccaggauacagccggggcucccccuggacggcgcgagauuagagccgcgaugcaguuuggcgacaccgaaaucaaggugacggcuguugaugugagcacaaaccgguccgucagagccucuauugacuuccugagcaauuga

SEQ ID NO: 661 - RNA, 1416 nt, Artificial Sequence
  derived and/or modified CDS sequence (opt5) from Homo sapiens__NP_008879.3__HsHSPA13
auggccagagagaugaccauccugggcagcgcugugcucacacugcuucuggccggguaccucgcgcagcaauaucugccccuuccuacgccgaaggucauuggaaucgaccugggcaccacauacugcuccguugggguguucuuucccggaaccggcaaagugaaggucauuccugaugaaaacgggcacaucucuauucccagcaugguguccuucacagacaaugauguuuaugugggauacgagucugucgaacucgcugacagcaacccucagaauaccaucuaugaugccaaacgguuuaucggcaagauuuucacagccgaggaacuggaggcugagaucggccgcuaccccuuuaaagugcugaacaagaaugggaugguugaguucuccgugaccucuaacgaaacgauuaccgucagcccugaauaugugggauccagacuccugcuuaagcugaaagagauggccgaggcuuaccucggcaugccgguggccaaugcggucaucagcguucccgccgaauuugaccugaagcagcggaacucuacaauugaggcugccaaucuugcugggcugaaaauccuccgcgugauuaacgaaccuaccgccgcggccauggcuuacggacugcauaaggccgauguguuccacguccuggugaucgaccucggcgggggaacacuggauguuucccuucugaauaaacagggcggcauguuucucaccagagcuaugagcgggaacaauaagcugggaggccaagacuucaaccagcggcuucugcaguaucucuacaagcagaucuaucaaacguacggguuugugcccucucgcaaagaggaaauucauagacugcggcaggccgucgagauggugaagcugaaucucacacugcaccaguccgcccagcuuagcguucugcucaccguggaggaacaagaucgcaaagagccucauucuuccgacacagaacugcccaaggauaaacuuagcuccgcugacgaccacagagucaacucuggauucggccgggggcugagcgauaagaaauccggagagagccaggugcucuuugaaaccgagaucucucgcaagcuguucgacacccugaacgaggaucucuuccagaagauucuggucccgauccaacaggugcuuaaagaaggccaccuggagaagacagaaauugacgagguugugcucgucggcggguccacgagaaucccucggauccgccaggugauucaggaauuuuucggaaaagaucccaauaccagcguugacccugaucuggcgguggucacaggcguggccauccaagcugggauugacggaggcucuuggccccuucaggugagcgcccuggagauccccaacaagcaucuccagaaaaccaauuuuaacuga

SEQ ID NO: 662 - RNA, 1530 nt, Artificial Sequence
  derived and/or modified CDS sequence (opt5) from Homo sapiens__NP_057383.2__HsHSPA14
auggccgcuaucggcguccaccuggggugcaccagcgccugugucgcgguuuacaaggacggcagagcuggagugguggccaacgaugccggggaccgggucacacccgcugugguugccuauuccgagaaugaagagauugugggacucgcugccaaacagucucgcaucagaaacauuagcaauacggucaugaaggugaaacaaauccugggccgguccucuagcgauccucaggcgcagaaguacauugccgaauccaaaugccuuguuaucgagaagaacgggaagcugcgcuaugaaaucgacaccggagaggagacaaaauucgugaauccggaagaugucgcuagacucaucuuuucuaagaugaaagagaccgcccauagcgugcugggcuccgacgcuaacgauguggucauuacaguucccuucgacuuuggcgaaaagcagaaaaaugcccuuggggaggcggcccgggcugccggauucaacgugcugcgccucauucacgagccuagcgcugcccugcuggccuacggcaucgggcaagauucucccaccggaaaguccaauauucucguguuuaagcugggcgggacaagccuuucucuguccgucauggaagugaacagcggaaucuauagaguucucucuaccaauacggacgauaacauuggcggcgcucauuucaccgagacacuggcgcaguaccuugccuccgaauuucagcggagcuucaaacacgacgugcgcgggaaugcuagagccaugaugaagcugaccaacuccgccgaggucgcuaaacauucucucagcacacugggauccgccaauuguuuucuggauagccucuaugaaggccaggacuucgacugcaacgugucucgggcgcgcuuugagcugcuuuguuccccucuguucaacaagugcaucgaggcuaucagagggcuccuggaucaaaauggauuuaccgccgacgauauuaacaaaguugugcuuuguggcgggagcucucggauccccaagcugcagcagcucauuaaagaccuguucccugccgucgaacugcucaauagcaucccgcccgaugaggugauuccuaucggagcugccaucgaagcuggcauucugaucggcaaggagaaccuucuggucgaagacucccucaugauugagugcucugcccgcgauauccuggugaaggggguugacgagagcggagcguccagauucacggugcuuuuucccagcggcacaccucugcccgcccggagacagcacacccuccaagcuccggggucuauuuccagcgucugucuggaacuguacgagucugauggcaaaaauuccgccaaggaagagacaaaauucgcucaggugguucuccaggaccuggauaagaaagaaaacggacuucgcgacauccuggccgugcucaccaugaagcgggacgggagccugcacgugaccugcacagaucaagagacgggcaagugugaggcgaucuccauugaaaucgccucuuga

SEQ ID NO: 663 - RNA, 2577 nt, Artificial Sequence
  derived and/or modified CDS sequence (opt5) from Homo sapiens__NP_006635.2 __HsHSPH1
augagcguggucggccuggacguugggucccagucuugcuacaucgccguggcuagagccggaggcauugagaccaucgcgaacgaauuuagcgaucgguguacacccuccgugauuucuuuugggagcaagaaucgcacgaucggagucgcugccaaaaaccaacagauuacccacgccaauaacacaguguccaauuucaagagauuucauggccgggcuuucaacgacccuuuuauccagaaagagaaggaaaaucucucuuaugaucugguuccgcuuaaaaacgggggagugggcaucaaggucauguacaugggcgaggaacaccuguucagcguggagcagauuaccgccaugcuccugacaaaacuuaaagagaccgcugaaaauucccugaagaaacccguuacagacugcgugaucagcgucccuucuuucuucaccgaugccgagcgcagauccgugcucgacgcggcccaaauuguggggcugaacugucugcggcucaugaaugauaugacggcugucgcccugaacuauggaaucuacaagcaggaccuucccagccuggaugaaaaaccucgcauuguuguguuuguggacaugggccauucugcuuuccaggucuccgccugcgcguuuaauaaggggaagcucaaagugcugggaaccgccuucgaucccuuucuuggcgggaagaacuucgacgagaaacugguugagcacuucugugcugaauuuaagacaaaauauaagcucgaugccaaaagcaagaucagagcucugcugcggcucuaccaggagugcgaaaagcugaaaaagcugaugucuuccaauagcaccgaccuuccucucaacauugaguguuucaugaacgacaaagauguguccggaaagaugaaucgcucucaauuugaggaacugugcgccgagcuucugcagaaaaucgaagucccgcucuauagccugcuggagcagacacaucucaagguggaagacguuuccgccguggagaucgucggcggcgcuacccggauucccgcggugaaggaaagaaucgccaaauucuuugggaaggauauuagcacgacacugaacgcugacgaggccgucgcccgcggaugugcccuucagugcgcuauccugucuccugcguucaaagugagagaguuuuccguuaccgaugcugugcccuucccuauuagccucaucuggaaucacgacucugaagauacagagggcguccacgaaguguuuagccggaaccaugccgcccccuucuccaagguucugaccuuucuucgcagagggccguucgagcuggaggcuuuuuacucugacccucaaggagugcccuacccugaagccaaaaucggccgguucgucgugcagaaugugagcgcucagaaggauggggagaaguccagaguuaaagucaaggugcgcgugaacacccacggaauuuucacaaucagcacggccucuauggucgaaaaagugcccaccgaggaaaaugagauguccagcgaggcggacauggaaugucucaaccaacggcccccugagaauccggauacagacaagaacguucagcaggacaauucugaagccggcacccagccccaagugcagacagaugcucagcagaccucccaaagcccucccuccccugagcugacgucugaagagaacaaaauucccgacgccgauaaggcuaaugagaagaaagucgaccagccgccugaagccaagaaacccaagaucaaagugguuaacguggagcugccuauugaagcgaaucucgucuggcagcugggcaaggaucuucugaacauguauaucgagacagaagggaaaaugaucaugcaggacaagcucgagaaggagagaaacgaugccaaaaaugcuguggaagaguacguuuaugaauuucgcgacaagcugugcggacccuacgagaaauucauuugcgaacaagaucaucagaacuuucugcggcuucucaccgagaccgaggacuggcuguaugaagagggcgaagaucaggccaagcaggcuuacguggacaaacuggaggagcucaugaagaucgggacaccugucaaggugagauuccaagaagccgaggaacgccccaaaauguuugaggaacugggacagcggcuucagcacuaugccaagauugcugcggauuucagaaauaaagacgagaaguacaaccacaucgacgagagcgaaaugaaaaagguggagaaguccgucaaugaaguuauggaguggaugaacaaugugaugaacgcccaagcuaaaaagucucuggaucaggacccggugguccgcgcccaggaaauuaaaaccaagaucaaagagcucaauaacacaugugagccugugguuacgcagcccaagcccaagauugaaagcccuaaacuggagcggaccccgaauggccccaacaucgauaagaaagaagaggaccuggaagauaagaauaacuuuggggccgagccuccccaucaaaauggcgagugcuacccuaacgaaaagaacuccgugaauauggaccuugauuga

SEQ ID NO: 664 - RNA, 3000 nt, Artificial Sequence
  derived and/or modified CDS sequence (opt5) from Homo sapiens__NP_006380.1 __HsHYOU1
auggccgacaaggugagacggcagcgccccagacggcgcgucugcugggcucugguugccgugcuccuggcggaucuucuggcucucagcgacacccuggccgugauguccgucgaucuuggcucugagagcaugaaaguggccaucguuaagccuggggugccgauggaaaucguccugaacaaagaguccagacggaagacacccgugaucguuacgcucaaagaaaaugagcgcuucuuuggagacucugcugccagcauggcuauuaagaacccuaaggccacccugagauacuuccaacaucugcucggcaaacaggcggauaauccccacguggcccuguaucaggcucgguuuccugaacacgagcuuacauucgacccccagcgccaaaccguccauuuucagaucuccucucagcugcaguucagcccugaggaagugcucgggauggugcugaacuacuccagaagccuugccgaggauuuugcugaacaaccgauuaaggacgccgucaucacaguucccguguucuuuaaucaggcggagcggcgcgccgugcugcaggcugccagaauggcuggacucaaaguccugcagcugaucaacgauaauaccgccacagcccucucuuauggcguguuccggcgcaaggacauuaacaccacggcucaaaauaucauguuuuacgauaugggguccggaagcaccguuuguacaauugugaccuaucagauggucaaaacaaaggaggcgggcaugcagccucaacugcagaucagaggcgugggguucgaccggacccuuggaggccuggaaauggagcucagacugcgcgaacggcuugccgggcuguuuaacgagcagagaaagggacagcgcgcuaaagauguucgggaaaaucccagagccauggccaagcuccugcgcgaggcuaaccggcugaaaacggugcucucugccaaugcggaccacauggcucaaauugagggccugauggacgaugucgacuucaaggccaaagugacaagagucgaguucgaggaacuuugcgccgaucuguuugagcgcgugccugggcccguucagcaggcucuccaguccgccgaaaugagccuggacgagaucgagcaagugauucuugucggaggcgcuacccgggugccgagaguucaggaagugcugcucaaggccgucggcaaagaggaacuggggaagaacaucaaugcggaugaggccgcugccaugggagcuguguaccaggccgcggcccugucuaaggcuuucaaagugaagccuuuuguuguccgcgacgccgugguguaucccauccucgucgaguucacacgggagguggaggaagaaccuggcauucauucccugaaacacaacaagagaguucuuuuuagccggauggggcccuacccccagcgcaaagugaucaccuucaacagauacucccacgauuuuaauuuccauauuaacuauggagaccugggcuuucucgggccugaagaucugcgggucuucggaucucaaaaucugaccacagugaagcucaagggcguuggcgacagcuuuaaaaaguacccggauuaugaguccaaagggaucaaggcucacuucaaccucgacgagagcggagugcugucucuggacagagucgaauccguguuugagacgcucguugaagauagcgccgaggaagagucuacccugacaaaacuuggcaauaccauuagcucccuguucgggggaggcacaacccccgacgccaaggagaacgggacggauacagugcaggaagaggaagagucuccugcugaaggcagcaaggacgagcccggagagcaggucgaacucaaagaggaagcggaggccccuguggaagauggcucccagcccccgccucccgagccuaagggggacgcuacccccgagggagaaaaagccaccgagaaggaaaauggcgauaaaagcgaggcccaaaagccuucugagaaggcugaagccgggcccgagggaguggcgccggcuccugaaggcgagaaaaagcagaaacccgcccgcaagcggagaauggucgaagagaucgggguugagcugguggugcuggaccuucccgaucucccugaagacaaacuggcccaguccguccaaaagcugcaggaucucacacugcgcgaccuugagaaacaggaaagagagaaggcugccaacagccuggaagcguucaucuuugagacccaggauaagcucuaccaaccggaguaucaggaagugucuacagaggaacagcgggaggaaauuuccggcaaacugagcgcugccuccacguggcuggaggacgagggaguuggcgccaccacagugaugcuuaaggaaaaacucgcugagcugcgcaagcugugucaggggcuuuucuuuagagucgaagaacggaaaaaguggcccgagcgccugucugcccuugacaaucugcucaaccauagcuccauguuccugaagggagcuagacugaucccugaaauggaucaaauuuuuaccgagguggaaaugacaacccuugagaaaguuaucaaugaaacgugggccuggaagaacgcgacccucgccgagcaggcuaaacugcccgccacagagaagccugugcugcucucuaaagacauugaagcuaagaugauggcccuggaucgggagguccaguaccuucugaauaaggccaaauucaccaagccccgcccuagacccaaagacaagaacggcacacgggcugaaccgccucucaaugcgagcgccuccgaucagggggagaaagugauucccccugcuggacaaaccgaagacgccgagcccaucagcgagccggaaaagguugagacgggcucugaaccuggggauacagagccccuggaacugggcggaccuggcgccgagcccgagcagaaggaacaguccaccgggcaaaaacgcccccuuaagaacgacgagcuguga

SEQ ID NO: 665 - RNA, 2199 nt, Artificial Sequence
  derived and/or modified CDS sequence (opt5) from Homo sapiens__NP_005339.3 __HsHSP90AA1
augcccgaggaaacccagacacaagaccagcccauggaggaagaggaaguggagacguucgccuuucaggcugagaucgcccagcugaugagccucauuaucaacaccuucuacuccaauaaggaaauuuuucugagagagcuuaucucuaacagcuccgaugcgcuggacaaaauucgguaugaaucucucacagauccgagcaagcuggacuccggcaaagagcuucacaucaaucugauccccaacaagcaagaucgcacccucacaauugucgacaccgggaucggaaugacaaaagcugaucugauuaauaaccugggcaccaucgccaagucugggacgaaggccuucauggaggcucuccaggccggagcugacauuagcaugaucggccaguuugggguuggauucuacuccgccuaucugguggcggaaaaagugaccgucauuacaaagcauaaugaugacgagcaguacgccugggaaagcucugcuggcggcuccuuuaccgugagaacagauaccggggagccuaugggacggggcacgaaaguuauccuucaccugaaggaagaccaaacagaguaucucgaggaacgcagaaucaaagagauugugaagaagcauagccaguucaucggguaccccauuacccuguuugucgaaaaagagcgggauaaggaagugucugacgacgaggccgaggaaaaagaggauaaggaagaggaaaaagagaaggaggaaaaagaguccgaagacaagccugagaucgaggauguuggaagcgacgaagaggaagagaagaaagauggcgacaagaaaaagaaaaagaagauuaaagaaaaguauaucgaucaggaggagcuuaacaaaacaaagcccaucuggacccgcaauccugacgauauuaccaacgaagaguacggggaguucuacaaaucucugacaaaugacugggaggaucaccucgcugugaagcauuuuuccgucgaaggacagcuggaguucagagcccugcucuuugugccgcggcgcgcgcccuucgaccuguucgagaacagaaagaaaaagaauaacaucaaacuuuaugugcggcgcgucuuuauuauggacaauugcgaagaacugaucccugaauaccucaacuucauuagaggcguuguggauagcgaggaccugccccuuaacaucucccgggaaaugcugcaacagucuaagauccucaaagugauucgcaagaaucuggucaagaaaugucuggagcucuuuacggagcuggccgaagauaaggagaacuauaaaaaguucuacgaacaguuuagcaaaaauaucaaacuuggcauucacgaggacucccaaaacagaaagaagcugagcgagcuccugcgguauuacaccucugcuuccggggaugaaauggugagccuuaaggacuauugcacaagaaugaaagagaaucagaagcacaucuacuacauuaccggagaaacaaaagaucagguugccaacucugcuuucguggagcgccugcggaagcauggccucgaagucaucuauaugauugagccuaucgacgaguacugugugcagcaacugaaagaauuugaggggaagacccugguuagcgugacgaaggaaggacucgagcugcccgaagaugaggaggagaaaaagaaacaggaagaaaagaaaacaaaguucgagaaucuuugcaagaucaugaaagacauucuggaaaagaaagucgagaagguggucguguccaacagacucguuaccucuccguguugcaucgugaccagcacauauggcuggaccgccaauauggagcgcauuaugaaagcccaggcucugcgggauaacuccacaaugggguacauggcggccaagaagcaccuggaaaucaauccugaccauagcauuaucgagacgcuuagacagaaagcugaagccgauaagaacgacaaaucugucaaggaccucgugauccugcuguaugagaccgcccuccuguccagcggauuuucucuugaggauccccaaacacacgcuaaucgcauuuaccggaugaucaaacugggccucggcauugacgaagaugacccuaccgccgaugacacauccgcggcuguuaccgaggaaaugccuccccuggagggggaugacgauacgagcagaauggaagagguggacuga

SEQ ID NO: 666 - RNA, 339 nt, Artificial Sequence
  derived and/or modified CDS sequence (opt5) from Homo sapiens__NG_005218__HsHSP90AA3P
auggacagcuccaagcuggauucuggcaaagggcuccacaucaaccuggugcccaauaagcagaaccaaacccuuacaauugucgacacgagaaucggaaugaccaaaacagaucugauuaauaaccucggcaccguuacaaagagcgggaccaaagccuucauggaggcucugcaggccgacgcggauaucuccaugauuggacauuuuggcgugggguucuacucugcuuaucuuguggccaagaaggucacagugaucagcaaacacaauaacgacgaacaguacaccugggaguccucugccggaggcagcuuuacgguucggaccgaugaauga

SEQ ID NO: 667 - RNA, 2175 nt, Artificial Sequence
  derived and/or modified CDS sequence (opt5) from Homo sapiens__NP_031381.2__HsHSP90AB1
augcccgaggaagugcaccauggcgaggaagaggucgaaaccuucgccuuucaggcugagaucgcccaacugaugagccucauuaucaacacauucuacuccaauaaggagauuuuucugagagaacuuaucucuaacgcgagcgacgcucuggauaaaauucgguaugagucccucacggacccuucuaagcuggauagcgggaaagaacuuaagaucgacaucauuccgaauccccaggagcgcacccugacacucguugauaccggaaucggcaugacaaaagccgaccugauuaacaaucuggggaccaucgccaaguccggaacaaaggcuuucauggaggcccuccaggcuggcgccgauauuucuaugaucgggcaguuuggagugggcuucuacagcgcguaucugguggccgaaaaagucgugguuauuaccaagcacaacgacgaugagcaauacgcuugggaauccagcgccggcgggucuuuuacggugagagcugaccauggagagccuaucggccgggggaccaaagucauccuucaccugaaggaagaucagacagaguaucucgaggaacgcagagugaaagagguugugaagaagcauucccaguucauuggauaccccaucacccuguaucuugaaaaagagcgggaaaaggagauuagcgacgaugaggccgaagaggaaaaaggcgagaaggaagaggaggacaaagacgaugaagagaagccuaaaaucgaagacgucgggucugaugaggaggacgauuccggaaaggacaagaaaaagaaaacaaagaaaauuaaggaaaaguacaucgaucaggaggaacugaauaaaaccaagcccaucuggacgcgcaacccugacgauauuacacaagaggaauacggcgaguuuuauaaaagccucaccaaugacugggaggaucaccuggcggugaagcacuucucuguggaaggccagcuggaguuuagagcccuccuguucaucccgcggcgcgcucccuuugaccuuuucgaaaacaaaaagaagaaaaauaacauuaagcuguacgucagacggguuuucaucauggacuccugcgaugagcucauuccugaauaucugaauuuuauccgcggggugguggacagcgaggaucuuccccugaacaucuccagagagaugcuccagcagucuaaaauucugaaggucauccggaaaaauauugugaagaagugucuggaacucuucagcgagcuggccgaagacaaagagaacuacaagaaauuuuaugaggcuuucuccaagaaccuuaaacugggaauccaugaggauagcacaaaucgcagacggcucucugagcugcuuagauaccacaccucccaaagcggcgacgaaaugaccucucugagcgaguauguuucccgcaugaaggaaacacagaaaucuauuuacuacaucacgggggagagcaaggaacagguggccaacuccgccuuugucgaacgggugagaaagcgcggauucgagguuguguauaugaccgaaccuauugaugaguacugcguccaacagcucaaagaauuugacggcaagagccuggugucugucacaaaagaggggcuggagcuccccgaagaugaggaagagaagaaaaagauggaagaguccaaggcuaaauucgagaaucuguguaaacuuaugaaggaaauccuggacaagaaaguggagaagguuaccaucagcaaccggcucgugucuuccccgugcuguauugucacaagcaccuauggauggacggcgaauauggaaagaaucaugaaggcccaggcucugcgcgauaacuccacaaugggcuacaugauggccaaaaagcaucuggagauuaauccugaccaccccaucguggaaacccuucggcagaaagccgaggcugauaagaacgacaaagccguuaaggaccucgugguccugcuguuugagaccgcgcuccugucuagcggcuucucccuugaagauccucaaacacacucuaauagaauuuaucgcaugaucaagcuggggcucggaaucgacgaggaugaaguggcugccgaggagcccaacgccgcugugcccgacgaaauuccuccgcuggagggcgaugaagacgccagccggauggaggaaguugauuga

SEQ ID NO: 668 - RNA, 2412 nt, Artificial Sequence
  derived and/or modified CDS sequence (opt5) from Homo sapiens__NP_003290.1__HsHSP90B1
augagagcccugugggugcucggccugugcuguguccuucugaccuucgggagcguucgggcugacgaugagguggacguggauggaacagucgaagaggaccucggcaagucccgcgaagggucuagaacggaugacgaggugguucagcgggaagaggaggccauccaacuggauggacuuaacgcgagccagauucgcgaacugagagagaaauccgaaaaguuugcuuuccaggccgaggugaaucggaugaugaaacucaucauuaacucucuguacaagaauaaagagaucuuucugcgcgaacucauuagcaacgccuccgacgcucuggauaagaucagacuuaucucucugaccgacgagaaugcccucagcggcaacgaagaacugacagucaagauuaaaugcgauaaggagaaaaaucuucugcacgugaccgacacagggguuggaaugacccgggaggagcucgugaagaaccugggcacaaucgcuaaauccggcaccagcgaguuccugaauaagaugacggaggcccaggaagaugggcaaucuaccuccgagcucauuggacaguuuggcgucggguucuauagcgcguuucugguggccgacaaggugaucgucacaucuaaacauaacaaugacacccagcacauuugggaauccgauagcaacgaguucucuguuaucgcugacccccgcggaaauacacuuggcagagggaccacgauuacacuggugcucaaggaggaagccuccgauuaccuggagcuugacaccaucaaaaaccuggugaagaaauauagccaguuuaucaauuucccuauuuacgucugguccucuaagacagaaaccguggaggaaccgauggaggaggaagaggcugccaaagaagagaaggaggaaagcgaugacgaggcggccguugaagaggaagaggaggaaaagaaacccaagaccaaaaagguggagaaaacagucugggauugggaacucaugaacgacaucaagccuauuuggcaacggcccuccaaggagguggaagaggaugaguauaaagccuuuuacaagagcuucucuaaagaauccgacgauccuauggcuuauauccauuuuacggcugagggagaaguuaccuucaagagcauucuguucgugcccacaucugccccucgcggccuguuugacgaguacggcagcaaaaaguccgacuacaucaagcucuaugucagacggguguucaucaccgaugacuuucacgauaugaugccgaaauaccugaacuucgucaagggggugguugacucugaugaccuuccccugaaugugagccgcgaaacacuccagcagcauaaacugcuuaaggucauucggaaaaagcuggugagaaagacccucgauaugaucaaaaagauugccgacgauaaauauaacgacacguuuuggaaggaguucggaacaaauaucaaacugggcguuauugaggaucacuccaacagaacccgccuggcuaagcuccugcgguuucagagcucucaccauccuaccgacaucacaucccuugaucaauacguggaaagaaugaaagagaagcaggacaagaucuauuucauggcggggagcucucgcaaagaagccgaguccagccccuuugucgagcggcugcucaagaaaggauacgaagugauuuaucugaccgagccuguggacgaauacuguauccaggcucugcccgaguucgauggcaagagauuucaaaauguugccaaagaaggggucaaguucgacgaguccgagaagacaaaagaaucucgcgaggccguggaaaaggaguuugaaccgcuucucaacuggaugaaagauaaggcucugaaagacaagauugagaaggccguggucagccagcggcugacggaguccccuugcgcgcucguggcuucucaguacggauggagcggcaauauggaaagaaucaugaaagcccaggccuaucaaaccggcaaggauauuuccacaaacuacuaugcuagccagaaaaagaccuucgagaucaauccccgccacccucugauucgggacaugcuuagacgcaucaaagaagaugaggacgauaagacaguucuggaccucgccgugguccuguucgaaaccgcuacgcugcggucuggguaccuucuccccgauaccaaggccuauggagacagaaucgagcggaugcugcgccugucccucaacauugaucccgacgcgaaaguggaggaagaaccugaagaggagccggaagagacagccgaagacaccacagaggauaccgaacaggacgaggaugaggaaauggacguuggcacggaugaggaagaggaaacagcuaaggagagcaccgccgagaaagacgaacuguga

SEQ ID NO: 669 - RNA, 2115 nt, Artificial Sequence
  derived and/or modified CDS sequence (opt5) from Homo sapiens__NP_057376.2__HsTRAP1
auggccagagagcugcgggcucuccugcuuuggggccgcagacugcggccccuccugcgcgccccugcgcuugcugccgugcccgggggaaagccgauccugugcccuagacggaccacagcccagcucggcccccgcagaaacccugcuuggagccugcaagccgggcggcuguucuccacgcagaccgcugaagacaaagaggaaccccuccacucuauuaucagcuccacagagucuguccagggaagcaccuccaagcaugaauuucaggccgagacaaagaagcugcuugauauuguugcgcgcucucuguacagcgagaaagaaguguucaucagagagcucauuuccaaugccagcgacgcucuggaaaaacuucggcacaagcuggugucugauggccaagcccucccugagauggagauccaucugcagaccaacgcugaaaaagggacaaucaccauucaggacacgggaaucggcaugacccaggaggaacuggucuccaaucucggcacaauugcccgcagcgggucuaaggcguuucuggaugcccuucaaaaccaggcugaggccuccagcaaaaucauuggacaguucggcgugggguuuuauucugcuuucaugguugccgacagaguggaagucuacucccggagcgccgcuccgggaucccugggcuaucaguggcucucugaugggagcggaguguuugagaucgcggaggccuccggcguucgcaccggcacaaagauuaucauccaccugaaaagcgacuguaaggaguucucuuccgaggcuagagugcgggaugucgugaccaaguacagcaauuuugugucuuucccccuuuaucugaacgggagacgcaugaauacgcuccaagccauuuggaugauggacccuaaagauguccgggaauggcagcaugaggaauuuuacagauauguugcccaggcucacgacaagccccgcuacacacugcacuacaaaaccgaugccccucugaacauccggagcauuuucuaugugcccgacaugaagccguccauguuugacgugucuagagagcucggaagcuccgucgcgcuguacagccgcaaagugcuuauccaaacaaaggcuaccgauauucugccuaaauggcuccgguucaucagaggcguuguggacucugaggauaucccccugaaucuuucccgcgaacugcuccaggagagcgcccugauucggaagcugagagacguccuccagcagcgccugaucaaguucuuuauugaucaaucuaaaaaggacgccgaaaaauaugcuaaguucuuugaggauuacgggcuuuucaugcgggaaggaaucgugaccgccacagagcaggagguuaaagaagacauugcuaagcugcucagauaugaguccagcgcccugccuuccggccagcugacgucucuuagcgaauacgcgucccggaugcgcgccgggaccagaaacaucuauuaccucugcgcucccaaucggcaucuggccgagcacucucccuacuaugaggcuaugaagaaaaaggauacagaagugcuguuuuguuucgagcaguuugacgaacucacccugcuucaucugagagaguucgauaaaaagaaacucaucagcgucgaaacagacauuguggucgaccacuacaaggaggagaaguuugaagaucgcuccccugccgcggagugccugagcgaaaaagagaccgaagaacugauggccuggaugcggaacgugcuuggaucuagaguuacgaaugugaaggucacacuccgccuggacacccacccggcuauggugaccguucuggagaugggcgccgcuagacauuuccuccggaugcaacagcuggccaaaacacaggaggaacgcgcccagcuucugcaacccacccucgaaaucaacccuagacacgcucugauuaagaaacugaaucagcuucgggcguccgagcccggccucgcccagcugcugguggaucagaucuaugaaaacgcuaugauugccgccgggcucgucgacgauccucgcgcuauggugggaagacugaacgagcuucuggugaaggcccucgagcggcauuga

SEQ ID NO: 670 - RNA, 462 nt, Artificial Sequence
  derived and/or modified CDS sequence (opt5) from Homo sapiens__NP_000609.1__HsIGF1
augggcaagaucagcucccugcccacccagcuuuucaaaugcuguuuuugcgacuuccugaaggugaaaaugcacacaaugucuagcucccaucucuuuuaccuggcccucugucugcuuacguucaccucuagcgcuacagccgggccugagacccugugcggagcggaacucgucgaugcucugcaauuuguuuguggcgacagaggguucuauuuuaacaagccgacaggauacggcuccucuagccggcgcgcuccccagaccgggauuguggaugagugcuguuucagauccugcgaccugcggcgccucgaaauguauugugccccucugaaacccgccaagagcgccagaucugugcgggcucagcgccacacagauaugccuaagacccagaaagagguccaucuuaagaaugccuccagaggaagcgcgggcaacaaaaauuaccggauguga

SEQ ID NO: 671 - RNA, 543 nt, Artificial Sequence
  derived and/or modified CDS sequence (opt5) from Homo sapiens__NP_000603.1__HsIGF2
augggcauccccaugggaaagagcaugcuggugcuccugaccuuccuugccuuugcuuccugcuguauugccgcguacagaccuucugagacacugugcgggggcgaacucgucgacacgcugcaguucguuuguggggaucggggauuuuauuucagccgcccggcuuccagagugucucggcgcagcagaggcaucguggaggaaugcuguuuucgguccugcgaccuugcccugcucgagaccuacugugccacacccgcuaaaucugaacgcgaugucagcaccccucccacagugcugccugacaacuuccccagauauccuguugggaaguuuuuccaauacgauaccuggaaacaguccacacagcggcugcgcagaggacucccggcccugcuucgggcucgcagaggccacgugcuggccaaggagcucgaggcguuucgggaagccaaacgccauagaccccugauugcccuuccuacccaggaccccgcucacggcggggcuccucccgagauggccagcaaucggaaguga

SEQ ID NO: 672 - RNA, 639 nt, Artificial Sequence
  derived and/or modified CDS sequence (opt5) from Homo sapiens__NP_000591.1__HsIL6
augaacagcuucuccaccucugccuuuggccccguggcuuucagccuggggcuccugcuuguccugccugccgcguuuccggcucccguuccucccggagaggacuccaaggauguggccgccccucacagacagccccucacaucuagcgaacggaucgacaaacaaauucgcuacauccuggauggcauuuccgcucuuagaaaggagacgugcaauaaaucuaacaugugugaaagcuccaaggaggcccuggcugaaaauaaccucaaucugccuaaaauggccgagaaggacgggugcuuccagagcggauuuaacgaggaaaccugucuggugaagaucauuacaggccuccuggaguucgaagucuaucuugaguaccugcagaaucgguuugagucuuccgaagaacaggcgcgcgccgugcaaaugagcaccaaaguucucauccaguuccugcagaagaaagcuaagaaccuugaugccaucacaaccccggaccccacaaccaaugcuucucugcucacgaaacugcaggcccaaaaccaguggcugcaggauaugaccacacaucucauucugagauccuuuaaggaguuccuucagagcucucugcgggcgcuccgccaaauguga

SEQ ID NO: 673 - RNA, 1281 nt, Artificial Sequence
  derived and/or modified CDS sequence (opt5) from Homo sapiens__NP_002183.1__HsINHBA
augccccugcucuggcugagaggcuuccuucuggccagcugcuggaucauugugcgguccucuccuaccccggggagcgagggacacuccgcugcccccgacuguccuucuugcgcgcucgcugcccugcccaaggaugucccuaacagccagcccgaaaugguugaggccgugaaaaagcauauccuuaauaugcugcaccucaaaaagcgcccugacgugacacaaccgguccccaaagcugcccugcugaacgcuauuagaaagcuccaugugggcaagguuggggaaaauggauacguggagaucgaagaugacauuggccggcgcgccgagaugaacgagcugauggaacagacguccgagaucaucaccuuugcggaaucugggacagccagaaaaacccuucacuucgagauuagcaaggagggauccgaucugagcgucguggaacgggcugagguuuggcucuuucugaaagugccuaaggccaaucgcacaagaaccaaagucacaauccggcuuuuccagcagcaaaagcauccccagggcucucuggacaccggcgaagaggcugaagagguggggcucaagggagagcgcuccgaacugcugcucagcgagaaaguggucgaugccagaaagucuacguggcacguuuuuccuguguccagcucuauucagcggcugcuugaccagggcaaauccagccuggaugugcgcaucgcgugugaacaaugccaggaguccggggccucucucguccugcuuggaaagaaaaagaaaaaggaagaggagggcgaagggaagaaaaagggaggcggcgaagggggagcuggcgccgacgaggagaaagaacagagccacagacccuuccugaugcuccaggcucggcaauccgaggaucauccgcaccgcagacggagacgcgggcuggagugugacggaaaggugaacauuugcuguaaaaagcaguuuuucguuagcuuuaaggauaucggcuggaaugacuggauuaucgccccuucuggguaucaugccaacuacugcgaaggagagugucccucccacaucgcuggcaccagcggcucuagccuguccuuccacucuacagugauuaaucauuaucggaugagagggcacagcccuuuugcgaaccucaaauccugcuguguccccaccaagcugcgccccaugagcaugcuuuacuaugacgauggacagaauaucauuaaaaaggacauccaaaacaugauuguggaagagugcggcugcucuuga

SEQ ID NO: 674 - RNA, 1224 nt, Artificial Sequence
  derived and/or modified CDS sequence (opt5) from Homo sapiens__NP_002184.2__HsINHBB
auggacggccugcccgggagagcccucggagcugccugccugcuucugcucgcggcuggcuggcuggggccugaggccuggggaagcccgacacccccucccaccccugccgcucccccuccgcccccucccccuggcucccccgggggaucucaggauacguguaccagcugcggcggcuuccggcgcccggaggaacuugggagaguggacggagauuuucuggaagccgucaagcggcacauccucucccgccugcaaaugagaggccggccuaacauuacacaugcuguucccaaagccgcgauggugaccgcccugcgcaagcuccacgcugggaaagugagagaggacggacgggucgaaaucccucaucuggauggccacgccucucccggggcugacggacaggagcgcgugagcgagauuaucuccuucgccgaaacagauggccuugcgucuagcagaguucggcuguacuuuuucauuuccaaugagggcaaccagaaucucuuugugguccaggccagccuguggcuuuaucugaagcuccugcccuacgugcuggaaaaagggucucgcagaaagguucgggugaaggucuauuuccaagagcagggacauggcgaccgcuggaacaugguggagaaaagaguggaucucaagcgguccggguggcacaccuuuccucugacagaagcuauccaggcccuuuucgagagaggagaacgccggcugaaucucgacguccagugugauagcugccaagagcuggcuguugugccgguguuugucgaccccggcgaagagucucacagaccuuucgugguugugcaggcccgccuuggggauucccggcauagaauccgcaaacggggacuggagugugacggcagaaccaaccucugcugucgccagcaguuuuucauugacuuucggcugaucggcuggaaugauuggauuaucgcccccacgggguacuauggaaacuacugcgaaggcagcuguccugcuuaucuggcggggguccccggaucugccuccagcuuccacaccgcugugguuaaucaauacagaaugcgcggccucaacccggggacagucaauuccugcuguauuccuaccaagcugucuacaaugagcaugcuuuacuucgacgaugaguauaacaucgugaaacgggacgugcccaauaugauugucgaagagugcggcugcgccuga

SEQ ID NO: 675 - RNA, 3459 nt, Artificial Sequence
  derived and/or modified CDS sequence (opt5) from Homo sapiens__NP_000623.2__HsITGAM
auggcccugagagugcuccugcuuaccgcucugacacucugccacggcuucaaccuggacacggagaaugccaugaccuuucaggaaaacgcgcggggguucggacaaagcgugguucagcuucagggcucccgcgugguggucggggcuccccaggagaucguggccgccaaucaaagaggaucucuguaccagugugauuauagcacaggcuccugcgaaccuauucggcuccagguuccgguggaggcugucaacaugucucuggggcugagccucgccgcuaccacauccccuccucagcugcuugccuguggacccaccgugcaucaaacaugcucugaaaauaccuacguuaagggccuguguuuucucuucggcagcaaccugcgccagcagccucagaaauuucccgaggcgcuuagagggugcccucaagaggacuccgauaucgccuuccugauugacggaagcggcucuaucauuccgcacgauuuucggcgcaugaaggaguucguguccacggucauggaacagcucaaaaagagcaaaacccuguuuucucugaugcaguauuccgaagaguucagaauccauuuuacauucaaggaguuucaaaauaaccccaauccucggagccucgugaagcccaucacccagcugcuugggcgcacacacaccgcuacgggaauuagaaaagugguccgggaacuguucaacaucacaaauggcgcccgcaagaacgcuuucaaaauucucguugugaucaccgacggggagaaguuuggagauccucugggcuacgaagacgugauucccgaggccgauagagaaggcgucauccgguaugugauugggguuggagacgcguuccgcucugagaaauccagacaggagcuuaauacaaucgccagcaagccgccucgggaucauguguuucaggucaacaauuucgaagcucugaagaccauccaaaaccagcucagagagaaaauuuuugccaucgaaggcacccagacaggguccucuagcuccuucgagcacgaaaugagccaggagggauuuucugcugccauuacguccaacggcccccugcugagcaccguggggucuuacgacugggccggaggcguuuuccucuauacaagcaaggagaaauccaccuuuaucaauaugacacgcguggauucugacaugaacgacgcuuaccugggcuacgcggccgcuauuauccuucggaauagaguccaaagccuggugcucggggccccucgcuaucagcacaucggacuggucgccauguuccggcagaacaccggcaugugggaauccaaugcuaacgugaaggggacgcagauuggagccuacuuuggcgcgagccuuuguucuguugauguggacuccaaugggagcacagaucugguccucaucggcgcuccccauuauuacgagcaaaccagaggaggccaggugucuguuugcccccugccucgcgggcgggccagauggcagugugacgccgugcuguauggagaacagggccaaccgugggggcgcuucggagcugcccucaccguccugggcgaugugaacggggacaaacuuacagauguggcuauuggcgcccccggagaggaagacaaucggggcgcgguuuaccuguuucacgggaccuccggaagcggcaucuccccuucucauagccagagaauugccggguccaagcucucuccccgccugcaguauuucggacaaagccuguccggcgggcaggaucuuacaauggacggccucgucgaucugacggugggagcucagggccacgugcugcuccugcggagccagccuguccuuagagugaaagccaucauggaguucaacccccgggagguugcucgcaauguguuugaaugcaacgaccaagucgugaaggggaaggaggccggagaaguuagagugugucugcacguccagaaaucuacccgggacagacuccgcgagggccagauccaguccgugguuacauacgaucuggcgcuggacagcgggcggccgcauucuagagccguguucaaugagaccaagaacuccacacgcagacaaacccagguccuuggacucacgcagaccugcgaaacacugaaacugcagcucccuaauugcauugaggaucccgugagcccuaucgugcugcggcuuaacuuuucucuggucggcacaccccucagcgcuuucgggaaccugcgcccuguucuggccgaagacgcucaaagacuuuuuaccgcccucuuccccuuugagaagaauuguggcaacgauaauauuugccaggacgaucuguccaucaccuucagcuuuaugucucuggacugucucguggugggaggcccgcgggaguucaacgucacggugacaguucgcaaugauggggaagacuccuacagaacccaggugacauuuuucuuuccucuggaucuuagcuaucggaaagucuccacccugcaaaaccagcgcucucagagaagcuggcggcucgccugcgaguccgcuucuagcaccgaaguguccggagcgcugaagucuacaagcuguuccauuaaucaccccaucuuccccgagaacagcgaaguuacguucaauauuaccuuugacguggauucuaaggccucccugggcaacaaacuucuccugaaggcuaaugucacaagcgagaacaauaugccucgcaccaacaaaacagaguuccagcuggaacucccggugaaguacgccguuuauaugguggucaccucucaugggguguccacgaaauaccugaauuuuacagccagcgagaacaccucuagagugaugcaacaccaguaucaggucuccaaccuuggacagcggagccugcccaucucccucguuuuccuggugccugugagacugaaucaaaccgucaucugggaccgcccccaggugacauuuagcgaaaaccuuucuagcacaugccauaccaaggagcggcugccuucccacucugacuuccucgcugaacugagaaaggcccccguugugaauuguagcauugcggucugccagcgcauccagugugauauucccuuuuucggcauccaagaggaauuuaacgcuacgcucaaaggcaaucuguccuucgacugguacauuaagaccucucacaaccaucuucugaucgugagcacagccgagauccucuuuaaugauuccguuuucacccugcugcccgggcagggagccuucgugcggucucagacagagaccaaagucgaaccguuugaggugccuaacccccuuccucugauugucggcagcuccgucgggggacuccugcuccuggcucuuaucacggccgcgcuguauaagcucggcuucuuuaaaagacaguacaaggacaugaugagcgaagggggacccccgggcgcugagccucaauga

SEQ ID NO: 676 - RNA, 1404 nt, Artificial Sequence
  derived and/or modified CDS sequence (opt5) from Homo sapiens__NP_002415.1__HsMMP8
auguucagccugaagacccuccccuuucugcuucugcuccacgugcagaucuccaaagccuucccugucucuagcaaggagaaaaacacaaagacgguucaagacuaccuggaaaaauuuuaucagcuuccguccaaucaguaccagucuaccagaaagaacggcacaaaugugauuguggagaagcugaaagaaaugcaacgguucuuugggcucaacgucaccggaaagcccaaugaggaaacacuggauaugaugaaaaagccucgcugcggcgugcccgacagcgggggauucaugcugaccccuggcaaccccaaaugggagagaacaaaucucaccuaucggauccgcaacuacacgccucagcuguccgaggcugaaguugagagagccauuaaggaugcguuugaacuuuggucuguggcuagcccgcugaucuucacccggauuucccagggggaggccgacaucaauaucgccuuuuaucagcgcgaucauggagacaacagccccuucgauggcccuaauggcauucucgcucacgccuuucaacccgggcagggaaucggcggggacgcucauuucgaugccgaggaaacauggaccaacacaucugcgaauuacaaccuguuucuugucgccgcucacgaguucggacauucccugggccucgcccacagcucugacccuggggcucugauguaucccaauuacgccuucagagaaaccuccaacuacagccugccgcaggaugacauugauggaauccaggcgauuuauggccucucuuccaacccuauccaacccacgggcccuagcacacccaagcccugugacccuucccugaccuuugacgccauuacaacccuucggggagagauccuguucuuuaaagaucgcuacuucuggagacggcacccgcagcuccagcgcguggaaaugaauuuuaucucucuguucuggcccagccuuccuaccgggauucaagcugccuaugaggacuuugauagagaccugaucuuccucuuuaagggcaaccaguacugggcucuguccggguaugauauucugcagggauaccccaaagacaucagcaauuauggcuucccuucuuccguucaggccauugaugccgcuguguuuuaccggagcaagacauacuucuuugucaacgaccaauucuggcgcuaugauaaucagagacaguucauggagcccggguacccgaaaucuaucagcggagcguuuccuggcaucgaauccaagguggacgccguguuccagcaagagcacuuuuuccaugucuuuucuggcccccgguauuacgcuuucgaucucauugcccagagaguuacgcgcguggcccgggggaacaaauggcugaauugcagauauggauga

SEQ ID NO: 677 - RNA, 2124 nt, Artificial Sequence
  derived and/or modified CDS sequence (opt5) from Homo sapiens__NP_004985.2__HsMMP9
augagccuguggcagccccucgugcugguccuucugguucucggcugcuguuucgccgcuccuagacaacggcaguccacccuggugcuuuuuccgggggaccugcgcacaaaccucacggauagacagcuggccgaggaauaccuguaucgguacggauauacccgcguggcggagaugagaggcgaaucuaaaagccucgggcccgcucugcuucugcuccagaaacaacugucccuuccugagacaggagaacuggacucugccacccucaaggccaugcggacaccccgcugcggcgucccugaucuggggagauuccagaccuuugagggagaccugaaauggcaccaucacaauaucacauacuggauucagaacuauagcgaggaucucccccgggcugugaucgacgaugccuucgcucgcgccuuugcgcugugguccgccguuaccccucuuacguucaccagaguguacucucgggacgcugauauugucauccaguuuggcguggccgaacauggcgacggguauccguucgauggaaaggacggccugcucgcucacgccuuucccccugggcccgggauucaaggcgaugcgcauuucgacgacgaugagcuguggagccuugggaaaggaguuguggucccuacacgcuuuggcaaugccgacggcgcugccugucacuuccccuuuaucuucgaagggagauccuacagcgcuugcaccacagauggacggucugacggccugccgugguguuccaccacggccaacuacgauacagacgaucgcuucggguuuugcccuagcgagagacucuauacccaggacggaaaugccgauggcaagcccugucaguucccuuuuaucuuccaggggcaaucuuacuccgcuugcacaaccgacggacggagcgauggcuauagauggugugcgaccacagccaacuacgaccgcgacaagcuguuuggcuucugccccacgcgggcugauucuaccgugaugggaggaaauuccgccggcgagcuguguguguuucccuucacauuucucgggaaagaauauagcacaugcaccuccgagggaagaggcgacgggcgccuguggugcgccaccacgucuaacuucgauagcgacaagaaauggggcuuuuguccugaucagggauacucccuuuuccuggucgcugcccacgaauuuggccaugcgcucgggcuggaccacagcucuguuccggaggcucuuauguaucccauguaccgguucacagaaggaccuccccugcauaaggaugacgugaauggcauuagacaccucuacgggccucgccccgagccggagccucggcccccuaccaccacaacaccccagccuaccgcgcccccgacggugugcccuaccggaccucccacaguccaccccuccgaaagaccgaccgccggccccacagggccucccagcgcuggcccuaccggacccccuacggccggccccucuaccgcuacaaccgugccgcugagcccuguugaugacgccuguaacgugaauaucuucgaugcgauugccgagaucgggaaccaacuguaucucuuuaaagacggaaaguacuggcgcuucuccgaaggccgggggucuagaccccagggaccuuuucugauugcugauaaguggcccgcccuuccgcgcaaacuggacagcgucuucgaggaacggcucuccaagaaacuguuuuucuuuagcggcagacagguguggguuuauacaggggcuucugugcugggcccucggcgccuugacaagcucggacugggcgccgaugucgcccaggugaccggggcccugagauccggacggggcaaaaugcuccuguucagcgggagacgccuuuggcgguuugacgucaaggcucaaaugguggaucccagaucugccuccgagguugaccgcauguucccuggagugccccuggauacgcaugacgucuuucaguacagagagaaggcuuauuucugccaggaucgguuuuacuggcgcgugagcuccagaucugaacucaaucagguugaccaagugggcuaugucacauacgauauccugcagugucccgaggacuga

SEQ ID NO: 678 - RNA, 1416 nt, Artificial Sequence
  derived and/or modified CDS sequence (opt5) from Homo sapiens__NP_002418.1__HsMMP13
augcaccccggcgugcuggccgcuuuccucuuucugagcuggacccauugcagagcccuuccucugccguccgggggagacgaggaugaccucucugaagaggaucugcaguucgcggaacgguaccuucgcagcuauuaccaccccacaaaccuggcuggcauccucaaggagaaugccgccuccucuaugacggaaagacugcgggagaugcagagcuuuuucgggcuggaggucaccggaaaacucgacgauaacacacuggacguuaugaagaaaccucgcuguggcgugcccgaugugggggaauauaaugucuuuccuagaacccuuaagugguccaaaaugaaccugacauaccggauugugaauuauacccccgacaugacacauucugagguugaaaaggcuuucaagaaagccuuuaagguguggagcgaugucaccccucucaacuucacgcgccugcacgacggaaucgcugauauuaugaucuccuuuggcauuaaagagcauggcgacuucuacccguuugaugggcccagcggacuucuggcccacgcguucccucccggcccuaauuaugggggagacgcccacuuugacgaugacgagaccuggacaucuuccagcaagggcuacaaccucuuccugguggcugcccaugaguucgggcacucucugggacucgaucauuccaaagaccccggcgcucugauguuuccgaucuacaccuauacaggcaagagccacuucaugcuuccugaugacgauguucaagggauccagucucuguacggacccggcgacgaggauccuaaucccaagcaccccaaaaccccugacaagugcgauccgucccucagccuggacgccauuacgucccuuagaggggaaacaaugaucuuuaaagaccgguucuuuuggcgccugcauccccagcaaguggaugcggaacucuuccugaccaagucuuuuuggccugaacugcccaacagaauugacgccgcuuaugagcacccuagccaugaucucaucuucauuuuucggggacgcaaauucugggcccugaauggcuacgacauccuugagggguaucccaagaaaauuuccgaacugggacucccgaaggaggucaagaaaaucagcgcugccgugcacuuugaagauacaggcaagacccugcuuuucucuggcaaccagguguggagauacgacgauaccaaucauaucauggacaaagauuauccucggcugauugaggaagacuuucccgggaucggagauaaggucgacgccguuuacgagaaaaacggcuacauuuauuucuucaaugggccuauccaguuugaguacuccauuuggagcaaccgcaucgugagagugaugcccgcuaacucuauccucugguguuga

SEQ ID NO: 679 - RNA, 1068 nt, Artificial Sequence
  derived and/or modified CDS sequence (opt5) from Homo sapiens__NP_001286.1__HsCCR1
auggagacccccaacacaacggaagacuacgauaccacaaccgaguucgacuauggcgaugccacaccuugccagaaggugaaugaaagagcuuuuggggcccaacugcucccgccccuguacagccuugucuucguuaucggacuggugggcaacauucucgugguccuggugcuuguucaguauaaacggcugaagaauaugaccuccaucuaccuccugaaccuggcgauuucugaccuccuguuucuuuucacacugccuuuuuggaucgauuauaaacucaaggacgauuggguguucggggacgcuauguguaaaauucugagcggauuuuacuauaccggccuuuacuccgagaucuucuuuaucauucugcucacgaucgaucgcuaccuggccauuguccacgccguguucgcucugagagcccggaccguuacauuuggggugaucaccucuauuaucauuugggcucucgccauccuggcgagcaugcccggacuuuauuucuccaagacacagugggaauuuacccaucacacgugcucucugcauuucccucacgagagccuccgcgaguggaagcuguuccaggcccuuaaacugaaucucuuuggccugguccugccccuccuggugaugaucauuuguuacacaggcaucauuaagauccuucugagacggccuaacgagaaaaaguccaaagcugugcgccucauuuucgucaucaugaucaucuuuuuccuguuuuggaccccguauaaucuuacaauucugauuagcguuuuccaagacuuucucuucacccaugaaugcgaacagucuagacaccuggaucuggccguccaggugaccgaggugaucgcuuacacacacuguugcgugaaccccguuauuuaugccuuugugggggagcgguuccgcaaguaccucagacagcuguuucaucggcgcgucgcggugcaccuuguuaaguggcugccuuuccucuccguggacagacuggaacgggucagcucuacgucccccagcaccggagagcaugaacugucugccggcuuuuga

SEQ ID NO: 680 - RNA, 636 nt, Artificial Sequence
  derived and/or modified CDS sequence (opt5) from Homo sapiens__NP_002598.4__HsPDGFA
augagaacccuggccugccuccugcuucugggcuguggguaccucgcucacgugcuggccgaggaagcggagaucccccgggaagucauugagcgccuugcuagaagccagauccauuccauucgggaccugcaacgccuccuggaaaucgauucuguuggaagcgaggacucccuggauacaucucucagagcccacggcgugcaugccacgaagcacgugccugagaaacggccgcugcccauucgcagaaagcggagcaucgaagaggcugucccugccgugugcaaaacccgcacaguuaucuaugaaauucccagaucccagguggacccuaccucugcuaacuuccuuaucuggcccccuugugucgaggugaagcggugcacaggguguugcaauaccagcuccguuaaaugucagccgagccgcgugcaucacagaucugucaagguggccaagguggaguacguccggaaaaagcccaaacugaaggaaguucaggugcgccucgaggaacaccuggagugcgcgugugccacaaccucccuuaacccugauuauagagaagaggacacgggacggcccagagagagcggcaaaaagcgcaagcggaaaagacugaagccuaccuga

SEQ ID NO: 681 - RNA, 726 nt, Artificial Sequence
  derived and/or modified CDS sequence (opt5) from Homo sapiens__NP_002599.1__HsPDGFB
augaacagaugcugggcccuguuccucagccuguguugcuaccuucggcugguguccgcugagggcgaccccaucccugaggaacucuaugaaaugcugucugaucacagcauucgcuccuuugacgaucuucagagacugcuccauggggacccgggagaggaagauggcgccgagcuggaccugaauaugacccggucucacagcgggggagagcucgaaucccuggcgcgcggcagacggucucuugggagccugacaaucgcugagcccgccaugauugccgaauguaagacgcgcaccgaggucuucgagaucuccagacggcucauugaucgcacaaacgcuaauuuucugguuuggccucccugcguggaagugcaaagauguagcggaugcuguaacaaucggaacguccagugccgcccuacccaggugcagcuuagacccguucaagugcggaaaaucgagaucguccgcaagaaaccuauuuucaagaaagccacagugacccuggaagaccaucucgcuuguaagugcgagacaguugccgcggccagaccggugacccggucucccggcggcucccaggaacagagagcuaagacgccucagacccgcgucacaauccggaccgugagagugcgccggcccccuaaagggaagcacagaaaauuuaagcauacacacgauaaaaccgcccugaaggagacgcugggagcuuga

SEQ ID NO: 682 - RNA, 1038 nt, Artificial Sequence
  derived and/or modified CDS sequence (opt5) from Homo sapiens__NP_057289.1__HsPDGFC
augagccuguucggccuccugcuucugaccuccgcccucgcugggcagagacaaggaacacaggccgagucuaaccugagcuccaaguuucaguucucuagcaauaaagaacagaacggcgugcaagacccccagcacgagcggaucauuacggucuccaccaaugggucuauccauagcccucgcuuuccgcacacauaccccagaaacaccguucuuguguggcggcugguggcggucgaagagaauguguggauucagcucacauucgaugaacgcuuuggacuggaggacccugaggaugacaucugcaaguaugauuucguugaaguggaggaacccuccgacggcaccauucuggggagaugguguggaagcggcacagucccuggcaaacagaucucuaaggggaaccaaauccggauucgcuuuguguccgaugaguacuuccccagcgagccuggauuuugcauccauuauaauauuguuaugccgcaguucaccgaagcugugucucccuccguccucccucccagcgcccugccucuugaccugcucaacaaugccaucacggcuuuuucuacccuggaggaucuuauuagauaccuggaacccgagcgguggcagcucgaccuggaagaucuguaucgcccgacauggcagcuccugggcaaagccuucguguuugggagaaagucccggguggucgaccuuaaccugcucaccgaggagguucgccuguacagcuguacaccuagaaauuucuccgugucuauccgggaggaacuuaagcgcaccgauacgauuuucuggcccggaugccugcucgugaaaagauguggcgggaacugcgcuuguugccugcacaauuguaacgaaugccaaugugucccuagcaaggugaccaaaaaguaucaugagguucugcagcuccggcccaaaacaggagugagaggccugcacaagucccuuacagacgucgcccuggaacaccaugaggagugcgacugcgugugucgcggcagcaccgggggauga

SEQ ID NO: 683 - RNA, 1095 nt, Artificial Sequence
  derived and/or modified CDS sequence (opt5) from Homo sapiens__NP_149126.1__HsPDGFD
augcacagacugaucuucguguacacccucauuugcgccaacuuuuguagcugccgggacacauccgcuacgccccagucugccagcaucaaggcgcugcgcaaugcuaaccuuagacgggaugaccuguaucgcagagaugagaccauucaagucaaaggcaauggguacguucaguccccucgguucccgaacucuuauccccgcaaucuccugcuuacauggagacugcauagccaggaaaacacccggauccagcucguguuugacaaucaauucggacuggaggaagccgagaacgauauuugucgcuacgacuuuguggaagucgaggauaucuccgagacaucuaccaucauuagaggccgguggugcgggcacaaggaagugccuccccgcaucaaaagcagaacaaaucagauuaagaucaccuucaaauccgacgauuauuuuguugccaagccuggauucaagauuuacuauagccugcucgaggacuuucagcccgcugccgcuucugaaacgaacugggaguccgugaccagcucuaucuccggcgucagcuacaauucuccuuccgugacagauccgacccugauugccgacgcgcuugauaaaaagaucgccgaguucgacacaguugaagaccugcucaaauacuuuaaccccgagagcuggcaggaagaucuggagaauauguaucuugacaccccucgguaccgcgggagauccuaucaugaucggaagucuaaaguggaccuggauagacucaacgacgaugcuaagcgcuacagcuguacgccccggaauuauuccgucaacaucagagaggaacugaagcuggccaacgugguguucuuuccucgcugccuccugguccaacgguguggaggcaauugcggcugugggacaguuaacuggagaagcugcaccuguaauucuggaaaaacagugaagaaauaccacgaggugcuucaguucgaacccggccauauuaagcgccgggggagagcuaaaaccauggcccuggucgacauccagcucgaucaccacgagcgcugcgacugcauuuguuccagccggccgccuagauga

SEQ ID NO: 684 - RNA, 678 nt, Artificial Sequence
  derived and/or modified CDS sequence (opt5) from Homo sapiens__NP_003946.3__HsSOCS3
auggugacccacagcaaguuccccgccgcuggcauguccagaccucuggacacaucucuccggcugaaaacguuuagcuccaagucugaguaccagcuugucguuaacgccgugcgcaaacugcaagaaagcggguucuauugguccgcggugaccggaggcgaggcuaaucuccugcuuucugccgaaccggccgggacauuucugaucagagauagcuccgaccagcggcauuucuuuacccucagcgucaagacacagucuggaaccaaaaaccugcgcauucagugcgagggcggguccuucagccugcaaucugaucccagauccacacagccugugccccgguuugacuguguucucaagcuggugcaccauuacaugccucccccuggagcuccgagcuuccccucuccucccaccgaaccuuccagcgagguccccgagcagccguccgcccagccucuucccggcucuccuccccgcagagcuuauuacaucuauagcggcggggaaaagauuccccuggugcucucccggccucugagcucuaauguugccacgcuucaacaccugugccgcaaaaccgugaacggacaucucgauuccuacgagaaggucacacagcugccgggccccaucagagaauuucuggaccaguaugaugcgccucucuga

SEQ ID NO: 685 - RNA, 483 nt, Artificial Sequence
  derived and/or modified CDS sequence (opt5) from Homo sapiens__NP_003227.1__HsTGFA
auggugcccagcgccggccagcuggcucucuucgcccuggggaucguccuugcggcuugccaagcccuggagaacuccaccucuccucucagcgccgacccgcccguugcugccgcuguggugucccacuuuaaugauuguccugacucucauacacaguucugcuuucacggaacguguagauuccugguccaggaagauaagcccgccugcgugugucauagcggcuacguuggggcgcggugcgagcacgccgaccuucuggcuguggucgccgcuucccagaaaaagcaagccauuaccgcgcucgugguugugucuaucgucgcccuggcugugcugauuaucacaugugugcucauucauugcugucagguccgcaaacacugcgaaugguguagagcccugaucugccggcacgagaagccuagcgcccuucugaaaggacgcaccgcuugcugucauuccgaaacaguuguguga

SEQ ID NO: 686 - RNA, 1173 nt, Artificial Sequence
  derived and/or modified CDS sequence (opt5) from Homo sapiens__NP_000651.3__HsTGFB1
augcccccuagcggccugagacuccugccgcuucugcucccccugcuuuggcugcucgugcugaccccugggcggcccgccgcuggacuguccacaugcaagacgaucgacauggagcucgucaaacgcaagagaauugaagccauccggggccagauucugucuaaacuucgccuggcgagcccucccucccaaggggagguuccuccgggaccccucccugaagcugugcuggcccuuuacaacucuaccagagaucggguggccggcgagagcgcugaacccgagccugagcccgaagccgacuauuacgcuaaggaggucacacgcgugcugaugguugaaacccacaaugagaucuaugauaaauucaagcaguccacacauucuauuuacauguuuuucaacaccagcgagcucagagaagccgugccggagccuguccugcugucccgggcggaacuccgccugcuuagacugaagcucaaaguggagcagcacguugaacuguaucagaaguacagcaauaacucuuggcgguaucuuuccaaucgccugcucgcccccagcgacucuccugaguggcuguccuuugaugugacaggggucgugagacaauggcugagccggggaggcgagaucgaaggcuuccgccucucugcucauuguuccugcgacagcagagauaacacccuucagguggacaucaauggguuuacgaccggacggagaggcgaucuggccacaauucacgggaugaaccgccccuuccugcuccugauggcuacaccccuugagcgggcccagcaucugcaguccucuagacaccgccgggcgcucgacaccaauuacuguuuuagcuccaccgagaaaaacugcugugucagacaacuguacaucgauuuccgcaaggaccugggauggaaauggauucacgaaccuaagggcuaucaugccaauuuuugccucgggccgugucccuacaucuggagccuggauacgcaguauucuaagguucuugcucuguacaaccagcacaauccuggagccuccgcugcccccugcugugugccucaggcccucgaaccccugccgauuguguauuacgucggccggaaaccuaagguggagcaacugagcaacaugaucguuagaucuugcaaauguagcuga

SEQ ID NO: 687 - RNA, 1245 nt, Artificial Sequence
  derived and/or modified CDS sequence (opt5) from Homo sapiens__NP_003229.1__HsTGFB2
augcacuacugcgugcugagcgccuuccucauccugcaucuugucaccguugcucugucccucucuacauguagcacgcuggacauggaucaguuuaugagaaagcggauugaggccauccgcggccaaauucuuuccaaacugaagcucaccucucccccugaagacuauccggagcccgaagaggugccucccgaagugaucagcauuuacaacuccacaagagaucugcugcaggagaaagcgucucggcgcgcugccgccugcgagagagaacggagcgacgaggaauauuacgcuaaggaggucuauaaaaucgauaugccucccuucuuuccuuccgagaaugccaucccgcccaccuucuaccgcccuuauuuuagaauugugcgguucgacguuagcgcuauggaaaagaacgccucuaaucucgugaaggcggaguuucgcgucuucagacugcagaaccccaaagcccgggugccugaacagcgcaucgagcuuuaccaaauucugaaguccaaagaucucacaagccccacccagagauacaucgacucuaagguugugaaaacacgggcugaaggggaguggcuguccuuugaugucaccgacgccgugcacgaguggcuucaucacaaggaucgcaaucugggauucaagauuagccuccauuguccgugcuguacguuugugccuucuaacaauuauaucauucccaacaaauccgaggaacuggaagcuagauucgccggcaucgacgggaccagcacauacaccuccggagaucagaagacaaucaaaucuacccggaagaaaaauagcggcaagacgccucaucugcuccugaugcuucugcccuccuauagacucgagagccagcaaacaaaccgccggaaaaagagagcgcuggacgccgcuuacugcuuucgcaauguccaggacaacuguugccuucggccccuguauauugauuucaagagagaccucggguggaaauggauccacgaaccuaagggauacaaugccaacuucugugcuggcgccugcccguaucuguggucuuccgauacccagcacagccgcguucugucucucuacaauacaauuaaccccgaggccagcgcuuccccuuguugcgugucucaggaccuggagccccuuaccauccuguacuauauuggcaaaaccccuaagaucgaacaacucagcaacaugaucgugaaauccugcaaguguagcuga

SEQ ID NO: 688 - RNA, 1239 nt, Artificial Sequence
  derived and/or modified CDS sequence (opt5) from Homo sapiens__NP_003230.1__HsTGFB3
augaagaugcaccuucagagagcccucgugguccuggcucugcugaacuucgccaccguuagccucucccugucuacaugcacgacccuugacuuuggccauaucaaaaagaaacggguggaggcgauucgcgggcaaauccugagcaagcucagacugacaucucccccugaaccgaccgugaugacacacguccccuaccaggugcuggcucucuauaauuccacccgggagcugcuugaagagaugcauggagaacgcgaggagggcuguacacaggaaaacaccgagagcgaauacuaugccaaagagauucacaaguucgauaugauccaggggcuggccgagcauaaugaacucgcuguuugcccuaagggaauuacguccaaaguguuuagauucaacgucucuagcguggagaagaaucggaccaaccuguuucgcgccgaguucagaguucuucgggugcccaauccuuccagcaaacgcaacgaacaaagaaucgaacuguuucagauccuccggcccgacgagcacauugcuaagcagcgcuacaucggcgggaaaaaucugccuacaagaggaaccgccgaguggcugucuuucgaugucacagacaccgugcgggaauggcuccugcgcagagaguccaaccuuggccuggaaauuagcauccacuguccgugccauacguuucagcccaauggcgauauucucgagaacauccacgaagugauggagauuaaguucaagggggucgacaaugaggaugaccauggacggggcgaucuggggagacuuaaaaagcaaaaagaccaccacaacccucaucugauccucaugaugauucccccucaccgccuggauaaucccggacagggcgggcagcggaagaaaagagcgcuggacacaaacuauuguuuucgcaaccucgaagagaauugcuguguucggccgcuguacaucgauuucagacaggaccuuggauggaagugggugcaugaaccuaaaggcuauuacgccaacuuuugcucuggccccuguccuuaccugcgcuccgcugacaccacacacagcaccgugcucgggcuguauaauacccuuaaccccgaggccucugcuucccccugcugugucccucaagaucuggaaccgcucacaauccuguacuaugugggacggacgcccaagguugagcagcugagcaauaugguggucaaguccugcaaaugcucuuga

SEQ ID NO: 689 - RNA, 1386 nt, Artificial Sequence
  derived and/or modified CDS sequence (opt5) from Homo sapiens__NP_001057.1__HsTNFRSF1B
auggcccccguggcugucugggccgcgcuggcuguuggccucgagcugugggccgccgcucacgcccuuccugcucagguggccuucaccccguacgcgcccgaaccugggagcacaugcagacugcgggaguauuacgaccaaacggcccagauguguugcuccaaguguucucccggacagcaugcuaaaguguuuugcaccaagacaagcgauaccgucugugacuccugcgaagauucuacauauacccagcucuggaacugggugccugagugucugagcugcggcucccgcuguucuagcgaccaaguugaaacacaggccugcaccagagagcagaaucggaucuguacgugccgccccgggugguacugcgcucuuuccaaacaggagggauguagacugugcgccccucuccggaagugucgcccgggcuucgggguggcgagacccggaaccgaaacaagcgaugucgugugcaaaccuugugcccccggcaccuuuucuaacacaaccuccagcacggacauuugccggccucaccaaaucuguaauguuguggcuauucccggcaacgccucuauggaugcugucugcacauccaccagcccgacacgcucuauggccccuggggccgugcaucugccccagccuguguccaccagaagccagcacacccagcccacacccgagccuuccacggcuccgucuaccagcuuccugcuccccaugggaccuuccccucccgcggaaggcagcacaggggacuuugcccugcccgucggacuuaucguuggcgugaccgcucuggggcuccugauuaucggaguggucaauugugugaucaugacacaaguuaagaagaaaccgcuuugccugcagcgggaggccaaggugccucaucuccccgccgauaaagcucgcggcacccagggcccugagcaacagcaucugcugauuacggcccccucuuccagcucuagcucccucgaaucuagcgcguccgcucuggacagacgggccccuacacgcaaccagccccaggccccgggggucgaggcuagcggagccggcgaagcuagagccucuaccggguccagcgauucuuccccuggaggccacgggacccaagugaauguuacauguaucgugaacgucugcagcuccucugaccacagcucccagugcucuagccaggcguccagcaccaugggagauacagacucuucccccagcgagucucccaaggacgaacaggugccuuucuccaaagaggagugugccuuucggagccaacuugaaacgccggagacccugcucggcucuacagaagagaagccccugccucuuggcguccccgaugcugggaugaagccuagcuga

SEQ ID NO: 690 - RNA, 513 nt, Artificial Sequence
  derived and/or modified CDS sequence (opt5) from Homo sapiens__NP_002623.2__HsPGF
augcccgugaugagacuguucccuugcuuucuccagcugcuugccggccuggcucucccggccguucccccucaacagugggcgcugagcgcugggaacggauccucugaggucgaaguggugcccuuccaggaggucuggggccggagcuacugucgcgcccuugaaagacugguggacguuguguccgaguauccuucugaagucgagcacauguuuagccccuccugcgugucucuccugcgguguaccgggugcuguggagaugagaaucugcauugcguuccuguggaaacagccaacgucacgaugcagcuccugaagauccgcagcggcgacagaccguccuacguggagcuuaccuucagccaacacgugcggugugaaugccgcccccugagagagaaaaugaagccugagcggcgcagacccaaagggcggggaaagcgcagacgggaaaaacagcgcccuacagauugucaucucugcggcgacgcuguccccagacgguga

SEQ ID NO: 691 - RNA, 1239 nt, Artificial Sequence
  derived and/or modified CDS sequence (opt5) from Homo sapiens__NP_001020537.2__HsVEGFA
augaccgacagacagacagauacggcccccagcccuuccuaccaccuucucccgggccggcgcagaaccguggacgcugccgcgucucgggggcaaggacccgagccugcucccggcgggggagucgaaggcguuggggcccgcggaguggcccugaagcuguucgugcagcugcucggcugcagcagauuuggcggggcugucgugcgggccggagaggcugaaccuuccggcgccgcgcgcucugccagcuccgggagagaggaaccccagccugaggagggagaagaggaagaggagaaagaagaggaacggggcccgcaguggcgccugggggcuagaaagcccggaucuuggacaggcgaggccgcuguuugugccgauagcgcgccugccgcucgggcuccccaagcccuugcccgcgccuccggcagagggggacggguggcucgcagaggcgcggaagagagcgggccuccccauucuccgucccggagaggaagcgccucucgcgcuggcccugggcgggccuccgagaccaugaacuuccugcucagcuggguccacuggucucuggcccugcuccuguaucuucaucacgcuaaauggucccaggccgcgcccauggcugaaggaggcggccagaaucaucacgaggugguuaaguuuauggacguguaccagagaagcuauugccacccuaucgaaacacuggucgauauuuuccaagaguaccccgacgaaaucgaguauauuuuuaaacccuccugugugccucucaugcgcugcgggggauguugcaacgaugagggccuggaaugugugccgaccgaggaaucuaauaucacaaugcagauuaugcggaucaagccccaucaggggcagcacaucggagagaugagcuuccuucaacauaacaagugcgaauguagaccuaaaaaggaccgcgcccggcaggagaaaaaguccgucagaggcaaagggaagggccagaagcgcaaacggaagaaaagcagauacaagucuugguccguuuaugugggagcccgcugcugucugaugcccuggagccucccuggcccccacccgugcgggccuugcucugagcggagaaaacaccuguuugugcaagauccccagaccuguaagugcagcuguaaaaauacggacucccggugcaaggcucgccagcuggaacucaacgagagaaccugucggugcgauaagccuagacgcuga

SEQ ID NO: 692 - RNA, 699 nt, Artificial Sequence
  derived and/or modified CDS sequence (opt5) from Homo sapiens__NP_001165094.1__HsVEGFA
augaacuuccugcucagcugggugcacuggucccuggcccuucugcucuaccugcaucacgcuaaguggucucaggccgcgcccauggcugagggcgggggacaaaaucaucacgaagucguuaaauuuauggacguguaucagagaagcuacugccauccuaucgagacccuuguggauauuuuccaggaauauccggacgagaucgaauacauuuuuaagcccuccugugucccucugaugcggugcggcggguguugcaacgaugagggacucgagugugugcccacagaagagucuaauaucacgaugcagauuaugcgcaucaaaccucaccaaggccagcacaucggggaaaugagcuuccugcagcauaacaagugcgaguguagacccaaaaaggaccgggcccgccaggagaagaaauccguuagaggaaagggcaaaggccaaaagcggaaacgcaagaagucuagauauaaaagcugguccguguacgucggggcccggugcugucugaugccuuggagccucccgggaccccacccuugcggccccuguucugaacgcagaaagcaucuguuugugcaggauccucagaccugcaaaugcuccuguaagaauacagacagccggugcaaagcucgccagcuugagcugaacgaaagaaccugucggugcgauaagccccgcagauga

SEQ ID NO: 693 - RNA, 624 nt, Artificial Sequence
  derived and/or modified CDS sequence (opt5) from Homo sapiens__NP_003368.1__HsVEGFB
augagcccccugcucagacggcugcuucuggccgcucuccugcagcuugccccugcgcaagcuccggugucccagcccgacgccccuggccaccagcgcaaggucguuucuuggaucgauguguacaccagagccacaugccagccccgggagguggucgugccucugacgguugaacucauggggaccguggcuaagcaacugguccccagcugugugacaguucagcgcugcggaggcuguugcccugacgaugggcuggagugugugccgaccggacagcaucaggucagaaugcaaauucucaugauccgguaucccuccucucagcugggcgaaaugagccuugaggaacacucccagugcgagugucgcccuaagaaaaaggacucugccgugaaacccgauagagcugccacaccucaucaccggccccagccgcgcagcgugccugggugggacuccgcgcccggagccccuagccccgcugauauuacccaucccaccccugccccgggccccucugcucacgccgcgccuuccacaacgagcgcccugacccccggcccugcugccgcugccgccgacgcugcggccucuuccgucgcuaaagggggagccuga

SEQ ID NO: 694 - RNA, 1260 nt, Artificial Sequence
  derived and/or modified CDS sequence (opt5) from Homo sapiens__NP_005420.1__HsVEGFC
augcaucugcucggcuucuuuagcguggccugcucccugcuugcugccgcgcugcuccccgggccuagagaggcuccggccgccgcugccgcuuucgaaucuggacuggaccuuagcgaugccgagcccgacgcgggcgaagccaccgcuuacgccuccaaggaucuggaggaacagcuccggucugucagcuccguugacgagcugaugacagugcuguauccugaguacuggaaaauguauaagugucaacuccgcaaagggggauggcagcacaacagagaacaggcuaaucugaacucucggacggaggaaaccaucaaguuugccgcggcccacuacaauacagagauucuuaaaagcaucgauaacgaguggcgcaagacccagugcaugcccagagaaguguguauugacgucggcaaggaguucgggguggcuacaaauaccuuuuucaaaccucccugcguuuccguguaucgguguggaggcugcuguaacagcgaaggccugcaaugcaugaauacaucuaccuccuaccucagcaagacgcuguuugagaucaccgucccucuuucucaggggccgaaacccgugacaauuuccuucgccaaccauaccagcugucgcugcaugucuaagcuggauguuuauagacaggugcacuccaucauccggcgcagccucccugcuacacugccccagugucaagccgccaauaaaaccugcccuacgaacuacauguggaauaaccauauuugcagaugucuggcucaggaagacuuuauguucuccucugaugcgggagacgauagcacagacggcuuucacgauaucugcgggcccaauaaggagcucgacgaggaaaccugucagugcgucugucgggccggacugcgcccggcuuccugcggcccucacaaggagcuugacagaaacagcugucagugcguguguaaaaauaagcuguuccccucucaaugcggggccaaccgggaauuugaugagaacacaugucagugcgugugcaaacgcaccuguccuagaaaucagccccucaaccccggaaagugcgccugugaaugcaccgaguccccucaaaaaugucugcuuaagggcaaaaaguuccaucaccagacaugcagcuguuaccggagaccgugcacgaaucgccagaaggcuugugagcccggcuucucuuauagcgaagaggucugccgguguguuccuuccuacuggaaaagaccccagaugucuuga

SEQ ID NO: 695 - RNA, 1065 nt, Artificial Sequence
  derived and/or modified CDS sequence (opt5) from Homo sapiens__NP_004460.1__HsVEGFD
auguacagagaguggguggucguuaacguguucaugaugcuguaugugcagcucguccaaggcagcuccaaugaacacgggcccgugaagcggucuagccaguccacccuggagcgcucugaacagcagaucagagccgcuagcucccuugaggaacugcuccggauuacacauucugaggacuggaaacuguggcgcugcagacuucggcucaagagcuuuacguccauggauagccgcucugccucccacagaagcacccgguucgcggcuacauuuuacgacaucgagacccugaaaguuauugaugaagaguggcaacgcacacaguguucuccuagagaaaccugcguggaggucgccuccgagcugggaaagagcacaaacaccuucuuuaaaccgcccugugugaauguuuuccggugcggcggguguugcaacgaagagucucugaucuguaugaauacguccaccagcuauauuuccaagcagcucuuugaaaucucugugccucugacaagcguccccgagcuugugccugugaaggucgccaaccauaccggaugcaaaugucugcccacagcuccucgccacccguacuccaucauuagacggagcauccagauucccgaagaggaccgcugcucucauuccaagaaacucuguccuaucgauaugcugugggacagcaauaagugcaaaugcguucuucaagaggaaaacccccuggccggcaccgaggaucacucucaccuccaggaaccugcucugugugggccccauaugauguucgacgaggauagaugcgaaugugugugcaagacgccguguccuaaggaccugauucagcaccccaaaaauugcagcuguuuugagugcaaggagucccucgaaacauguugccagaaacauaagcuguuccacccugauaccuguucuugcgaggaccggugccccuuucacacaagacccugugccagcggaaaaaccgcgugcgccaagcauugucgcuucccuaaagaaaagcgggcugcccaaggcccgcacuccagaaagaaccccuga

SEQ ID NO: 696 - RNA, 72 nt, Artificial Sequence
  derived and/or modified CDS sequence (opt6) from Homo sapiens__AAA59606.1__signal peptide-HLA-A2-SP
auggcaguaauggcaccaagaacauuaguacuacuacuaucaggagcacuagcacuaacacaaacaugggca

SEQ ID NO: 697 - RNA, 69 nt, Artificial Sequence
  derived and/or modified CDS sequence (opt6) from Homo sapiens__AAA61213.1__signal peptide-HsPLAT
auggaugcuaugaaaagagguuuauguuguguuuuauuauuauguggagcuguauuuguaaguccaagu

SEQ ID NO: 698 - RNA, 81 nt, Artificial Sequence
  derived and/or modified CDS sequence (opt6) from Homo sapiens__NP_000790.2__signal peptide-HsEPO
auggguguacaugaauguccagcuuggcuuuggcuuuuacuuucacuuuuaucuuuaccuuuagguuuaccuguacuugga

SEQ ID NO: 699 - RNA, 54 nt, Artificial Sequence
  derived and/or modified CDS sequence (opt6) from Homo sapiens__NP_000468.1__signal peptide-HsALB
augaaauggguuacuuuuauuucucuucuuuuucuuuuuucuucugcuuacucu

SEQ ID NO: 700 - RNA, 18 nt, Artificial Sequence
  derived and/or modified CDS sequence (opt6) from Artificial____cleavage site-Furin
agaaggaggagaaaaaga

SEQ ID NO: 701 - RNA, 630 nt, Artificial Sequence
  derived and/or modified CDS sequence (opt6) from Homo sapiens__NP_061986.1__HsFGF21
auggacucagacgaaacaggauuugaacacucaggauuauggguaucaguauuagcaggauuacuacucggagcaugccaagcacacccaaucccagacucaucaccauuauuacaauucggaggacaagucagacaacgauacuuauacacagacgacgcacaacaaacagaagcacauuuagaaauaagagaagacggaacaguaggcggagcagcagaucaaucaccagaaucacuacuacaacuaaaagcacuaaaaccaggaguaauacaaauauuaggaguaaaaacaucaagauucuuaugccaaagaccagacggagcacuauacggaucauuacacuuugauccagaagcaugcucuuucagagaacuacuacuagaagacggauacaacguauaccaaucagaagcucauggacuaccuuuacaccuaccaggaaacaaaucaccacacagagauccagcucccagaggacccgcaagauuccuaccauuaccaggauuaccaccagcauuaccagaaccaccaggaauacuagcaccacaaccaccagacguaggaucaucagacccauuaucaaugguaggaccaucacaaggaagaucaccaucauacgcaucauaa

SEQ ID NO: 702 - RNA, 1410 nt, Artificial Sequence
  derived and/or modified CDS sequence (opt6) from Homo sapiens__NP_002412.1__HsMMP1
augcacucauuuccaccacuauuauuacuacuauuuuggggagucguaucacauagcuuucccgcaacacuagaaacccaagaacaagacguagacuuaguacaaaaauaucuagaaaaauacuauaaccucaaaaacgacggaagacaagucgaaaaaagaagaaacagcggaccaguuguagaaaaacuaaaacaaaugcaagaauuuuucggauuaaaaguuacuggaaaaccagacgcagaaacacuaaaaguaaugaaacaaccaagaugcggaguaccagauguagcacaguucguauuaacagaaggaaacccacguugggaacaaacacaucuuacauacagaauugaaaauuacacaccugaccuaccaagagcagacguagaccacgcaauagaaaaagccuuucaauuauggucaaacguaacaccauuaacauucacaaaaguuucugaagggcaagcagacauaaugaucucauuuguuagaggagaccaccgagacaauagcccauucgacgggccaggaggaaaccuagcacaugcuuuccaaccaggaccuggaauaggaggcgacgcacauuucgacgaagacgaacgauggacaaacaauuucagagaauacaaccuacauagaguagcagcccacgaauuaggccacagccuaggcuuaucacacucaacagacauuggagcucuaauguacccuuccuacacauuuucaggagacguacaauuagcccaagacgauauagacggaauacaagcaauauacggacgaucacaaaacccaguacaaccaauaggaccacaaacaccaaaagcaugcgacucaaaauuaacauuugacgccauaacaacaauaagaggagaaguaauguuuuucaaagaccgauuuuauaugagaacaaauccauucuacccagaaguagaauuaaacuuuauaaguguauucuggccucaauuaccaaacggauuagaagcagcauaugaauuugcagacagagacgaaguacgauucuuuaaaggaaauaaauacugggccguacaaggacaaaacguauuacauggauacccaaaagacauauacagcucauucggguuuccaagaacaguaaaacacauagacgccgcauuaucagaagaaaacacaggcaaaacauauuuuuucguagcaaacaaauacuggagauacgacgaauacaaaagaucaauggacccaggauauccaaaaaugauagcacacgauuucccuggcauugggcacaaaguagaugcaguauucaugaaagauggcuuuuucuacuucuuucacggaacucgacaauacaaauucgacccaaaaacaaaaagaauacucacacuacaaaaagcaaacaguugguucaauuguagaaaaaacuaa

SEQ ID NO: 703 - RNA, 1170 nt, Artificial Sequence
  derived and/or modified CDS sequence (opt6) from Homo sapiens__NP_002412.1__HsMMP1(1-19,100-469)
augcauucauucccaccacuacuauuauuauuauucuggggaguaguaucacauucauuuguacuaacugaaggaaauccuagaugggaacaaacucacuuaaccuauagaauagaaaacuauacaccagaccuaccaagagccgacgucgaccacgcaauugaaaaagcauuccaauuauggaguaacguaacaccacuaacauucacaaaaguaucagaaggacaagcagacauaaugauaucauuugucagaggagaccaccgagacaacucaccauuugacggaccuggaggaaaucucgcacacgcauuccaaccaggaccaggaauaggaggagacgcacauuuugaugaagaugaacgauggaccaacaauuuuagagaauacaaccuacaccgaguagccgcacacgaacucggacacagccuaggacuaucacacucaaccgacaucggagcacuaauguacccaucauacacauucuccggagacguccaacuagcucaagacgacauagacggaauacaagcaauauacggaagaucacaaaauccuguacaaccaauaggaccacaaaccccaaaagcaugcgacucaaaauuaacauuugacgcaauaaccacaauuagaggugaaguaauguuuuucaaagauagauuuuacaugagaacaaaucccuucuauccagaaguagaauuaaauuucauaucaguauucuggccacaacuaccaaauggauuagaagcagcauacgaauuugcagauagagacgaaguaagauucuucaaaggcaacaaauacugggcaguacaaggccaaaacguacuacacggauauccuaaagacauauacucuuccuuuggauuuccuagaacaguaaaacacauagaugccgcacuaucagaagaaaacaccggaaaaacauacuucuucgucgccaauaaauacuggagauacgacgaauauaaacgaucaauggacccagguuacccaaaaaugauagcacacgauuucccaggaauaggacacaaaguugacgcagucuuuaugaaagacggauuuuucuacuucuuucacggaacacgacaauacaaauucgaucccaaaacuaaaagaauccuaacuuuacaaaaagccaauucuugguuuaauuguagaaaaaacuaa

SEQ ID NO: 704 - RNA, 3357 nt, Artificial Sequence
  derived and/or modified CDS sequence (opt6) from Clostridium histolyticum__BAA77453.1__ColG
augaaaaaaaacauacucaaaauucuaauggacucauacucgaaagaaucaaaaauacaaacaguccgcagaguuacaucagucucguuacuagcaguauaccugacgaugaacacauccucguuaguacucgcuaaaccuauagaaaauaccaacgauaccaguauaaaaaacguagaaaaauuaagaaaugcaccaaacgaagaaaacaguaaaaaaguagaagacaguaaaaaugacaaaguagaacauguaaaaaacauagaagaagcaaaaguugaacaaguagcaccagagguaaaauccaaaagcacauuaagaagcgcgucaaucgccaacacaaauucagagaaguacgacuucgaauacuuaaacggauuaaguuauacagaacuaacaaaucucauuaaaaauaucaaauggaaccagauaaauggacuauuuaauuacucaacaggaucacaaaaauuuuucggagacaaaaauagaguacaagcaauuauaaacgcuuuacaagaaagcggacgaacguauacagcaaacgauaugaaaggaauugaaacauucacagaaguacuacgcgcugguuuuuaucugggcuauuauaacgacggacuaucauaccucaacgaccgaaacuuccaagauaaaugcauaccagcgaugauugcaauucaaaaaaacccaaacuuuaaacuaggaaccgcaguccaagaugaaguaauaacgucgcucggaaaacuaauaggaaaugcaagcgcuaaugcagaaguuguaaauaacuguguucccguacuaaaacaauuccgagaaaauuuaaaucaauacgcaccagauuacgucaaaggaacggccguuaaugaacuuaucaaaggaauagaauuugauuucucaggagcagcuuaugaaaaagacguaaagacuaugccaugguacggaaaaauagaucccuuuauaaaugagcugaaggcacuaggccuuuacggaaacaucacaucagcuacagaaugggcgucagaugucgggauauacuaucuaucaaaauucggacuuuacucaaccaaccgaaaugauauaguacaauccuuagaaaaagcaguagauauguauaaauacggaaaaauagcuuucgucgcaauggaacgaaucacaugggauuaugacgguauaggaagcaauggaaaaaaaguagaucaugacaaauuccuagaugacgcagaaaaacauuaccuccccaaaacauacaccuucgauaacggcacauucauaauaagagcuggagacaaaguaucagaagaaaaaaucaaacguuuauacugggcaucacgagagguuaaaucacaauuccauagaguagucgguaaugacaaagcauuagaaguaggcaaugcagacgacguacucacaaugaaaauauucaauucuccugaagaauauaaauuuaauaccaacauuaacggaguaucuacagacaauggaggccuuuacauagaaccaagaggaacguucuauaccuacgaaagaacaccacaacaaucaaucuuuucauuagaagaacuauuuagacacgaauacacacacuaucugcaagcacgauaccugguggauggacuauggggacaagggccauuuuaugaaaaaaaccgcuuaacaugguuugaugaaggcacagccgaauuuuucgcaggaucaaccagaacaucgggugucuuaccacggaaaucaauacucggguacuuagcaaaagacaaaguagaucauagauauucauuaaaaaaaacacuaaauaguggauaugaugacucggauuggauguuuuacaacuaugguuuugcgguagcacauuauuuauaugaaaaagauaugcccacauucauaaaaaugaacaaagcuauauuaaauaccgauguaaagagcuaugaugaaauaauaaaaaaacucagugaugaugcaaauaaaaacacugaauaucaaaaccacauacaagaacuagcagacaaauaccaaggagcagguauuccguuaguuucagaugauuacuuaaaagaccacggauauaaaaaagcaucagaaguauacagugaaauaucgaaagcagccagccuuacaaacaccucaguaacagcagagaaaagucaauauuucaacacauuuacacuaagaggaacauacacgggggaaaccucaaaaggagaauuuaaagauugggaugaaauguccaaaaaacuagacggaacacuagagagcuuagcuaaaaacaguuggagcggauacaaaacuuuaacggcauacuuuacuaacuaccgaguuacaagugacaauaagguucaauacgacguaguauuucacggaguacuaacagacaacgcugauauuaguaacaacaaagcgccuaucgcuaaaguaacaggaccaucgacuggggcagucggaaggaacauagaauuuucugggaaagacaguaaagaugaagacggaaaaauaguuaguuacgauugggauuuuggcgauggagcuaccucucguggaaagaacucugugcaugcauacaaaaaagcaggaacauauaacguaacccuaaaaguaacagacgacaaaggagcaacagcuacagagagcuuuaccauagaaauaaaaaacgaagauacaacgacaccaauaacaaaagagauggaaccuaaugaugacauaaaagaagcuaacggacccauaguggaaggaguaacagugaaaggagaccugaauggcagcgaugacgcugauacuuuuuauuucgaugucaaagaagacggugacguaaccauugaacuaccguacagcggcaguucaaauuuuacaugguugguauauaaagaaggagacgaccaaaaccacauagcaucuggaauagauaaaaauaacucaaaaguugguacauuuaaaaguacaaaagguagacacuauguauucaucuauaaacacgacagcgcaucaaacauauccuauucccucaauauaaagggacuaggaaaugaaaaacugaaagaaaaagaaaauaacgauuccagugacaaagcaacuguaaucccaaauuuuaauacaacaaugcaaggaucuuuauuaggagacgauagucgcgacuauuacucauuugaagugaaagaagaaggagaaguaaauauagaacuugacaaaaaagacgaguucggaguaaccuggacucuccacccagaaucaaauauaaacgauagaaucacauacggacaaguagacgguaacaaagucucaaauaagguaaaacuuagaccagggaaauacuauuuacucguauauaaauacucuggcagcggcaacuacgaguuacggguuaacaaauaa

SEQ ID NO: 705 - RNA, 3081 nt, Artificial Sequence
  derived and/or modified CDS sequence (opt6) from Clostridium histolyticum__BAA77453.1__HsALB(1-18)_ColG(111-1118)
augaaaugggucaccuuuauaagucuacuuuucuuauuuuccucagcauauagcauagcaaauacaaauuccgaaaaauaugacuucgaauaccuaaacggucuuaguuacacagaauuaacuaaccuaauuaaaaacauaaaauggaaucaaauaaauggcuuauuuaauuauucaacagguagucaaaaauucuucggagauaaaaacagagugcaagcaauaauaaacgcccuacaagagucaggacgaacauauacagcaaaugacaugaaaggaauagagacauucacagagguauuacgugccggauucuaccuaggauacuacaacgacgguuuaucuuacuuaaaugacagaaacuuccaggauaaauguauaccagcaaugauagcaauacagaaaaacccuaauuucaaacucggaacggcgguucaagacgaaguaauuacaucuuuagguaaauugauaggaaacgcaucagcgaacgccgagguaguaaacaauugcguaccgguccuuaaacaauuuagagaaaaucuaaaccaauaugcaccagacuacgugaaaggaacagcagugaaugaauuaauaaaaggcauugaguucgacuucucaggagcagcauaugaaaaagauguaaaaacaaugccaugguacggaaaaauagauccauucauaaaugaacuaaaagcauuaggauuauacggcaacaucaccagugcaacugaaugggcaucagaugucgggauauacuauuuaucaaaauucggacucuauagcacaaaccgaaacgacauaguacaaucacuagagaaagcaguagacauguacaaauacgggaaaauagcauuuguagccauggaacgaauuacaugggacuacgauggcauagguagcaauggaaagaaaguagaucacgauaaauuccuugacgacgcagaaaaacacuaucuuccuaaaacauacacuuuugauaacgguaccuucauaauacgagccggugauaaaguaagcgaagagaaaauaaaaaggcuauauugggcaagcagagaagucaaaagccaauuucauagaguaguaggaaaugacaaagcacuagaaguuggaaacgcugacgauguucuaacaaugaaaaucuucaacucaccugaagaauacaaauucaacacaaacauaaauggaguaaguaccgacaacggaggauuauauauagaacccagggggacguuuuauaccuacgagagaaccccucaacaaucuauauuuuccuuagaagaauuauuucgacaugaauacacacacuauuuacaagcacgauauuugguagauggacuauggggacaaggaccauuuuaugagaaaaacagacuuacgugguucgacgaaggaacggcagaguucuuugcaggaaguacaagaacaaguggaguauuaccaagaaaaucaauacuagguuacuuagcaaaagacaaaguagaucacagauacagccuaaagaaaacacugaauagcgguuaugaugacagugauuggauguucuauaauuacggauucgcaguagcucacuaucuauaugaaaaagauaugccaacauucaucaaaaugaauaaagcaauacuuaacaccgacguuaaaucauaugacgaaauaauaaagaaauuaagugacgacgcaaacaaaaauaccgaauaccaaaaccacauccaagaacuagcagacaaauaucaaggugcaggaauaccauuaguaucagacgacuaccucaaagaccauggauacaagaaagcguccgaaguauacucagaaauaaguaaagcagcaucauugacuaauacuucaguaacagcagaaaaaucacaauacuuuaacacauucacacuucgcggaacauauacgggagaaaccucaaaaggugaauuuaaagauugggacgaaaugaguaaaaagcucgacggcacucuagaaucauuggcuaaaaacuccuggucaggauauaaaacacuaacagccuacuucaccaauuacagagucaccucagauaauaaaguacaauaugacguaguauuucauggagucuuaacagacaacgcugauauaaguaacaauaaagcgccuauagcgaaaguaacaggaccaucaacgggagcaguaggaagaaauauugaguucucaggaaaggauagcaaagacgaagacggaaaaauuguaucuuaugauugggauuucggagauggagcaaccucaagagggaaaaacagugugcaugccuacaagaaagcaggaacuuauaauguaacacuaaaagugacagaugacaaaggagcgacagcaacagagagcuucacgauugaaauuaaaaacgaagauacuacaacacccauaacaaaagaaauggaaccaaaugaugacauaaaagaagcaaacggaccgauaguggaaggcguaacgguaaaaggagacuuaaauggaagugaugacgccgacacauuuuacuuugauguuaaagaagacggugaugucacaauagaauuacccuacucugguaguuccaacuucacuugguuaguauacaaagaaggagaugaucaaaaucauauagcauccggaauagacaaaaacaauagcaaaguaggcacauuuaaauccacaaaaggacgucauuauguuuucauuuacaaacacgauagugcaaguaacauaaguuauucucuaaauauaaaaggacuagguaaugaaaaacuaaaagaaaaagaaaacaacgauagcagugacaaagcuacuguuaucccaaacuucaacaccacaaugcaaggcagcuuacucggagacgauucacgagauuauuacagcuucgaaguaaaagaagagggggaaguaaacauagaacuagauaagaaagacgaauuuggaguaacauggacacuacacccggaaucgaacauaaaugacagaaucacauauggacaaguagacggaaacaaaguaucaaauaaagucaaacuaagaccuggcaaauauuaccuauuaguguauaaauauucaggaucagguaauuacgaacugagagucaauaaauaa

SEQ ID NO: 706 - RNA, 3429 nt, Artificial Sequence
  derived and/or modified CDS sequence (opt6) from Clostridium histolyticum__BAA77453.1__HsALB(1-18)_ColG(1-110)_CS-F_ColG(111-1 118)
augaaguggguaacuuucauaagucuucuuuuccuuuucucuucagcauacucgaugaagaaaaacauacuaaaaauacucauggauuccuauagcaaagaaaguaaaauacaaacaguacggagaguuacaucaguaagucuauuagcaguauaccuaacaaugaauacaagcuccuuaguauuagcaaagccaaucgaaaacacaaacgauacgucaauuaaaaacguagaaaaauuacgaaacgcaccuaaugaagaaaacucaaagaaagucgaagacagcaaaaacgauaaagucgagcacgugaaaaauauagaagaagcaaaaguagaacaaguagccccagaaguaaaaaguaaaucaacucuaagaucugcuucacgcagacgacguaaacgaauagccaacacaaauucagaaaaauaugauuucgaauaccuaaacggguuaucauacacagagcuaacgaaucuaaucaaaaacauaaaauggaaccaaauaaauggccuauuuaauuauagcacaggaucccaaaaauucuucggcgacaaaaaucgaguacaagcaauaauuaaugcacuacaggaaucuggcagaacauauacugcuaaugacaugaaaggaauagaaacauuuacagaaguacucagagcaggauuuuauuuagguuauuauaaugacggcuuaaguuaccuaaaugauagaaacuuucaagauaaaugcauaccugcaaugaucgcaauacagaaaaacccaaacuuuaaacuagggacagcgguacaagacgaaguaauaaccagcuuaggaaaacucaucggaaacgcuucugcaaacgcggaaguuguaaacaacugcguaccaguacuaaaacaauuccgagaaaaccuaaaucaauacgcuccagauuauguaaaaggaacggcuguaaacgaauuaauaaaagguaucgaauuugauuucagcggcgcagccuaugaaaaggacgucaaaacgaugccaugguauggaaaaauagacccauucauaaaugaacugaaagcacucggacuuuacgguaauauaacaagugcuacagaaugggcaucagacguaggaauauauuauuuaucaaaauucggauuauacucaacaaauagaaaugacauaguacaaagucuagaaaaagcggucgacauguacaaauauggcaaaauagcauuuguagcuauggaacgcauaacaugggacuaugauggaauagguucuaacgguaagaaaguugaucaugauaaauucuuagaugacgcagaaaaacacuacuuaccaaaaacauauacauucgacaacggcaccuuuauaauacgugccggagacaaaguuagugaagagaaaauuaaacgacuauacugggcuucgagagaaguaaaaucucaauuucacagagucgugggaaacgauaaagcacuagaaguuggaaacgcagaugauguccucacaaugaaaaucuuuaauuccccggaagaauacaaauuuaauacgaauaucaacggcgugucaacugauaauggaggacuguauauagaaccacgaggaacauucuacacuuaugaaagaaccccgcaacaaagcauuuucucccuagaagaacuauucaggcaugaauauacacauuaccuccaagccagauaccuaguugauggacuauggggacaaggaccguuuuacgagaaaaaucgauuaaccugguuugaugaaggaacggcagaguucuuugcaggaucaacaagaacaagcggaguacuaccaagaaaauccauacuagguuacuuagcaaaagauaaaguugaccacagauauaguuuaaagaaaacccucaacagugguuacgaugauucggauuggauguuuuacaacuacggauucgcaguugcgcacuacuuauacgaaaaagauaugccaacguucauaaaaaugaacaaagcaauacuaaauacugaugucaaaagcuacgaugaaauaauaaagaaacuaagugacgacgccaauaaaaauacagaauaccaaaaccauauacaagaacuagcugacaaauaccaaggugcgggaauaccucuaguaagugacgacuaucuaaaagaucauggauauaagaaagcaucagaaguuuacucugaaaucagcaaagccgcaucauuaacaaacaccucaguaacagcugaaaaaucacaauauuucaacacauucacacuaagggguacauauacaggcgaaaccaguaaaggagaauuuaaagauugggacgaaaugagcaagaaauuagauggaacucuagaaucuuuagccaaaaacucuuggucaggauacaaaacauuaacggcauauuucacgaacuauagaguuacaagugauaauaaagugcaauaugacguaguauuucacggaguccucacagauaacgccgauauuucaaauaauaaagcuccgauagcuaaaguaaccgguccauccacaggagcaguaggcagaaacauugaguucucugguaaagauaguaaagaugaagauggaaaaauagucucauacgacugggauuucggagauggagcaacaucaagagggaaaaacucaguacaugccuauaagaaagcgggaaccuauaacguaacccuaaaagucacagaugacaagggagcaacggcuacagaaaguuuuacaaucgaaauuaaaaaugaagacacaacaacaccaauaacgaaggaaauggaaccaaacgacgacaucaaagaagcuaacggaccaauaguugaaggaguaacaguuaaaggagauuuaaacggaucagaugaugcggacacuuuuuacuucgaugucaaagaagauggagacgucaccauugaauuaccuuauucaggaagcaguaacuucaccugguuaguauauaaagaaggagacgaucaaaaccacaucgcuagcggcauagauaaaaauaauucaaagguuggaaccuuuaagucaacaaaaggaagacacuauguauuuaucuacaaacaugauuccgccucaaacauauccuauagccugaauaucaaaggccuaggaaacgaaaaauuaaaagaaaaagaaaauaacgacagcucagauaaagcaacaguaauuccuaacuuuaacacuacaaugcaagguagccuauugggugacgauaguagagacuauuacagcuuugaagucaaagaagaaggagaaguuaauauagaacuagacaagaaagaugaguuuggaguaaccuggacauugcacccugaauccaauauaaaugacagaauuacuuauggccaagucgacggaaauaaagucucaaacaaagugaaacuaagaccggguaaauauuaccuuuugguguacaaauauaguggcucaggaaacuaugaauuaagggucaacaaauga

SEQ ID NO: 707 - RNA, 3105 nt, Artificial Sequence
  derived and/or modified CDS sequence (opt6) from Clostridium histolyticum__BAA34542.1__ColH
augaacuuucucaaaauaauacugaaccguggcaaaacaaugaaaagaaaaugccuaaguaaaagacucaugcuggccaucacaauggcuacaauauucaccgucaacagcaccuuaccuauuuaugcagccguagacaaaaauaacgcuacugccgccguacaaaaugaaagcaaaagauacacugucucguaucuuaaaacacuaaauuacuacgaccuaguagauuuauuaguaaaaacagaaauagaaaaccuaccugaucucuuucaauacucaucagaugccaaagaauuuuacggaaacaaaacacgaaugucuuuuauaauggaugaaauaggccgcagagcuccacaauacaccgaaaucgaccacaaaggaauaccaacauuaguggaagugguaagagcaggauuuuauuuaggcuuccacaacaaagaacuaaacgaaauaaauaaaagauccuucaaggaaaggguaauacccucaauauuagcaauacagaaaaaccccaauuucaaacuaggaacagaagugcaagacaaaaucgucagcgcaacgggacuucuagccgguaacgaaacugcuccaccagaaguaguaaacaacuucaccccaauccuacaagacuguauuaaaaacauagacagauaugcauuagacgaucuaaagucaaaggcuuuauuuaacgucuuagcugcaccuacuuacgacauaacagaauaccucagggcaacaaaagaaaaaccggaaaauacaccuugguacggaaaaauagauggcuucauaaacgaacuaaagaaauuagccuuauacggaaaaauuaacgauaauaacucuuggauaauagauaaugguauuuaccacauagcuccguuagggaaacugcauaguaacaauaaaaucggaauagaaacauuaaccgaagucaugaaaguauacccauauuuaucaaugcaacacuuacaauccgccgaccaaaucaaaagacacuacgacagcaaagaugcagaaggaaauaaaauaccauuagauaaauucaagaaagaaggaaaagaaaaauacugcccaaaaaccuauacuuucgacgauggaaaaguaauaauaaaagcuggagcaagagucgaagaagaaaaaguaaaacgacucuacugggcaucaaaagaagucaacucacaauucuucagagucuauggcauagauaaaccgcuagaagagggaaaccccgaugacauccuaacaaugguaauauacaauucaccagaagaguauaaacuaaauagcguauuauacggauacgacacaaauaacggcggaauguacaucgaaccugaaggaaccuucuucaccuaugagcgagaagcccaagaaaguacauacacccuggaagaacuauucagacaugaauacacacauuaccuacaaggacgauacgccgugccaggacaaugggggcgaacgaaauuauacgacaacgacagacucacaugguaugaagaagguggagcagaauuauucgcaggcaguacccguacaucagguauccuaccaagaaaaucuaucgucaguaacauacacaacacaacuaggaauaaucgauacaaauuaucagacacaguacauuccaaauacggggccuccuucgaauuuuacaacuacgcgugcauguuuauggauuauauguauaacaaagauauggguauucuaaacaaauuaaacgaccuagccaagaauaaugacguggacggauacgacaacuauauuagggaccuaucaucaaauuaugcauuaaacgacaaauaccaagaccacaugcaagagaggauagauaauuacgaaaaccuaacaguaccauuugucgcagacgauuauuuagugcgacaugcauacaaaaauccaaacgaaaucuacagugagauuucagagguagcaaaacucaaggaugcgaaauccgaagucaagaaaagucaauacuucaguacauucacgcuaagaggaucauauacaggaggagccucaaaaggaaaauuagaagaccaaaaagcaaugaauaaauucauagacgauucauuaaagaaacuagauaccuacaguuggaguggcuauaaaacacucacugcauauuucacaaauuacaaaguagacucaucuaauaggguaaccuacgauguaguauuccacggauaccucccaaaugaaggcgacagcaaaaacucucucccauacggaaaaauaaacgggacauacaaagguacugaaaaagagaaaaucaaauucagcagcgaaggauccuucgacccagacggaaaaauuguuaguuaugaaugggacuucggagauggaaacaaaaguaaugaagaaaacccagaacauuccuaugacaaagucgggacuuacaccguaaaauuaaaaguuacagaugauaaaggcgaauccaguguaucaacaacaacagccgaaaucaaagacuuaagcgaaaauaaacuuccaguaauauauaugcacguaccaaaaucuggagcacuuaaccaaaaaguaguauucuacgguaaagguacauacgauccagacggaucaauagcuggguaucaaugggacuuuggagacgguucagauuucucaucagaacaaaaucccucccacguauacacaaagaaaggugaauacacagugacacuaagagucauggauagcagcggccaaaugucagagaaaacaaugaaaaucaaaauaacugaucccguauauccaauaggcacagaaaaagaaccaaacaacagcaaagaaacagccagcggaccaauaguaccaggcauacccgucaguggaacuauagaaaauacauccgaccaagacuacuuuuacuucgauguaauaaccccuggagaaguaaaaauagacauaaacaaauuagguuaugggggcgcaacauggguaguguacgaugaaaauaauaacgcaguaaguuaugcuacagacgacggccaaaaucuauccggaaaauucaaagcagacaaaccaggcagauacuauauucaucuauauauguuuaacgguagcuacaugccuuacaggaucaacauagaaggaagcguagguagauag

SEQ ID NO: 708 - RNA, 3066 nt, Artificial Sequence
  derived and/or modified CDS sequence (opt6) from Clostridium histolyticum__BAA34542.1__ColH
augaaacguaaaugccuuucaaaacgucuaauguuggcaauuacuauggcaacaauauuuacaguuaauuccacacuaccaauauaugcagcuguagacaaaaacaaugccacagccgcaguacaaaaugaauccaaaagguacacugucaguuaucuaaaaacucuuaacuauuacgaccuaguugaccuauuaguaaaaacagaaauagaaaaccuaccagacuuauuccaauacucaucugaugcuaaagaauuuuacggaaauaaaacccgcaugaguuuuaucauggaugaaauaggaagacgagcgccucaauauacugaaaucgaucacaaaggaauaccgacgcuaguagaaguuguaagagccgguuuuuacuuaggcuuucacaacaaagaacuaaacgaaauaaauaaacgaucauuuaaagagagaguaauacccagcauccuugccauacaaaagaauccaaacuucaaauuaggaacagagguacaagacaaaauaguauccgccacaggccuauuagcaggaaaugagacagcacccccugagguagugaacaauuucacaccaauauuacaagauugcauuaaaaauauagauagauaugcucuagaugaucuaaaaucaaaagcacuauucaacguacuagcagcacccacauacgauauaacagaauacuuacgagcgaccaaagaaaaaccagaaaacacaccaugguacggaaaaauagacggcuuuauaaaugaguuaaagaaauuagcauuauaugguaaaauaaaugauaauaacagcuggauuauagacaacgggauauaucauauagcaccccuaggaaaacuacacucaaacaauaaaauaggaauagaaacauuaaccgaagucaugaaaguuuauccuuacuuauccaugcaacacuuacaaucagcagaucaaauaaaaagacauuaugauucaaaagacgcagaagguaacaaaauaccccuagacaaauuuaagaaagaaggaaaagaaaaauauugcccaaaaacauacacauuugacgacgggaaaguaaucauaaaagcaggagcgagagucgaagaagaaaaaguaaaaagacucuacugggcaucuaaagaaguaaacucccaauucuucaggguauauggaauagacaaaccauuagaagaaggaaaucccgaugacauuuugacaaugguaaucuauaauaguccggaagaauauaaacugaacagugucuuauacggauaugauaccaacaacgguggaauguauauagaaccagagggaaccuucuucaccuaugaaagggaagcccaagaaucaacauacacucucgaggaacuauuuaggcacgaauauacacacuauuuacaaggacgauacgcaguaccaggacaauggggcaggacaaaacuuuacgauaacgacagacuaacuugguaugaagaagguggcgccgaacuauucgccgguucaacucgcacaagcggaauauugccacgaaaaucaaucguaucuaacauacacaacacaacaagaaauaaccguuacaaacuaucagauacaguucacuccaaauacggagcaaguuuugaauuuuacaacuacgccuguauguuuauggacuacauguauaauaaagauaugggcauacuaaauaaacugaacgauuuagcuaaaaacaaugacguagacggcuacgacaacuacauaagagauuuaaguuccaacuaugcacuaaaugauaaauaucaagaucacaugcaagaaagaauagauaacuaugaaaauuuaacaguaccuuuuguggcagacgauuaccuuguucgacacgcauauaaaaaccccaaugagauauauucagaaauuucagaaguagcaaaauuaaaagaugcaaaaagcgaaguaaagaaaagccaauacuucuccacauuuacccuccgaggaucauacaccggcggagccuccaaaggaaaacuagaagaccaaaaagcuaugaacaaauucauagaugacucccuaaagaaauuagacacauauucaugguccggauacaaaacccuaacggcuuacuucacaaauuacaaagucgacuccucaaauaggguuacauacgacgucguauuucacggauaucuccccaaugagggagacaguaaaaauucccuaccauacgggaaaauaaacggaacauauaaagggacagaaaaagagaaaauaaaauucucgucugaaggaucuuuugaccccgacgggaaaauugugucauaugaaugggauuuuggagauggaaauaaaucaaaugaagaaaacccagaacacagcuaugacaaaguaggcacauacaccguaaaauuaaaaguaacagacgacaaaggagaaucaucaguauccaccaccacagcagaaauuaaagaucuaucugaaaacaaacucccaguaaucuauaugcacguaccuaaaaguggcgcucucaaucaaaaaguaguauuuuacggaaaaggaacauaugacccagacggaagcauagcaggguaucaaugggauuucggagauggaucugauuuuucuucagaacaaaacccaucgcacguauacaccaagaaaggagaauauacaguaacacuaagaguuauggauucaucuggacaaaugucugagaaaacuaugaaaauaaaaauaacagacccaguuuauccaauaggcacagaaaaagaaccaaacaacaguaaagaaacagcaucaggaccaaucgucccgggcauaccaguaaguggaacaauagaaaauacaagcgaccaagauuacuucuacuucgauguaauaacaccaggcgaaguuaaaauugacauaaacaaacucggauauggaggagcaacauggguaguauaugaugaaaacaauaaugccguaucuuacgccacagacgauggacaaaaccuaaguggaaaauuuaaagcugauaaacccggacgcuacuacauacaccuguauauguuuaacgguucauacaugccauacaggauaaacauagaagggagugugggaagauaa

SEQ ID NO: 709 - RNA, 3000 nt, Artificial Sequence
  derived and/or modified CDS sequence (opt6) from Clostridium histolyticum__BAA34542.1__HsALB(1-18)_ColH(41-1021)
augaaauggguuacuuuuauaucauuacuauuccuauucucaucagcauacagcguacagaacgaaucaaaaagauacacaguaaguuacuuaaaaacguuaaacuacuacgaccuaguagauuuauuagucaaaaccgaaauugaaaauuuacccgaccuuuuccaauacucuuccgaugcaaaagaauuuuacggcaauaaaacacgaaugagcuucauaauggaugaaaucgguagacgagcuccccaauacacagaaauagaccacaaaggaaucccuacauuaguugaaguaguuagagcaggauucuaccuagguuuucauaacaaggaauuaaaugaaauaaauaaacgaucauucaaagaacgaguaauaccaucaauacuugcaauacagaaaaacccaaacuuuaaacuuggaacugaaguucaagacaaaauagugucagcaacaggacuccuagcuggcaaugaaacagcuccaccagaaguaguaaacaacuuuacaccaauauuacaagauugcauuaaaaauauagaccgcuacgcuuuagaugaucuaaaaaguaaagcacuauuuaacguacuggcagcaccuacuuacgacauaaccgaauaccuacgagcaacaaaagaaaaaccugaaaacacccccugguacggaaaaauagacggauuuaucaacgaacuaaagaaauuagcacuuuauggaaaaauuaacgauaauaauuccuggaucaucgacaauggcauauaccauauagcuccacuaggaaaauuacacucaaacaacaaaauaggaauagaaacacuaacggagguaaugaaaguauacccauaucuaucaaugcaacaccuacaaucagccgaucaaauaaaaagacauuaugacucaaaagaugcagaaggcaacaaaauaccacuagacaaauucaagaaagaaggaaaagaaaaauauuguccgaaaacauacaccuuugaugauggaaaaguaauuauaaaagcuggagcaagagucgaagaagaaaaaguuaaacgauuauauugggcaucaaaagaaguaaauagucaauuuuuccgcgucuauggaauagauaaaccccuugaggaaggaaauccagacgacauccuaacaaugguaauauauaauucaccugaagaauacaaauuaaauucaguacuauauggauacgacacaaacaacggaggaauguacauagaaccagaagguacauucuuuacauaugagagagaagcacaagaaagcacauacacucuagaagaacuauucagacacgaguacacccacuaccuacaaggucgauaugcuguaccaggacaauggggaaggacaaaacuauacgauaaugacagacuaaccugguacgaagaaggaggagccgaacuauucgcaggaagcacacguacaucagguauacuaccaagaaaauccauagucagcaacauacauaacacgacacguaacaacagauacaaauuaagugacacaguucauagcaaauauggagcuucauuugaguuuuauaacuacgcauguauguucauggauuacauguacaacaaagacaugggaaucuuaaauaaacuaaacgauuuagcuaaaaauaaugauguagauggauacgacaacuauauacgcgauuuaagcaguaacuacgcacuaaacgauaaauaccaagaucacaugcaagaaaggauagacaacuacgaaaauuuaacagucccauucgucgcagacgauuaccuagucagacacgccuauaaaaauccuaacgaaauauacucagagauuagcgaggucgcaaaauuaaaagacgcaaaaagugaaguaaagaaaagucaauauuucaguacauuuaccuuaagaggcucauauacaggcggagcaaguaaaggaaaauuagaagaucaaaaagcaaugaauaaauucauugaugacagccuaaagaaauuagacacauacucauggucgggcuacaaaacccuuaccgcuuacuuuacaaacuauaaagucgacaguucaaacagggucacauacgacguuguauuccacggcuacuuaccaaaugaaggagacaguaaaaacucccuaccauacggaaaaauaaauggaacguauaaaggaacagaaaaagagaaaauaaaauucucaucagaaggaucauucgacccggacggaaaaauuguuuccuacgaaugggacuucggggacgguaacaaaucgaacgaagaaaauccugaacauucauaugauaaaguaggaacauacacaguaaaacuaaaagucacagaugacaaaggagaaucguccguaucuaccacaacagcggaaauaaaagauuuaucagaaaauaaacuacccguuauuuacaugcaugucccaaaaagcggagcauuaaaccaaaaaguaguauuuuacggaaaaggcacauaugauccagacggaucaauugccgguuaucaaugggacuucggagacggaagcgacuucaguagugaacaaaaccccucccauguauacacaaagaaaggugaauacacagucaccuuaagaguaauggacucaucaggacagaugagugagaaaacaaugaaaauaaaaauaaccgaccccgucuauccaauaggaaccgaaaaagaaccaaauaauucaaaagaaacagcaucaggaccaauaguacccggcaucccaguaucuggcaccaucgaaaacaccucugaucaagacuacuucuacuucgacguaauaacaccaggugaaguaaaaauugauaucaauaaacuaggauacggcggagcaacauggguaguuuacgacgaaaacaacaacgcaguuagcuacgcuacagaugacggacaaaaccuaagugggaaauuuaaagcagacaaaccuggaagauauuauauccaucucuacauguucaacgguucuuauaugccauauagaauaaacauagaaggcucaguaggaagauaa

SEQ ID NO: 710 - RNA, 3138 nt, Artificial Sequence
  derived and/or modified CDS sequence (opt6) from Clostridium histolyticum__BAA34542.1__HsALB(1-18)_ColH(1-40)_CS-F_ColH(41-102 1)
augaaauggguuacauucaucagcuuacuauuccuauucaguagcgccuacagcaugaaaagaaaauguuuauccaaaagacuaaugcuagcuaucacaauggcuacaauuuucacagugaacucuacauuaccaauauacgcugcaguugauaaaaacaacgcaacagccgcuagaagaagaagaaaacgaguacaaaacgaaagcaaaagauacaccgucucuuacuuaaaaacacuaaauuacuacgaucugguagaccuucuaguaaaaacugaaauagaaaaucuaccagacuuauuccaauauucaagcgacgcaaaagaauuuuacggaaacaagacaagaaugaguuuuauuauggaugaaauuggacguagagcaccccaauacaccgaaauagaucacaaaggcauacccaccuuaguggaaguuguaagagccggguucuacuuaggauuucauaauaaagaauuaaaugaaauaaauaaacgauccuucaaagaaagagucauaccaagcauucucgcaauucagaaaaacccaaauuucaaacuaggaaccgaaguacaagauaaaauuguaucagcaaccggauuauuagcugguaacgaaacagcucccccugaaguaguaaauaacuuuacccccauauuacaagauugcauuaaaaauauagacagauacgccuuagacgaccuaaaaucaaaagcacuauucaauguccucgcugcuccaacauaugacauaacagaauaccuuagagcgacuaaggaaaaacccgaaaacaccccaugguaugguaaaauagaugguuucauaaacgaacuaaagaaacucgcacuauacggaaaaauaaacgacaacaauagcuggauaauagacaauggaauauaucauauagcaccauuaggaaaacuacauucaaacaauaaaaucggaauagaaacauuaacagaaguaaugaaaguauaucccuauuuaagcaugcaacaucuacagucugcggaccaaauaaaacgucauuacgacucuaaagacgcagaaggaaacaaaauuccacuagacaaauuuaagaaagaagggaaagaaaaauacugcccaaaaaccuacacuuuugaugauggaaaaguaauuauaaaagcuggagcacgcguagaagaagaaaaaguaaaacgauuauacugggccaguaaagaagugaauagucaauucuucagagucuauggaauugacaaaccucuagaagaaggcaacccagacgauauacuaaccaugguuauauauaauucuccagaagaauacaaacuaaauucaguauuauacggauaugauaccaacaacggagggauguacauagaaccugaagguacuuucuuuacauacgaaagagaagcacaagaaagcacauauaccuuagaggaacuauuuagacacgaauauacacacuaccugcaaggaagauaugcugugccaggacaauggggacguacuaaacuauacgacaacgauagacuaacaugguaugaagaaggaggagcagaacucuuugcuggcuccaccagaacaaguggaaucuuaccaagaaaaaguauaguaucaaacauacauaacacaacaagaaauaacagauacaaacucagcgacacaguacacucaaaauacggagcuagcuucgaauuuuauaauuacgcaugcauguucauggacuacauguacaacaaagauaugggaaucuuaaacaaacuaaaugaucuagcgaaaaauaaugauguugaugguuacgacaacuauauccgugaucucucaucaaacuacgcacugaacgacaaauaccaagaucauaugcaagaacguauagauaauuaugaaaauuuaacuguacccuucguagcagaugauuacuugguuaggcaugcauacaaaaauccuaaugaaauauacucagaaauaucugaaguagccaaacuaaaagaugcaaaaagugaaguuaagaaaagccaauauuuuuccacauuuacauuacgaggauccuauacuggaggggccaguaaagguaaacuagaagaccaaaaagcaaugaacaaauucaucgaugauucccuaaagaaauuagauacauauaguuggucaggcuacaaaacacuaacagccuauuuuacaaauuacaaaguagauucaagcaauagaguuacauacgacguaguauuccaugguuauuuaccaaaugaaggcgacaguaaaaauucauuaccauacggaaaaauaaauggaacauauaaaggaacggaaaaagagaaaauaaaauucuccucugaaggauccuuugacccagacggaaaaaucguuagcuacgaaugggacuucggugaugguaacaaaucaaacgaagaaaacccugaacacagcuacgacaaaguaggaaccuacacagucaaacucaaaguaacagaugauaaaggugaaucuucuguuucuacgacaacagcagaaaucaaagauuuauccgaaaacaaacucccagucauauauaugcacguaccaaaaucaggugcacuuaaucaaaagguuguauuuuauggaaaagguacauaugaucccgacggaucaaucgcaggauaccaaugggacuucggagacgggucagauuucuccucugaacaaaacccaagccacguauacaccaagaaaggagaauauaccguaaccuuacgagucauggauaguucaggucaaaugucagagaaaacaaugaaaaucaaaauaacugauccaguauacccaaucggaacagaaaaagaaccaaauaauagcaaagaaacagcaaguggacccaucgugccaggcaucccaguaucgggcacaauagaaaauacgagcgaccaagacuauuucuacuuugacgucauaacaccaggagaaguaaaaaucgauauaaauaaacuaggauacggaggagccacaugggucgucuacgaugaaaacaacaaugccgugagcuaugcaacagacgauggacagaaucuuucugggaaauucaaagcagauaaaccaggacgauacuauauacacuuauacauguuuaaugguaguuacaugccauaccgaauaaacauugaaggaagcguuggaagauga

SEQ ID NO: 711 - RNA, 576 nt, Artificial Sequence
  derived and/or modified CDS sequence (opt6) from Homo sapiens__NP_001133.1__HsAMELX
auggguaccuggauauuauucgcaugccuacuaggcgcagcauucgccaugccauuaccaccacacccaggacacccaggauacaucaacuucucauacgaaguacuaacaccacuaaaaugguaccaaucaauaagaccaccauacccaucauacggauacgaaccaauggguggauggcuacaccaccaaauaauaccaguacuaucacaacaacacccaccaacacacacacuacaaccacaccaucacauaccaguaguaccagcacaacaaccaguaauaccacaacaaccaaugaugccaguaccaggacaacacuccaugacaccaauacaacaucaccaaccaaaccuaccacccccagcacaacaaccauaccaaccacaaccaguacaaccacaaccacaccaaccaaugcaaccacaaccaccaguacaccccaugcaaccacucccaccacaaccaccacuaccaccaauguucccaaugcaacccuuaccaccaaugcuaccagaccuaacacuagaagcauggcccucaacagacaaaacaaaaagagaagaagucgacuaa

SEQ ID NO: 712 - RNA, 135 nt, Artificial Sequence
  derived and/or modified CDS sequence (opt6) from Homo sapiens__NP_001133.1__HsAMELX-TRAP
augccacuaccaccacacccaggacacccaggauacauaaacuucucauacgaaguacuaacaccacuaaaaugguaccaaucaauaagaccaccauacccaucauacggauacgaaccaaugggaggaugguaa

SEQ ID NO: 713 - RNA, 168 nt, Artificial Sequence
  derived and/or modified CDS sequence (opt6) from Homo sapiens__NP_001133.1__HsAMELX-LRAP
augccacuaccaccacacccaggacacccaggauacauaaacuucucauacgaaguacuaacaccacuaaaaugguaccaaucaauaagaccaccaccaaugcuaccagaccuaacacuagaagcauggccaucaacagacaaaacaaaaagagaagaaguagacuaa

SEQ ID NO: 714 - RNA, 207 nt, Artificial Sequence
  derived and/or modified CDS sequence (opt6) from Homo sapiens__NP_001133.1__HLA-A2-SP_HsAMELX(17-60)
auggcaguaauggcaccaagaacacuaguacuacuacuaucaggagcacuagcacuaacacaaacaugggcaaugccacuaccaccacacccaggacacccaggauacauaaacuucucauacgaaguacuaacaccacuaaaaugguaccaaucaauaagaccaccauacccaucauacggauacgaaccaaugggaggaugguaa

SEQ ID NO: 715 - RNA, 240 nt, Artificial Sequence
  derived and/or modified CDS sequence (opt6) from Homo sapiens__NP_001133.1__HLA-A2-SP_HsAMELX(17-47,168-191)
auggcaguaauggcaccaagaacauuaguacuacuacuaucaggagcacuagcacuaacacaaacaugggcaaugccacuaccaccacacccaggacacccaggauacauaaacuucucauacgaaguacuaacaccacuaaaaugguaccaaucaauaagaccaccaccaaugcuaccagaccuaacacuagaagcauggccaucaacagacaaaacaaaaagagaagaaguagacuaa

SEQ ID NO: 716 - RNA, 579 nt, Artificial Sequence
  derived and/or modified CDS sequence (opt6) from Homo sapiens__NP_001134.1__HsAMELY
augggaacauggauacuauucgcaugcuuaguaggagcagcauucgccaugccacuaccaccacaccccggccacccaggauacauaaacuucucauacgaaguauuaacaccacuaaaaugguaccaaucaaugauacgcccaccauacuccucauacggauacgaaccaaugggcggcugguuacaccaucaaauaauaccaguaguaucccaacaacacccacuaacacacacacuacaaucacaccaccacauaccaguaguaccagcacaacaaccacgaguacgccaacaagcacuaaugccaguaccaggacaacaaucaaugacaccaacacaacaccaccaaccaaaccuaccauuaccagcacaacaaccauuccaaccacaaccaguacaaccccaaccacaccaaccaaugcaaccacaaccaccaguacaaccaaugcaaccacuccuaccccaaccaccacuaccaccaauguucccacuaagaccacuaccaccaauacuaccagaccuacaccuagaagcauggccagcaacagacaaaacaaaacaagaagaaguagacuaa

SEQ ID NO: 717 - RNA, 138 nt, Artificial Sequence
  derived and/or modified CDS sequence (opt6) from Homo sapiens__NP_001134.1__HsAMELY-TRAP
augccacuaccaccacacccaggacacccaggauacauaaacuucucauacgaaguacuaacaccacuaaaaugguaccaaucaaugauaagaccaccauacucaucauacggauacgaaccaaugggaggaugguaa

SEQ ID NO: 718 - RNA, 171 nt, Artificial Sequence
  derived and/or modified CDS sequence (opt6) from Homo sapiens__NP_001134.1__HsAMELY-LRAP
augccacuaccaccacacccaggacacccaggauacauaaacuucucauacgaaguauuaacaccacuaaaaugguaccaaucaaugauaagaccaccaccaauacuaccagaccuacaccuagaagcauggccagcaacagacaaaacaaaacaagaagaaguagacuaa

SEQ ID NO: 719 - RNA, 210 nt, Artificial Sequence
  derived and/or modified CDS sequence (opt6) from Homo sapiens__NP_001134.1__HLA-A2-SP_HsAMELY(17-61)
auggcaguaauggcaccaagaacauuaguacuacuacuaucaggagcacuagcacuaacacaaacaugggcaaugccacuaccaccacauccaggacacccaggauauauaaauuucucauacgaaguauuaacaccacuaaaaugguaucaaucaaugauaagaccaccauacagcucauacggauacgaaccaaugggaggaugguaa

SEQ ID NO: 720 - RNA, 243 nt, Artificial Sequence
  derived and/or modified CDS sequence (opt6) from Homo sapiens__NP_001134.1__HLA-A2-SP_HsAMELY(17-48,169-192)
auggcaguaauggcaccaagaacacuaguacuacuacuaucaggagcacuagcacuaacacaaacaugggcaaugccacuaccaccacacccaggacacccaggauacauaaacuucucauacgaaguacuaacaccacuaaaaugguaucaaucaaugauaagaccaccaccaauacuaccagaccuacaccuagaagcauggccagcaacagacaaaacaaaacaagaagaaguagacuaa

SEQ ID NO: 721 - RNA, 570 nt, Artificial Sequence
  derived and/or modified CDS sequence (opt6) from Sus scrofa__NP_999071.1__SsAMELX-001-1
augggaaccuggauauuauucgcaugccuacuaggagccgcauucuccaugccacuaccaccacacccaggacacccaggauacauaaacuucucauacgaaguauuaaccccauuaaaaugguaucaaaacaugauaagacacccauacacaucauacggauacgaaccaaugggaggauggcuacaccaccaaauaauaccaguaguaucccaacaaacaccacaaucacacgcacuacaaccacaccaccauauaccaaugguaccagcacaacaaccaggaauaccacaacaaccaaugaugccacuaccaggacaacacucaaugacaccaacacaacaccaccaaccaaaccuaccacuaccagcccaacaaccauuccaaccacaaccaguacaaccacaaccacaccaaccacuacaaccccaauccccaaugcacccaauacaaccacuacuaccacaaccaccacuacccccaauguucucaaugcaaucacuacuaccagaccuaccacuagaagcauggccagccacagacaaaacaaaaagagaagaaguagacuaa

SEQ ID NO: 722 - RNA, 138 nt, Artificial Sequence
  derived and/or modified CDS sequence (opt6) from Sus scrofa__NP_999071.1__SsAMELX-TRAP
augccacuaccaccacacccaggacacccaggauacauaaacuucucauacgaaguacuaacaccacuaaaaugguaccaaaauaugauaagacacccauacacaucauacggauacgaaccaaugggaggaugguaa

SEQ ID NO: 723 - RNA, 171 nt, Artificial Sequence
  derived and/or modified CDS sequence (opt6) from Sus scrofa__NP_999071.1__SsAMELX-LRAP
augccacuaccaccacacccaggacacccaggauacauaaacuucucauacgaaguacuaacaccacuaaaaugguaccaaaacaugauaagacacccaucacuacuaccagaccuaccacuagaagcauggccagcaacagacaaaacaaaaagagaagaaguagacuaa

SEQ ID NO: 724 - RNA, 210 nt, Artificial Sequence
  derived and/or modified CDS sequence (opt6) from Sus scrofa__NP_999071.1__HLA-A2-SP_SsAMEL(17-61)
auggcaguaauggcaccaagaacauuaguacuacuacuaucaggagcacuagcacuaacacaaacaugggcaaugccacuaccaccacauccaggacacccaggauauauaaauuucucauacgaaguauuaacaccacuaaaaugguaucaaaauaugauaagacauccauauacaucauacggauacgaaccaaugggaggaugguaa

SEQ ID NO: 725 - RNA, 243 nt, Artificial Sequence
  derived and/or modified CDS sequence (opt6) from Sus scrofa__NP_999071.1__HLA-A2-SP_SsAMEL(17-49,167-189)
auggcaguaauggcaccaagaacacuaguacuacuacuaucaggagcacuagcacuaacacaaacaugggcaaugccacuaccaccacacccaggacacccaggauacauaaacuucucauacgaaguacuaacaccacuaaaaugguaccaaaacaugauaagacacccaucacuacuaccagaccuaccacuagaagcauggccagcaacagacaaaacaaaaagagaagaaguagacuaa

SEQ ID NO: 726 - RNA, 534 nt, Artificial Sequence
  derived and/or modified CDS sequence (opt6) from Sus scrofa__P45561-2__SsAMELX-001-2
augggaacauggauacuauucgcaugccuacucggugcagcauucucaaugccacuaccaccacacccaggacacccaggauacauaaacuucucauacauacgacacccauacacaucauacggauacgaaccaaugggaggauggcuacaccaccaaauaauacccguaguaucucaacaaacaccacaaucacacgcacuacaaccacaccaccacauaccaaugguaccagcacaacaaccaggaauaccacaacaaccaaugaugccauuaccaggacaacacucaaugacaccaacacaacaccaccaaccaaaccuaccacuaccagcacaacaaccuuuccaaccacaaccaguacaaccacaaccacaccaaccacuacaaccacaaucaccaaugcacccaauacaaccauuacuaccacaaccaccacuaccaccaauguucucaaugcaaucacuacuaccagaccuaccacuagaagcauggccagcaacagacaaaaccaaaagagaagaaguagacuaa

SEQ ID NO: 727 - RNA, 570 nt, Artificial Sequence
  derived and/or modified CDS sequence (opt6) from Sus scrofa__NP_998965.1__SsAMELX-001-3
augggaacauggauauucuucgccugccuacuaggcgcaucacuagcaaugccacuaccaccacacccaggacacccaggauauauaaacuucucauacgaaguacuaacaccucuaaaaugguaccaaaacaugauaagacauccauacacaucauacggauacgaaccaaugggcggaugguuacaccaccaaauaauaccaguagucucccaacaaacaccacaaucacacgcauuacaaccccaccaccacauacccaugguaccagcccaacaaccaggaauaccacaacaaccaaugaugccacuaccaggacaacacucaaugacaccaacacaacaccaccaaccaaaccucccauuaccagcacaacaacccuuccaaccacaacccguacaaccacaaccacaccaaccacuacaaccacaaucaccaaugcacccaauacaaccacuacuaccccaaccaccacuaccaccaauguucucaaugcaaucacuacuacccgaccuaccauuagaagcauggccagcaacagacaaaacaaaaagagaagaaguagacuaa

SEQ ID NO: 728 - RNA, 219 nt, Artificial Sequence
  derived and/or modified CDS sequence (opt6) from Sus scrofa__K7GPB2__SsAMELX-002
augggaacauggauacuauucgcaugccuacuaggagcagcauucucaaugccacuaccaccacacccaggacacccaggauacauaaacuucucauacgaaguacuaacaccacuaaaaugguaucaaaacaugauaagacacccaucacuauuaccagaccuaccacuagaagcauggccagcaacagacaaaacaaaaagagaagaaguagauuaa

SEQ ID NO: 729 - RNA, 612 nt, Artificial Sequence
  derived and/or modified CDS sequence (opt6) from Sus scrofa__K7GLD0__SsAMELX-003
augggaacauggauacuauucgcaugccuacuaggagccgcauucucaaugccccuaccaccacacccaggacacccaggcuacauaaacuucucauacgaagaccuauaccuagaagcaauaagaauagacagaacagcauucguccuaacaccauuaaaaugguaccaaaacaugauaagacacccauacacaucauacggauacgaaccaaugggaggcuggcuacaccaccaaauaauacccguaguaucccaacaaacaccacaaucacacgcacuccaaccacaccaucacauaccuaugguaccagcacaacaacccggaauaccacaacaaccaaugaugccacuaccaggacaacacucaaugacaccuacacaacaccaccaaccaaaccuaccauuaccagcacaacaaccauuccaaccacaaccaguacaaccacaaccacaccaaccccuacaaccacaaucaccaaugcacccaauacaaccacuacucccacaaccaccccuaccacccauguucucaaugcaaucuuuacuaccagauuuaccauuagaagcauggccagcaacagacaaaacaaaaagagaagaaguagauuaa

SEQ ID NO: 730 - RNA, 498 nt, Artificial Sequence
  derived and/or modified CDS sequence (opt6) from Sus scrofa__K7GPE9__SsAMELX-004
augggcacauggauacuauucgcaugccuacuaggagcagcauucuccaugccacuaccaccacacccaggacacccaggauacauaaacuucucauacgaaguacucaccccacuaaaaugguaccaaaacaugauaagacacccaacaccacaaucccacgcacuccaaccacaccaccacauaccaaugguaccagcacaacaaccaggaauaccacaacaaccaaugaugccacuaccaggacaacacucaaugacaccaacacaacaccaccaacccaaccuaccacuaccagcacaacaaccauuucaaccacaaccaguacaaccacaaccacaccaaccacuacaaccacaaucaccaaugcacccaauacaaccacuacucccacaaccaccacuacccccaauguucucaaugcaaucacuauuaccagaccuaccacuagaagcauggccagcaacagacaaaacaaaacgagaagaaguagacuaa

SEQ ID NO: 731 - RNA, 522 nt, Artificial Sequence
  derived and/or modified CDS sequence (opt6) from Sus scrofa__J9JIM4__SsAMELX-201
augccacuaccaccacacccaggacacccaggauacauaaacuuuucauacgaaguacuaaccccacuaaaaugguaccaaaacaugauaagacaccccuacacaucauacggcuacgaaccaaugggaggauggcuacaccaccaaauaauaccaguaguaucacaacaaacaccacaaucacacgcacuccaaccacaccaccacauaccaaugguaccagcacaacaacccggaauaccacaacaaccaaugaugccacucccaggacaacacucaaugacaccaacacaacaccaccaaccaaaccuaccacuaccagcccaacaaccauuccaaccacaaccaguacaaccacaaccacaccaaccacuacaaccacaaucaccaaugcacccaauacaaccacuacuaccacaacccccacuacccccaauguucucaaugcaaucacuacuaccagaccuaccacuagaagcauggccagcaaccgacaaaacaaaaagagaagaagucgacuaa

SEQ ID NO: 732 - RNA, 2961 nt, Artificial Sequence
  derived and/or modified CDS sequence (opt6) from Homo sapiens__NP_006120.1__HsBMP1
augccagggguagcuagacuaccucuacucuuaggacuccuauuguuaccacggccaggaagaccguuagaucuagcggacuacacauaugaucucgcagaagaagacgacagugaaccgcuaaauuacaaagauccauguaaagcggccgcauuuuugggagauauagcauuagaugaagaagacuuaagagcauuucaaguacaacaagcuguugaucuaagaagacacacggcccgaaaaagcaguauaaaagcagcgguaccaggcaacacaagcacgccaucaugccaaaguacaaacggacaaccacaaagaggggcuugcgggagauggagaggaagaagcagaagcagacgcgcagcuacuucaagaccugaaagaguuuggccugacggcguaauaccauucguaauaggaggcaauuuuacaggaagucagcgcgcaguuuuucggcaagcaaugcgccacugggaaaaacauacuuguguaacauucuuagagcgaacagaugaagauuccuauauaguuuucacauacaggcccugcggauguuguucauauguaggaagacgcgggggaggaccacaagcgauaaguauaggaaaaaauugugacaaauucggaauaguuguccaugaauuaggucacguugugggauucuggcacgaacacacacgaccagauagagacagacauguaaguauaguaagggaaaauauacaaccagggcaggaauacaacuuuuuaaaaauggaaccccaagagguagaaucacuuggcgaaacuuacgauuucgauaguauaaugcauuaugcuagaaauacauuuucgagaggaauauuccuagacacuauaguaccgaaauacgaaguaaauggagugaaacccccaauaggccaaagaacuagacuaucaaaaggagacauagcacaggcaagaaaauuauauaaaugucccgcguguggugaaacauuacaagauucuacaggaaauuuuucaucuccugaauauccuaauggcuauagugcacacaugcauuguguauggcgcauuucaguaacaccaggagaaaaaauuauuuugaauuucacaagucuagacuuauacagaaguagauuauguugguaugacuauguagaagucagggauggauucuggagaaaagcuccucuaaggggaagauuuuguggaagcaaauuaccugaaccaauaguuagcacagauucaagacuuuggguagaauuuagaaguaguucaaauuggguaggaaaaggauuuuucgcaguguaugaagcaauuugcgguggagauguaaaaaaagacuaugggcacauacaaagcccaaacuauccugaugauuauagaccaucaaaaguauguauauggcgaauacaaguuagugaaggguuucacguaggauuaacuuuucaauccuucgaaauagaaagacaugacucuugcgcauaugauuauuuagaaguuagagacggacauagugagaguaguacucuaaucggaagauacugcggcuaugaaaaaccugaugacauuaaaagcacuagcucuagauuauggcuaaaauuuguaagugaugguagcauaaauaaggcagguuuugcaguaaacuuuuuuaaagagguugaugaauguucgaggccuaauagaggugguugugaacaacggugcuugaauacacuaggaagcuacaaaugcucaugcgauccaggcuacgaauuagcgccagauaaaagaagaugugaagcagcauguggaggauuuuugacuaaacuaaauggaucaauaacaaguccagguuggccgaaagaauacccuccuaauaaaaacuguauuuggcaacuuguagcaccuacucaauauagaauaucauugcaauucgauuuuuucgagacagaaggaaacgacguauguaaauaugacuuuguggaaguaagaaguggucuaaccgcugauaguaagcuacacggaaaauucugcgguagugagaaaccagaaguaauaacgucacaauacaauaauaugagaguugaauuuaagagugacaauacaguuucaaaaaaaggauuuaaagcacauuuuuucucagacaaagaugaguguaguaaagauaauggaggaugccagcaagacugcguaaauacauucggaagcuaugaaugucaaugucgauccggcuuuguauuacacgauaauaaacacgauuguaaagaagcuggaugcgaucacaaaguaacgaguacuagcggaacaauuacaagcccaaauuggccggacaaauaucccucaaaaaaagaauguacuugggcaauaucuucuacaccgggucauagagugaaauuaacauucauggaaauggacauagaaucacaaccagaaugugcauaugaucaccuugaaguauucgaugguagagaugcuaaagcuccaguacugggucgcuuuuguggaaguaaaaaacccgagccuguauuagcaacaggaucaagaauguuccuuagauucuacuccgacaauucaguacagagaaaagguuuccaagcuucucacgcaacagaauguggaggccaagugcgagcggauguaaaaacaaaagacuuauauucucacgcacaguuuggagacaauaauuauccaggagguguggauugugaauggguuauagucgcagaagaaggauacggaguagagcuagucuuucaaacauuugagguagaagaagaaacugauuguggauacgacuauauggaacucuuugauggauacgacucaacagcaccccgauuagguagauauuguggaucuggaccacccgaagaaguauauuccgcaggagacagcguauuagucaaguuccacuccgaugauaccaucacuaaaaaaggauuucaucuuagauauacaagcacaaaauuucaagacacucuucacagccgaaaauag

SEQ ID NO: 733 - RNA, 1191 nt, Artificial Sequence
  derived and/or modified CDS sequence (opt6) from Homo sapiens__NP_001191.1__HsBMP2
augguagcugguacuagaugccuacuagcauuacucuuaccacaaguauuacuaggaggagcagcaggauuagucccagaacuagguagaagaaaauucgcagcugccucaucaggaagacccagcucacaaccuucagacgaaguccuaucagaauuugaauugagauuacuaucaauguucggacuuaaacaaagaccaacaccaucaagagaugcaguaguaccaccauauaugcuagauuuauauagaagacacucaggacaaccaggaaguccagcuccagaccauagauuagaaagagcagcaaguagagcaaacacagucaggagcuuucaucacgaagaaucacuagaagaauuaccagaaacaucaggaaaaaccacaagaagauuuuucuuuaaccuuaguucaauaccaacagaagaauucaucacaagugcagaacuacaagucuucagggaacaaaugcaggacgcacuaggaaauaauucaucauuccaucauagaauaaauaucuaugaaauaauaaaaccagcaacagccaacucaaaauucccaguaacaagacuacuagacacaagacuaguaaaccaaaacgcaagcagaugggaaagcuuugauguaacaccagcaguaaugcgauggacagcacaaggucacgcaaaucacggauucguagucgaagucgcgcaucuagaagaaaaacaagguguaagcaaacgacauguaagaauaaguagaaguuuacaccaagaugaacauucauggucacaaauaagaccacuccuaguaacauucggacaugacgguaaaggacacccacuacacaaacgagaaaaaagacaagcaaaacauaaacaaagaaaaagacuaaaaucaucaugcaaaagacauccguuauauguugacuuuucagauguaggauggaacgacuggaucguagcacccccaggauaucacgcauucuauugucauggagaauguccauuuccauuagcagaucacuuaaauagcacaaaccacgccauuguacaaacucuagucaauucagucaauucaaaaaucccaaaagcaugcugcguaccuacagaacuaucagcaauuucaaugcuauaccuagacgaaaaugaaaaaguaguacuuaaaaacuaucaagacaugguuguagaaggauguggaugcagauaa

SEQ ID NO: 734 - RNA, 1227 nt, Artificial Sequence
  derived and/or modified CDS sequence (opt6) from Homo sapiens__NP_001193.2__HsBMP4
augauacccggaaacagaaugcuaaugguaguauuacuaugccaaguauuacuaggaggagcuagccaugccagcuuaauuccugaaacaggcaaaaagaaaguagcagaaauacaaggacacgcaggaggaagaagaucaggacaaagccaugaacuacuaagagacuucgaagcaacauuacuacaaauguuuggacuacgacgaagaccacaaccuaguaaaagcgcagucauaccagacuauaugagagaucuauaucgcuuacaaagcggagaagaagaagaagaacaaauacauucaacaggauuagaauacccagaaagacccgcaucaagagcaaauacagugaggucauuccaucaugaagaacaucuagaaaauauaccaggaacaucagaaaauucagcauucagauuuuuauucaauuuaaguucuauaccagaaaacgaaguaauaucaucugcagaacuaagauuauucagagaacaaguugaucaaggaccagacugggaaagagguuuucacagaauaaauaucuaugaaguaaugaaaccuccagcagaaguaguuccagggcaucuaaucacaagauuacucgauacaagauuaguacaccauaacguaacacgaugggaaacauuugauguaucaccagcaguucuaagauggacaagagaaaaacaaccgaauuacggauuagcaauagaaguuacucacuuacaucaaacaagaacccaccaaggacaacauguaagaauaucccgaucauuaccacaaggcucaggaaauugggcacaacuaagaccacuccucguaacauuuggacaugacggaagaggacaugcucucaccagaagaagacgagcaaaaagaucaccaaaacaccauagccaaagagcuagaaagaaaaauaaaaauugcagaagacauaguuuauacguugacuucucagauguaggauggaaugauuggauaguagcaccaccugguuaccaagcauuuuauugucacggagacuguccauuuccuuuagcagaucacuuaaacaguacaaaucacgcaauaguacaaacucuaguuaacucaguaaacagcucuauaccaaaagcaugcugugucccaacagaacuaucggcaauuucaauguuauauuuagaugaauaugauaaaguaguacuuaaaaauuaucaagaaaugguaguagaaggaugcggauguagauaa

SEQ ID NO: 735 - RNA, 1542 nt, Artificial Sequence
  derived and/or modified CDS sequence (opt6) from Homo sapiens__NP_001709.1__HsBMP6
augccaggauuaggucguagagcacaaugguuaugcugguggugggguuuacuauguucauguuguggcccaccaccccuaagaccaccauuacccgcagcagcggcugcagccgcaggaggacaacuauuaggagauggaggaaguccaggcagaacagaacaaccaccgccaagcccccaaagcucaucuggauuucuauacagaagauuaaaaacacaagaaaagagagaaaugcaaaaagaaauacuaucgguauuaggacugccacaucgacccagaccacuacacggauuacaacaaccccaaccacccgcacuucgacaacaagaagaacaacaacaacaacaacaacuaccaagaggcgaaccuccaccaggaagauuaaaaucagcaccacuauuuauguuagauuuauauaacgcauuaucagcagacaaugacgaagacggagcaucagaaggagaaagacaacaaucauggccccaugaagcagcaucaaguucacaacgaagacaaccaccuccaggagcugcucauccauuaaacagaaaaucacuucucgccccaggaaguggcucuggaggugcaaguccauuaacaucagcacaagauagcgcuuucuuaaaugaugcagauaugguaaugucauuuguaaaucuagucgaauacgauaaagaauuuucaccaagacaacgacaucauaaagaauuuaaauucaauuuaagucaaauaccugaaggugaaguaguuacagcugcugaauuucgaauauauaaagacuguguaaugggaucauuuaaaaaccaaacauucuuaauaucaauauaucaaguuuuacaagaacaucaacauagagauagugaucucuuuuuacuagauacaagaguaguaugggcuagugaagaagguugguuagaauuugacauaacagcuacgaguaauuuauggguuguaacaccacaacauaauaugggucuacaacuuagcguaguuacacgagaugguguacauguacacccaagagcagcaggucuaguaggaagggauggaccuuaugacaagcaaccauucaugguagcauucuuuaaaguaagcgaaguucauguaagaacuacaagaucagcuucaucaagaagaagacaacaaagucgaaacagaaguacacaaagucaagauguugcaagaguauccagugcaucugauuauaacaguagcgaacuaaaaaccgcauguagaaaacacgaauuauacgucagcuuucaagaucuaggauggcaagauuggauaaucgcaccaaaaggauaugcagccaauuauugugauggagaaugcaguuuuccuuuaaaugcacacaugaaugcaacaaaucacgcuauaguucaaacacuuguucacuuaaugaauccugaauacguaccaaaaccauguugcgcaccuacaaaauuaaacgcaauaucaguacuauacuuugaugauaauucaaacguaauacuuaaaaaguauagaaauaugguaguaagagcaugugguugucacuaa

SEQ ID NO: 736 - RNA, 1296 nt, Artificial Sequence
  derived and/or modified CDS sequence (opt6) from Homo sapiens__NP_001710.1__HsBMP7
augcauguaagaucacuccgagcagcagcaccacacucauuuguagcauuaugggcaccacuauucuuauuaagauccgcacucgcagacuucaguuuagacaaugaaguacacucaucauuuauacaucgaagauuacgaucccaagaaaggagagaaaugcaaagagaaauacucucaauacuagguuuaccccacagaccaagaccacaccuacaaggaaaacauaauuccgcaccaauguucaugcuagaucuauacaacgcaauggcaguagaagaaggaggaggaccaggaggccaagguuucucauacccauauaaagcaguauucaguacacaaggaccuccacuagcaucccuacaagauucucacuucuuaacugaugcagauauggucaugucauucguuaacuuaguagaacaugauaaagaauuuuuucacccaagauaucaccaucgugaauuuagauucgaccuaucaaaaauuccagaaggagaagccguaacagcagcagaauucaggauuuauaaagacuauauccgagaacgauucgacaacgaaacauucagaauaucaguauaucaagucuuacaagaacaucucggccgagaaucagacuuauucuuauuagauucgagaacucuaugggcaucugaagaaggaugguuaguauuugauauaacagcaacaagcaaucauuggguaguaaacccccgacauaaucuaggauuacaauuaucaguagaaacacuugauggccaaagcauuaacccaaaauuagcaggacuaauaggcagacaugguccacaaaacaaacaaccauucaugguagcauuuuucaaagcaacagaaguccauuucagaaguauaagaucaacaggaaguaaacaaagaucacaaaacagaucaaaaacaccaaaaaaucaagaagcacuaagaauggcuaacguagcagaaaauagcucuagugaccaaaggcaagccuguaaaaaacacgaauuauauguaucauucagagauuuaggauggcaagauuggaucauagcaccagaaggauaugcagcauauuacugugaaggagaaugugcuuucccauuaaacucauacaugaacgcaacaaaucacgcaaucguacaaacacucguacacuuuauuaauccagaaacaguaccaaaacccugcugcgcacccacacaauuaaacgcaauaucaguacuauacuuugacgauucaucaaacguaauauuaaaaaaauacagaaacauggucguaagagcaugugguugccauuaa

SEQ ID NO: 737 - RNA, 300 nt, Artificial Sequence
  derived and/or modified CDS sequence (opt6) from Homo sapiens__NP_006264.2__HsCCL7
augaaagcaucagcagcacuacuaugccuacuacuaacagcagcagcauucucaccacaaggacuagcacaaccaguaggaauaaacacaucaacaacaugcugcuacagauucauaaacaaaaaaauaccaaaacaaagacuagaaucauacagaagaacaacaucaucacacugcccaagagaagcaguaauauucaaaacaaaacuagacaaagaaauaugcgcagacccaacacaaaaauggguacaagacuucaugaaacaccuagacaaaaaaacacaaacaccaaaacuauaa

SEQ ID NO: 738 - RNA, 3624 nt, Artificial Sequence
  derived and/or modified CDS sequence (opt6) from Homo sapiens__NP_001954.2__HsEGF
auguuacuaacuuugauaauauuauuaccaguuguuucaaaauuuucuuuugugucauuaucugcaccgcaacacuggaguuguccagaaggaacucuagcuggaaauggaaauucuacauguguugggccugcaccauuucuaauauucagccauggaaacucaauuuucagaauagauacugagggaaccaacuaugagcaacucguugucgacgcuggaguaucuguaauaauggauuuucauuacaaugagaaacgcauauacuggguugacuuagaacgacaauuauuacaaagaguauuucuaaauggaagcagacaagaaaggguaugcaauauagagaaaaaugugaguggaauggcaaucaauuggauaaaugaagaagugauauggucaaaccaacaagaaggaauuauaacaguaacagauaugaaaggcaauaauagccauauacuguugagcgcccuuaaauauccagcuaacguagcaguagauccaguagaaagauuuauauuuuggaguucugaagucgcaggaucacuauaccgagcugaccuugauggaguagguguaaaggcuuuacuagaaacaucagagaaaaucacagcaguaagucuugacguacuagauaaaagauuauucuggauccaauauaaccgcgaagggucuaauucccuuauauguucaugugacuacgacggaggcucaguacauauaucaaaacauccgacccaacauaaucuauuugcuaugagccuuuucggggacagaaucuuuuauucgacauggaaaaugaaaacaauuuggauagcaaauaaacacacaggaaaagacaugguaagaauuaauuuacauagcucuuucguaccuuugggagaauuaaaaguaguacauccguuggcacagccuaaagcagaagacgauacaugggaaccugaacaaaaauugugcaaauugcgaaaaggaaacuguucaucgaccguuuguggacaagacuuacaaagucacuugugcaugugugcggaaggauaugcucuauccagagauagaaaauauugugaagaugucaacgaaugugcuuuuuggaaucauggaugcacacuaggaugcaaaaacacaccagguucuuauuacuguaccuguccaguagguuuuguuuuacuaccagacgguaaaagaugucaccagcuaguaucguguccacgcaacguaucugaauguucucacgauuguguacuuaccagcgaaggaccauuauguuuuuguccggagggaaguguacuagaacgugacgguaaaacauguucaggaugcucaucaccugauaacggugguuguagucaauuaugcgucccacuuaguccuguaaguugggaaugugacugcuucccaggauaugauuugcaauuagaugagaaaagcugugcagccagcggaccucaacccuuucuccuuuucgcaaacagccaagauauaagacauaugcauuuugauggaacugauuauggaacgcuauuaagucaacaaaugggaaugguuuacgcacuagaucaugauccuguagaaaauaaaauauauuuugcucacacagccuuaaaauggauagaacgggcaaauauggacgguagccaaagagaacgacuaaucgaagaaggaguagauguuccugaaggauuagcaguagauuggaucggaagacgauuuuauuggacggauaggggaaaaagccuaauugguagauccgaccuuaauggaaaaagaucaaaaauaauaacaaaagaaaacauaagccaaccacgcggaauugcgguacauccaauggcaaaacggcuauuuuggacagauacaggaauaaacccaagaauagaaaguucuucuuuacagggacuaggacgucuaguaauagcaagcuccgauuuaauuuggcccagugguauaacgauagacuuuuuaacugauaaacuauacuggugugaugcaaagcaaucagucauugaaauggcaaaucuagauggaucuaaaagaagaagacuaacucaaaacgauguaggacacccauuugccguagcaguauuugaagauuauguuugguucucagauugggcaaugccaagcguaaugagaguaaauaaaagaacaggaaaagauagagucagauugcaaggaagcauguuaaaaccguccagucuugucgucguucauccccuugcaaaaccaggugcggauccaugucuauaucaaaacggaggaugugaacauauuugcaagaaacgguuagguacugcauggugcagcugucgagaaggauucaugaaagcgagcgaugguaaaacauguuuagcacucgauggacaucaacuacuagcuggcggagaaguagaccugaaaaaccaagugacaccccuugauauacuuaguaaaaccagaguaagugaagauaauauaacggaaucacaacauauguuaguagcagaaaucauggugagcgaucaagaugauugugcacccguaggauguaguauguaugcaagaugcaucucagaaggagaagacgcaaccugccagugcuuaaaaggcuuugccggcgacggcaaacugugcucagauauugaugagugcgaaaugggugugcccguuuguccuccagcgucauccaaauguauaaauacagaaggagguuauguauguagaugcagcgaggguuaucaaggugauggcauacacuguuuggauaucgaugaaugucaauuaggagaacauucuuguggggaaaaugcaaguuguacaaauacagaaggagguuauacuuguaugugugcuggccguuuaagugaaccuggcuuaauauguccagacagcacuccgccuccucaccuaagagaggaugaucaccauuacagcguacgcaauagcgauucagaaugcccucuaagucacgacggguacugucuacaugacggaguauguauguacauagaggcuuuagauaaguaugcauguaacugugucguugguuacauaggagaaagaugucaauaucgagauuuaaaauggugggaauuaagacacgcgggacauggccaacaacaaaaaguaauagucguagccgucugcguaguuguucuaguaauguuacuacuacugagucuuuggggugcacacuauuauagaacacaaaaacuacuaucgaaaaaucccaaaaauccauaugaagaaagcaguagagauguaaggucaagacgaccggcugacacagaagaugggaugucaaguugcccacaaccaugguuuguaguaauaaaagagcaucaagaccuuaaaaacggaggucagccaguagcuggagaagacggucaggcugcggaugggaguaugcaaccaacaucuuggagacaagaaccucaacugugcggaauggguacggagcaaggcugcuggaucccugucagcucagacaaaggcagcuguccucaagugauggaacgaucauuccauaugccgucauacgggacacaaacguuggaaggaggaguggaaaaaccacauagucuauuauccgcaaacccauuauggcaacaacgagcauuagauccaccucaucaaauggaauuaacucaauaa

SEQ ID NO: 739 - RNA, 510 nt, Artificial Sequence
  derived and/or modified CDS sequence (opt6) from Homo sapiens__NP_001423.1__HsEREG
augacagcagguagaagaauggaaauguuaugcgcaggaagaguacccgcacuacuacuaugccuaggauuccaccuauuacaagcaguacuaucaacaacaguaauaccaagcugcauaccaggagaaucaucagacaacugcacagcacuaguacaaacagaagacaauccaagaguagcacaaguaucaauaaccaaaugcucaucagacaugaacggauacugcuuacacggacaaugcauauaccuaguagacaugucacaaaacuacugcagaugcgaagucggauacacaggaguaagaugugaacacuuuuuucuaacaguacaucaaccacuaucaaaagaauacguagcacuaacaguaauauuaauaauacuauuucuaauaacaguagucggaucaacauacuacuucugcagaugguacagaaacagaaaaucaaaagaaccaaaaaaagaauacgaaagaguaacaucaggagacccagaacuaccacaaguauaa

SEQ ID NO: 740 - RNA, 468 nt, Artificial Sequence
  derived and/or modified CDS sequence (opt6) from Homo sapiens__NP_000791.1__HsFGF1
auggcagaaggagaaauaacaacauucacagcacuaacagaaaaauucaaccuaccaccaggaaacuacaaaaaaccaaaacuacuauacugcucaaacggaggacacuuccuaagaauacuaccagacggaacaguagacggaacaagagacagaagcgaccaacacauacaacuacaacuaucagcagaaucaguaggagaaguauacauaaaaucaacagaaacaggacaauaccuagcaauggacacagacggacuacuauacggaucacaaacaccaaacgaagaaugccuauucuuagaaagacuagaagaaaaccacuacaacacauacauaucaaaaaaacaugcagaaaaaaacugguucguaggacuaaaaaaaaacggaucauguaaaagaggaccaagaacacacuacggacaaaaagcaauacuauuccuaccauuaccagucucaagcgacuaa

SEQ ID NO: 741 - RNA, 867 nt, Artificial Sequence
  derived and/or modified CDS sequence (opt6) from Homo sapiens__NP_001997.5__HsFGF2
augguugggguaggaggaggagacguagaagauguaacaccaaggccaggaggaugucaaauaagcggaagaggagcaagaggauguaaugggauaccaggagcggcagcaugggaagcugcauuaccaagaagaagaccuaggagacauccaaguguuaauccaagaucuagagcagcggggaguccaagaacaagaggaagaagaacagaagaaagaccaagugggucaagauuaggagauagagguagggggagagcauuaccagguggaagauuaggagguagaggaagaggaagagcaccagaaagagugggaggaagaggaaggggaagaggaacagcagcaccaagagcagcaccagcugcaagaggaaguagaccagggccggcaggaacaauggcagcaggaaguauaacaacauuaccagcauuaccagaagacggaggaucaggagcauuuccaccaggacauuuuaaagacccaaaaagauuauauuguaaaaacggaggauuuuuucuaagaauacauccagauggaagagucgauggugugagggaaaaaagugauccgcauauaaaauuacaauuacaagcagaagaacgaggaguuguaaguauaaaaggaguaugugcaaauagauaucuagcaaugaaagaagauggaagauuauuagcaaguaaauguguaacagacgaauguuuuuuuuuugaaagauuagaaagcaauaauuauaauacuuauagaaguagaaaauauacaagcugguauguagcuuuaaaaagaacaggacaauauaaacuaggaaguaaaacaggaccaggacaaaaagcaauacuauuucuaccaaugagcgcaaagucauaa

SEQ ID NO: 742 - RNA, 585 nt, Artificial Sequence
  derived and/or modified CDS sequence (opt6) from Homo sapiens__NP_002000.1__HsFGF7
augcacaaauggauacuaacauggauacuaccaacacuacuauacagaagcugcuuccacauaauaugccuaguaggaacaauaagccuagcaugcaacgacaugacaccagaacaaauggcaacaaacguaaacugcucaucaccagaacgacacacaagaucauacgacuacauggaaggaggagacauacgaguaagaagacuauucugcagaacacaaugguaccuaagaauagacaaaagaggaaaaguaaaaggcacucaagaaaugaaaaacaacuacaacauaauggaaauaagaacaguagcagucggaaucguagcaauaaaaggaguagaaucagaauucuauuuagcaaugaacaaagaaggaaaacuauacgcaaaaaaagaaugcaacgaagacugcaacuucaaagaauuaauacuagaaaaccacuacaacacauacgcaucagccaaauggacacacaacggaggagaaauguucguagcacuaaaccaaaaaggaauaccaguaagaggaaaaaaaacaaaaaaagaacaaaaaacagcacacuuccuaccaauggcaauaacauaa

SEQ ID NO: 743 - RNA, 627 nt, Artificial Sequence
  derived and/or modified CDS sequence (opt6) from Homo sapiens__NP_001936.1__HsHBEGF
augaaacuacuaccaucaguaguacuaaaacuauuuuuagcagcaguacuaucagcacuaguaacuggagaaucacuagaaagauuaagaagaggacuagcagcaggaaccucaaauccagacccaccaacaguaagcacagaccaauuauuaccacuaggaggaggaagagacagaaaaguaagagaccuacaagaagcagaccuagaccuauuaagaguaacacuaucaucaaaaccacaagcacuagcaacaccaaacaaagaagaacacggaaaaagaaaaaaaaaaggaaaaggacuaggaaaaaaaagagacccaugccuaagaaaauauaaagacuucugcauacacggagaaugcaaauacgucaaagaacuaagagcaccaagcugcauaugccaccccggauaccauggagaaagaugccacggacuaucacuaccaguagaaaaccgacuauacacauacgaucacacaacaauauuagcaguaguagcaguaguauuaucaucaguaugcuuacuaguaauaguaggacuauuaauguucagauaccacagacgaggaggauacgauguagaaaaugaagaaaaaguaaaacuaggaaugacaaauucacauuaa

SEQ ID NO: 744 - RNA, 2187 nt, Artificial Sequence
  derived and/or modified CDS sequence (opt6) from Homo sapiens__NP_000592.3__HsHGF
auguggguaacuaaacuuuuaccagcguuauuacuccaacacguauuacuacaccuccuauuauuaccaauagcuauaccauaugcagaaggacaaagaaaacgcagaaacaccauacaugaauuuaaaaaaucggccaaaacaacucuaaucaaaauagauccagcauuaaaaauaaaaacaaaaaaaguuaacacagccgaucaaugugcaaaccgcugcacacguaauaaaggccuaccauucacaugcaaagcauuuguauuugauaaagcacguaagcaaugucuaugguuuccauuuaauagcaugagcucuggcguaaaaaaagaauuuggacaugaauuugaccuauacgaaaauaaagacuauauuagaaacuguauuauaggaaaaggaagaucauauaagggcacaguauccauaacaaaaucaggaauuaaaugucaaccauggucauccaugauaccccacgaacauucauuuuuaccaucaaguuauagaggaaaagauuuacaagaaaacuauugccgaaacccaagaggagaagaaggcggaccuugguguuuuacaucaaacccagaagucagauaugaaguuugugauauaccccaauguucagaaguagaauguaugacauguaauggagaaucauauagaggucuaauggaucacacagaaagugguaagauaugccaaagaugggaucaucagacaccacaccgacauaaauuuuuacccgaaagauacccugauaaaggauuugaugauaauuacugucgaaacccugaugggcagccaagaccaugguguuauacuuuagacccccacacaagaugggaauauugcgcuauaaaaacaugcgcggauaauacaaugaaugauacagauguacccuuagaaacuacugaauguauacaaggacaaggugaggguuaucgcggcacugucaauacuauauggaauggcauccccugucaaagaugggauucacaauauccccaugaacaugauaugacaccagaaaacuuuaaauguaaagauuuacgagaaaauuauugccguaauccagaugguucagaaucucccuggugcuuuacaaccgauccaaauaucagagucggguacuguucacagauaccaaauugcgacaugucucauggucaagauuguuauaggggaaacggaaaaaauuauaugggaaacuuaucucaaacuagaucagguuuaacuuguaguaugugggauaaaaauauggaagauuuacacagacauauauucugggaaccugaugcaagcaaacuaaacgaaaacuacuguaggaauccagacgaugaugcacauggcccuuggugcuauacaggaaauccauuaaucccgugggauuauugucccauaucgcgaugugaaggcgacacaacgccaacuauaguaaaccuagaucauccagugauaucaugugcaaaaacuaaacaauuaagagucguaaauggaauaccaacaagaacaaacauuggauggaugguaucacuccgauacagaaauaaacauauauguggaggaucauuaauaaaagaaagcuggguuuuaaccgcaagacaauguuuuccaucucgagaccuuaaagacuaugaagcaugguuaggaauacacgacguacaugguagaggagacgaaaaauguaaacaaguacuaaauguuucccaacuuguauaugguccagaagguucagauuuaguauuaaugaaauuagcgagacccgcaguuuuagaugauuucguaagcaccauagaccuaccgaauuauggauguacuauaccagaaaaaacaaguuguaguguauacggauggggauauacaggccuaauaaauuaugacggauuacuaagagucgcacacuuauauauaaugggaaacgaaaaauguucacaacaucacagagguaaaguaacauuaaaugaaagugaaauaugugcaggagcugaaaaaauaggcucaggaccgugugaaggagauuauggaggcccacuaguaugugaacagcacaaaaugagaaugguacuaggaguaauaguaccaggccgaggaugugcaaucccaaacagaccaggaaucuuuguuagagucgcuuacuaugcuaaauggauacauaaaauaauacuaacauauaaaguaccacaaucauaa

SEQ ID NO: 745 - RNA, 1926 nt, Artificial Sequence
  derived and/or modified CDS sequence (opt6) from Homo sapiens__NP_005336.3 __HsHSPA1A
auggcaaaagcagcagcaauuggaauagauuuggguacaacauacaguugcgugggcguguuucaacacggaaaaguagaaauaauagcaaacgaucaaggaaacaggacaacaccaucauacguggcauuuacagacacagaacgauuaauaggggacgcugcuaaaaaccaaguagcauuaaacccccaaaacacaguguucgaugcgaaaaggcuuauaggucggaaauuuggggaucccguaguccaaagcgauaugaaacauuggccauuccaagucauuaaugauggagauaaaccaaaagugcaaguaaguuacaagggugaaacaaaagcauuuuacccggaagaaauaucaaguaugguacuaacuaaaaugaaggaaauagcugaagcauaccuaggauacccaguaacaaaugcgguaauaacagugccagccuacuuuaacgauucgcaacgacaagcaacgaaagacgcaggggucauagccggucuaaaugucuuaagaauaauaaaugaaccaacagcagcagcgauagcuuacggacuagauagaacaggaaaaggugaaagaaacguacuaauauuugauuugggaggaggaacauuugacguaucgauauuaaccauagaugacggcauauuugaaguaaaggcaacggcaggagacacacaucugggaggagaagacuuugauaaucggcuaguaaaucacuuugucgaagaauuuaaaagaaaacacaagaaagauauaagucaaaacaaaagagcaguaagaagacuuagaaccgccugcgaaagagcaaaaagaacacuaagcucaucaacacaagcaaguuuggaaauagauucauuauuugaagguauagacuucuauacuucaauuacaagagccagauucgaagaacuauguagugauuuauuuagaaguacguuagaaccgguagaaaaagcguuaagagaugcuaaacuagauaaagcucaaauccaugaucuaguauuaguaggaggaaguacaagaauaccaaaagugcaaaaauuacuucaagauuucuuuaacggaagagaucuaaauaaaucgauaaauccagaugaagcgguagcguacggagcagcaguacaagcagcaauauugaugggagauaaaagugaaaacguucaagauuuauuauuacuagauguagccccauuaaguuuaggacucgagacagcugguggaguuaugacagcgcuaauaaaaaggaacucaacaauaccaacaaaacaaacacaaauauuuacaacauauagugauaaucaaccaggaguacuaauacaaguauaugaaggagaaagagcgaugacaaaagacaauaauuuacuuggaagauucgaacuuaguggaauaccaccagcaccacgaggaguaccacaaauagaaguaacguuugauauugacgcaaacggaauacuaaauguaaccgcuacagauaaaagcacaggaaaagcaaacaaaauaacuauaacaaaugauaaagguagauuaaguaaagaagaaauagaacguaugguacaagaagcagaaaaauacaaagcagaagacgaaguacaaagagaaagggucagcgcgaaaaaugcacuagaaaguuacgcauucaauaugaaaagugcaguagaagaugaaggacucaaaggaaaaauaagugaagcagauaaaaagaaagucuuagauaaaugucaagaagugauaagcuggcuagaugcaaauacauuagcugaaaaagacgaauuugaacauaaaagaaaagaacuagagcaaguaugcaacccaauaauaaguggcuuguaccaaggggcaggaggaccggggccaggaggcuuuggagcucaaggaccuaaaggaggaagcgguagcggaccaacaauagaagaaguagacuaa

SEQ ID NO: 746 - RNA, 1926 nt, Artificial Sequence
  derived and/or modified CDS sequence (opt6) from Homo sapiens__NP_005337.2 __HsHSPA1B
auggcaaaagcagcagcgauaggaauagauuuagggacaacuuauaguuguguaggaguauuccaacauggaaaaguagaaauaauagcuaaugaccaaggaaauagaacaacuccuaguuauguagcauuuacagacacagaaagacuaauaggagacgccgcuaaaaaucaaguagcccucaauccacagaauacaguauucgacgcaaaaagacuuauagguaggaaauucggagauccagugguacaaagcgauaugaaacauuggccauuucaaguaauaaaugacggagauaaaccaaaaguacaaguaucauacaaaggagaaacaaaagcauuuuauccugaagaaaucucaaguaugguacuaacaaagaugaaggaaauugcagaagcauaucuuggauacccaguaacgaacgcaguaauaacaguaccugccuacuuuaacgacagccaacgucaagcaacuaaagacgcaggaguaauagcuggucuaaacguacuuagaauuaucaaugaaccaacugcagccgcaaucgcauacggacuagaccgaacgggaaaaggagaaaggaauguauuaauuuucgaccuaggaggaggaacauucgaugucucuauauuaacuauagacgauggaauuuuugaaguaaaagcaacggcaggagacacgcauuuaggaggagaagauuucgauaaccgucuaguaaaucauuucguugaagaauuuaaaagaaaacauaaaaaggacauuucgcaaaauaaaagagcagugagaagauuaagaaccgccugugaaagagcaaaaagaacauuaagcagcaguacgcaagcaagccuugaaauagauucacuauuugaaggaauagauuucuacacaucaauaacaagagcucgauuugaagaauuauguagcgacuuguucagaucaacauuagagccaguagaaaaagcacuaagagacgcaaaauuagacaaagcacaaauacaugaccuaguauuaguuggaggcaguacacgaauaccaaaaguacaaaaacuucuacaagacuucuuuaauggaagagaucuaaauaaaucaauaaauccagaugaagcaguagccuacggugcggcgguucaagcagcaauacugaugggggacaaaucagaaaauguacaagauuuauuauuauuagauguggcaccacuaucauuaggauuagaaacagcuggagguguaaugacagcacuaauuaaacgaaacagcaccauaccaacgaaacaaacacaaauauuuaccacguacucggacaaucaaccgggaguauugauacaaguauacgaaggagaaagagcaaugacuaaagacaacaaucuauuaggaagauucgaauuaucaggaauaccgccagcaccaagaggaguaccacaaauagaaguaacauucgauauagacgcaaauggcauuuuaaacguaacagcaacagacaaaucaacagguaaagcaaacaaaauaacaauaacaaaugauaaaggaagacuaucuaaagaagaaauagaaagaaugguacaagaagccgaaaaauacaaagcagaagaugaaguucaaagagaacgugugagugccaagaaugcacuugaaucguaugcguucaauaugaaaagcgcaguagaagaugagggccuaaaaggaaaaauaucagaagcagacaaaaagaaagucuuggauaagugucaagaaguaauaaguugguuagaugcaaacacacucgcagaaaaagaugaauuugaacauaaaagaaaagaacuagaacaaguaugcaauccaauaauaucaggguuauaccaaggagcaggcggaccaggacccgggggauucggugcccagggaccaaaaggcgguaguggcagcggaccaaccauugaagaaguagauuaa

SEQ ID NO: 747 - RNA, 1926 nt, Artificial Sequence
  derived and/or modified CDS sequence (opt6) from Homo sapiens__NP_005518.3 __HsHSPA1L
auggcuacagcaaaaggaauagcaauaggaauagauuuaggaacaacauauucguguguuggaguauuccaacacggaaaaguagaaaucauagcaaaugaccaaggaaacagaacaacaccaagcuauguagcauuuacggauacagaaagauuaauaggagacgcagccaaaaaccaaguagcuaugaauccacaaaauacaguauucgaugcaaaaagacuaauaggaagaaaauuuaaugacccaguaguacaagcagauaugaagcuauggcccuuccaaguuauaaaugaaggagggaaaccaaaaguucuaguaaguuauaaaggugaaaauaaagccuucuauccagaagaaauaucaagcaugguccuaacaaaacuaaaagaaaccgcagaagcauucuuaggacauccugucacuaacgcaguaauaacaguaccagcauacuucaacgauagucaacgucaagcaacaaaagaugcuggaguuauagcaggacuaaauguacuacgaauaaucaacgaaccgacagcagcagcuauagcauauggacucgacaaaggcggacaaggagaaagacacgugcucaucuucgacuuaggcgguggcacauuugauguauccauacuaaccauugacgauggaauuuucgaaguaaaagccacagccggagacacccaucuagggggagaagauuucgauaaccgguuaguaagucacuucguagaagaauuuaaaagaaaacacaagaaagauauaagucaaaauaaacgagcaguaagaagauuaagaacagcaugugaaagagccaaaagaacacuuaguaguucaacacaagcaaacuuagaaauagauucauuauacgaaggaauagauuucuauaccaguauaacaagagcaagauuugaagaacuaugcgcugauuuauuucgcggaacauuagaacccgucgaaaaagcauuaagagaugcaaaaauggauaaagcaaaaauacacgacauaguauuagugggagguagcacgcgaauaccaaagguucaacgauuauuacaagacuauuuuaauggcagagaccucaauaaaaguauaaacccugaugaagcaguugcauacggagcugcaguacaagcagcuauacugaugggagacaaaucagaaaaaguacaagaucuccuacuacuagacguagcuccacuaucacugggucuugagacagcgggaggcguaaugacagcauuaauuaaaaggaacucgaccauacccacaaaacaaacacaaauauuuaccacauauucagauaaccaaccuggagugcuuauucaaguauacgaaggagaaagagcaaugacgaaagauaauaacuugcuaggaagauuugaucuaacagggauuccaccagcaccaagaggcgugccacaaauagaagucaccuucgacauagacgcaaacggaauauuaaacgucacagcaaccgauaaaucaacagguaaggucaauaaaauuacaauaacaaacgauaaaggaagacuaucaaaagaagaaauagaaagaaugguacuagaugcagaaaaauacaaagcagaagacgaaguacaaagagagaaaauagcagcuaaaaacgcgcuagaaaguuacgcauuuaacaugaaaaguguaguaucugaugaaggauuaaaaggcaaaauuucagaaagcgauaaaaauaaaauacuagacaaaugcaaugaacuacuuaguugguuagaaguaaaucaacuagccgaaaaggaugaauuugaccauaaaagaaaagaacuggaacaaauguguaaucccaucauaacaaaacuauaucaaggaggcugcacaggaccagcauguggaaccggauauguaccaggacguccagcaacaggaccaacaauagaagaaguagacuaa

SEQ ID NO: 748 - RNA, 1920 nt, Artificial Sequence
  derived and/or modified CDS sequence (opt6) from Homo sapiens__NP_068814.2 __HsHSPA2
augucagcaagaggaccagcaauugggauagaucuaggcacaacuuacucaugcguagguguauuccaacacggaaaaguagaaauuauagcaaacgaucaagggaacagaacaacaccaaguuauguagcauuuacagacacugaaagauuaauaggugacgcagcuaaaaaucaaguagcaaugaacccuacaaacacaauuuuugacgcaaaacgacuaaucggaagaaaauucgaagacgcaacaguacaaucagauaugaaacauuggccguucagaguaguaagcgaaggagggaaaccaaaaguacagguugaauacaaaggagaaacaaaaacuuucuucccagaagaaauuaguaguaugguccucacaaaaaugaaagaaauagcagaagcauaccuuggaggaaaaguucacucagcaguaauuacaguaccagcauacuucaacgauucccaaagacaagcaacgaaagacgccgguacaauaacaggauuaaacguguuaagaauuauaaacgaaccuaccgcagcagccauagcguauggauuagauaagaaaggaugugcaggaggagagaaaaauguauuaauauuugacuuaggcggugggacauuugauguaaguauacugacaauagaagaugggauauuugaagucaaaucgacagcaggagacacacauuuagggggagaagacuuugacaacagaaugguaagccaucuagcagaagaguucaaaagaaaacacaagaaagacauaggacccaauaaaagagcugucaggagacuuagaacagcaugcgaaagagcaaaaagaacauuaucaaguucaacacaagcaaguauagaaauagauucgcuauaugaaggaguugauuucuauacaaguauaacaagagcaagauuugaagaacuaaacgccgaucuauuuagaggaacauuagaaccgguugaaaaagcacuuagagacgcaaaauuggauaaaggccaaauacaagaaauuguucuaguaggaggaaguacacgcauuccaaaaauacaaaaacuauuacaagacuuuuucaauggaaaagaacucaauaaaucaauaaacccugaugaagcgguagcguauggugcagccguacaagccgcaauauuaaucggagacaaaagugaaaacguacaagaccuacuauuguuagauguaacaccauuaucacucggaauugaaacagcuggaggaguaaugacaccacucauaaaaagaaauacaaccauucccacaaaacaaacacaaacauucacaacguacagcgauaaccaaaguagcguccuaguacaaguauaugaaggcgaaagagcaaugaccaaagacaacaaucuauuaggaaaauucgacuuaacaggaauaccuccagcaccaaggggaguaccacaaauagaaguuacauuugacauagaugcuaacggaauauuaaacguaacagcagcagauaaaagcacaggaaaagagaauaaaauaacaauuacaaacgauaaaggaagacuaagcaaagacgauauagauagaaugguacaagaagcagaaagauauaaaagcgaagacgaagcuaacagggaucgagucgcagccaaaaaugcauuggaaagcuauacauacaauauaaaacaaacuguagaagaugaaaaauuaagaggaaagauaagugaacaagauaaaaauaaaauuuuagacaaaugucaagaaguuauaaacugguuagauagaaaccaaauggccgaaaaagacgaguacgaacauaaacaaaaagaacuagaaagagucuguaaucccauaauuagcaaauuauaccaaggaggacccggagguggaaguggaggaggaggaucaggagcaagcggaggcccaacaauagaagagguugauuaa

SEQ ID NO: 749 - RNA, 2523 nt, Artificial Sequence
  derived and/or modified CDS sequence (opt6) from Homo sapiens__NP_002145.3 __HsHSPA4
augagcgugguagguauagaucuuggauuccaaucauguuacguugccguagcaagagcaggaggaauagaaacaauagccaacgaauacagugacagauguacaccggccugcauauccuuuggaccuaaaaacagaucaaucggcgcagccgcaaaaucacaagugauuucaaaugcuaaaaacacagugcaagguuucaaaagauuccacggacgagcauuuagcgacccauuuguugaagcagaaaaaucaaacuuagcuuaugauaucguacaauuacccacaggacuaacagguauaaaagucacauauauggaagaggaaagaaacuucacaaccgaacaaguaaccgcgaugcuauuaucaaaacucaaagaaacagcagaauccgucuuaaagaaaccugucguugacuguguaguaucaguacccugcuucuacacagacgcagaaagaagauccguaauggaugccacacaaauagcuggucugaauugcuuacgacuaaugaaugaaacgacggcaguugcauuagcuuacggaauauauaaacaagacuuacccgcacuagaagaaaaaccaagaaacgucguauuuguagauaugggucacagugcauaucaaguguccguaugugcuuuuaacagagguaaacuaaaaguauuagcaacagcuuuugauacuacuuuaggcggacgaaaauuugaugaaguucuaguaaaucauuuuugcgaagaauuugguaagaaauacaaacucgauaucaaaucaaaaauacgugcauuauuacgacuuucacaagaaugugaaaaacuaaagaaauuaaugagugcaaacgcaagcgaccugccuuuaucuauagaauguuucaugaacgauguagauguaucgggcacaaugaacagagguaaauuccucgaaaugugcaacgaucuguuagcaagaguagaaccaccacuacgaaguguauuagaacaaacaaaacuaaagaaagaagacauuuaugcaguagaaauaguuggaggggcaacacgaauaccagcgguaaaagagaaaauuucaaaauucuuuggcaaagaauuaucaacuacacuuaaugcagaugaagccguaacuagaggaugugcacuccaaugugcaauauuaucaccagcuuucaaaguaagagaauuuagcauaacagauguaguaccauacccaauuucacugagauggaacucaccagcagaagaagggucauccgacugcgaaguauucaguaaaaaucaugcugccccuuuuucaaaaguacuaacauucuauagaaaagaaccuuuuacccuagaagcauacuauucaucaccccaagaucuuccauaccccgauccagcaauagcccaauuuagcgugcaaaaaguuacaccucaaagugauggaucaagcaguaaaguuaaaguaaaaguccgugugaacguucaugguauauuuaguguaucuucagccagccuaguagaaguacacaaaagcgaagaaaaugaagaaccaauggaaacggaucaaaaugcuaaagaagaagagaaaaugcaaguagaccaagaagaaccacauguagaggaacaacaacaacaaacacccgcagaaaacaaagccgaaagugaagaaauggaaacaucucaagcaggaucaaaggauaagaaaauggaucaaccuccucaagcgaagaaagcaaaaguaaaaacaucuacagucgaucuuccaauagaaaaccaacuuuuauggcaaaucgauagagaaauguuaaaccuauauauagaaaacgaaggaaaaaugauaaugcaagacaaauuagaaaaagaaagaaacgacgcuaaaaacgcaguagaagaauauguuuaugaaaugagagauaaacugagcggagaauacgaaaaauucguaagcgaagacgaucgaaauucauucacccuaaaacuugaagacacugaaaacuggcucuacgaagauggagaagaccaaccaaaacaaguauacguagauaaacuagcagaacugaaaaaccuaggacaaccaauaaaaauaagauuccaagaaagugaagaacguccuaaauuauucgaagaacuaggaaaacaaauacaacaauauaugaaaaucauaucaaguuuuaaaaacaaagaagaucaauacgaccacuuagaugccgcagacaugacaaaaguagaaaaaucuacuaacgaagccauggaauggaugaauaauaaauuaaaccuccagaacaaacaaucgcuaacaauggauccaguggucaaaucaaaagaaauagaagcaaaaauuaaagaacuaacaaguacuugcucaccaaucauaagcaaaccaaaacccaaagucgaaccaccaaaagaagaacagaaaaacgcagaacaaaauggaccaguagacggccaaggugacaacccaggaccacaagcagcggaacaagguacugacacagcaguacccucagacagugauaagaaacuaccagaaauggauauagacuaa

SEQ ID NO: 750 - RNA, 2520 nt, Artificial Sequence
  derived and/or modified CDS sequence (opt6) from Homo sapiens__NP_055093.2 __HsHSPA4L
augucaguagucggaauugaccuuggauuuuuaaacugcuacauagcaguagcuaggucaggaggaaucgaaacaauagcaaacgaauauagcgauagaugcaccccugccugcauaucauuaggaucacgcacuagagcaaucgggaacgcagccaaaucacaaauaguuacaaacguaagaaauacaauccacggauucaaaaaacuacacggcagguccuuugaugauccaauaguacaaacggaaagaauaagacuacccuacgaacugcaaaaaaugcccaauggaagugcaggcgucaaagucagauaucuagaagaagaaagaccuuuugcaauagaacaaguaaccggaauguuauuggcuaagcuaaaagaaacuucagaaaacgcauuaaagaaaccuguagcagauuguguuauaucaauaccaucguuuuucacagaugcagaacgaagaucaguaauggcagcagcacaaguagccggccuaaacugucuucgacuaaugaaugaaacaacugcaguugcccuagcuuauggaauuuauaaacaagauuuaccuccucuagacgaaaaacccaggaacguaguauucauagauaugggucauagugcauaucaaguucuagugugugcauuuaauaaaggaaaauuaaaaguccuagcaacaacauucgauccguaucuaggagggcgaaacuucgaugaggcacugguagacuacuuuugugacgaauucaaaacgaaauacaagauuaacguaaaagaaaacagcagagcucuucuaaggcuauaccaagaaugugaaaaacucaaaaaauuaauguccgcuaaugccucagaccuaccacuaaauauagaauguuucaugaaugauuuagaugugucaaguaaaaugaacagagcacaauuugaacaauuaugcgcaucauuacuagcucgaguagaaccaccauuaaaagccguaauggaacaagcuaauuuacaacgagaagauaucucaucaauagaaaucguuggaggagccaccagaauuccagcgguaaaagaacaaauuacuaaauuuuuucuuaaagacaucucaacaacacuaaaugcugacgaagcaguugcccggggaugcgcccuccaaugugcaauacuuagcccugcauuuaaaguacgagaauuuucaauaacagacuuaguuccauauucgaucacauuaagauggaaaacaucauucgaagacggcagcggcgaaugugaaguauucugcaaaaaccacccagccccuuuuagcaaaguaauaacauuucauaaaaaagaaccguuugaauuagaagcauuuuacacaaacuuacacgaaguaccauacccugaugcacgaauagguagcuuuacuauacaaaacguauucccacaauccgauggcgacagcucaaaaguuaaaguaaaagucagaguaaacauacauggaauuuucucugucgcaucagcaucuguuaucgaaaaacaaaaucuagaaggggaccauuccgacgccccaauggaaaccgaaacaagcuuuaaaaaugaaaacaaagacaauauggauaaaaugcaaguagaucaagaagaaggacaucaaaaaugccaugcugagcauacaccagaagaagagauagaccacacuggggcaaaaacaaaaucagccguuucagauaaacaagauagauuaaaucaaacacuaaaaaaaggcaagguaaaaucuauugauuuaccaauccaauccucacucugcagacaauuaggacaagaucuauuaaauagcuauauagaaaaugaaggaaaaaugaucaugcaagacaaacuagaaaaagaaagaaacgacgccaaaaaugcaguugaagaauacguauaugauuucagggaccgacuaggaaccguuuaugaaaaauuuauaacgccagaagaccuuucaaaacuaagugcaguauuagaagacacagagaacugguuauaugaagauggagaagaccaaccaaaacaaguauacguugacaaauuacaagaacuaaagaaauacggacaaccaauacaaaugaaauacauggagcacgaagaacguccaaaagcacuaaacgaccuaggcaaaaagauccaacuuguaaugaaaguaauagaagcuuauagaaauaaagaugaacgguaugaccaucuugaccccacagaaauggaaaaaguugaaaaaugcauaagcgacgcaaugagcuggcucaacagcaaaaugaacgcacaaaacaaauuaucacuaacacaagauccaguaguaaaagucagugaaauaguagcaaaaucaaaagaacuagacaauuucuguaauccaauaauauacaaacccaaaccaaaagccgaaguccccgaagacaaaccaaaagcaaacucagaacauaaugguccaauggauggacaaucuggaacagagacaaaaucagacucaacuaaagauucaucccaacauaccaagaguagcggggaaauggaagucgacuag

SEQ ID NO: 751 - RNA, 1965 nt, Artificial Sequence
  derived and/or modified CDS sequence (opt6) from Homo sapiens__NP_005338.1__HsHSPA5
augaaauuaaguuugguggcagcaaugcuauuauuauuaagcgcugcaagagcagaagaagaggauaaaaaagaagauguugguacggugguuggaauugaccuuggaacaacauacagcugugucggaguauuuaaaaauggaagaguugaaauuauagcuaacgaucaggggaauagaauaacaccaaguuacguagcauucacaccagagggagaaagauuaaucggagacgcagcaaaaaaccaacuuacuaguaauccagaaaauacaguauucgaugcaaaaagauuaauaggaagaacauggaacgacccuuccguacaacaagauaucaaauuccuaccauuuaaaguuguagaaaaaaagacaaaaccauacauacaagucgauauaggaggaggacaaacaaaaacauuugcgccagaggaaaucagugcaaugguauuaacuaaaaugaaagagacagcagaagcauacuuagguaaaaaaguaacacacgcaguagucacaguaccagcauauuuuaacgacgcacaaagacaagcaacaaaggaugcaggaacaaucgcaggauuaaacguaaugagaauaauaaaugagccaacagcagcagcaauugcauauggauuagacaaacgagaaggugagaaaaacauccugguauucgacuuaggagggggcacauuugacguaaguuuauuaacuauagauaauggaguauuugaaguaguagcaacaaacggugacacacauuuaggaggagaagauuucgaucagagaguaauggaacauuuuauaaaauuauacaaaaaaaaaacaggaaaagauguaaggaaagacaauagagcagugcaaaaacuuaggagagaagucgaaaaagcaaaacgagcccuaaguagccaacaucaagcaagaauagaaauagaaagcuuuuaugaaggggaagacuucagugaaacacuuacgagagcaaaauuugaagaauuaaacauggaccuauuuagaagcacaaugaaaccuguacaaaaagugcucgaagauucagaccuaaaaaaaagcgacauagaugagauugucuuaguaggaggaaguacaagaauuccaaaaauccaacaacuaguaaaagaauuuuucaauggaaaagaaccuaguagaggaauaaacccagacgaagcaguagcauauggagcugcaguacaagcuggaguucuaaguggcgaccaagacacaggagacuuaguauuacuagacguauguccguuaacauuaggaauagaaacaguaggaggaguaaugaccaaauugauaccuaggaacacuguuguaccaacgaaaaaaucacaaauauuuaguacagcaucagauaaccaaccaacuguaacuauaaaaguauacgaaggagaaaggccucuaacaaaagacaaucaccuucugggaaccuuugaucucacaggaauaccaccagcaccacggggaguaccgcaaauagaaguaacauucgaaauagacgucaacgguauucuaagaguaacggccgaagauaaaggaacaggaaacaagaauaagauaacuauuacaaaugaccaaaaucgauuaacuccagaagaaauagaacgaauggucaacgacgcagaaaaauuugccgaagaagauaaaaaauuaaaagagagaauagauacucgaaacgaacuagaaaguuacgccuacucacucaaaaaccaaaucggggauaaagaaaaguuaggagguaaauuaucaagugaagauaaagaaacaauggaaaaagcagucgaagaaaaaauugaauggcuagaaucacaccaagacgcagauauagaagauuucaaagcaaaaaaaaaagaauuagaagaaauuguacaacccauaauuaguaaauuauauggaagugcagggccaccaccaacaggcgaagaagacacagcagaaaaagaugaauuauaa

SEQ ID NO: 752 - RNA, 1932 nt, Artificial Sequence
  derived and/or modified CDS sequence (opt6) from Homo sapiens__NP_002146.2__HsHSPA6
augcaagcaccaagagaacuagcgguaggaauagauuuaggaacaacuuacucauguguaggaguauuucaacaaggaagaguagaaauauuagcaaaugaccaaggaaauagaacaacacccucauacguagccuuuacagacaccgaacgauuaguaggagaugcagcaaaaagccaagcagcacucaacccacauaauacggucuuugacgcaaaaagauuaauaggccgaaaauuugcggauacuacaguacaaagugauaugaaacacuggcccuuucgaguaguaucugaaggaggaaaaccgaagguaagaguauguuaucgaggagaagacaaaacauucuauccagaagaaauaucuucuaugguauugucgaaaaugaaagaaacggcugaagcguaucuaggacaaccaguaaaacaugcaguaauaacuguaccagcuuacuuuaaugauagccagagacaagcaacaaaagaugcaggagccauagcaggauuaaauguauugaggauaauaaaugaaccaacugcagccgcaauagcauacggguuagaccgaagaggagccggugaaagaaaugucuuaauauuugauuugggcggaggaacauuugauguaaguguauuaucaauagacgcaggaguuuuugaagucaaagcaacggcaggagacacacauuuaggaggggaagacuuugauaauaggcuaguaaaucauuucauggaagaauuucgaagaaaacacggaaaagauuuaucuggaaauaaacgagcuuuaagaagguuaagaacagccugugaaagagcaaaaagaacauuaucaucaaguacacaagcaacauuagaaauugacucacucuucgaaggagucgacuucuauacaucaauaacacgagcaagauuugaagaacuaugcucagaucuauuucgaucaacauuagaaccaguggaaaaagcauugcgggaugcgaaauuagacaaagcacaaauacaugacguaguuuuaguaggcggcucaacaagaauaccaaaagugcaaaaacuauuacaagauuucuucaacgggaaagaauuaaacaaaucaauuaauccggaugaagcuguagcuuauggagcagcaguucaagccgccgucuuaaugggagacaaaugcgaaaaaguucaagauuuauuacuacuagauguggcaccacucucucuuggucucgaaacagcgggaggaguuaugacuacguuaauccaaagaaaugcaacaauuccaacaaaacaaacccagacauucacaacauacucugauaaucaaccaggagucuuuauacaaguuuacgaaggcgaacgagcaaugacaaaagauaauaauuuauugggaagauuugaacuuucaggaauacccccagcaccuagaggaguaccucaaauagaaguaaccuucgacauagacgcuaauggaauacuuagcguaacugcaacugauagaaguacaggaaaagcaaacaaaauaacaauaacaaacgauaaaggccgacuaagcaaagaagaaguagaaagaaugguacaugaagcugaacaauacaaagccgaagaugaagcacaacgagauagaguugcagcuaaaaauagucuagaggcacauguauuucauguaaaaggcagccuacaagaagagagcuuaagagacaaaauaccagaagaagacagaagaaaaaugcaagauaaguguagagaaguauuggcaugguuagaacauaaucaauuagcagaaaaagaagaauaugaacaucaaaaacgagaauuagaacaaauaugucgaccaauauuuucaagguuauauggaggcccaggaguaccagggggaaguucaugugguacacaagcaagacaaggugauccgucaacaggaccaaucaucgaagaaguagacuaa

SEQ ID NO: 753 - RNA, 1104 nt, Artificial Sequence
  derived and/or modified CDS sequence (opt6) from Homo sapiens__P48741__HsHSPA7
augcaagcaccaagagaauuagcuguaggaauagacuuaggaacaacauauuccuguguaggaguauuucaacaaggaagaguagaaauuuuagcaaaugaucaaggaaauagaacaacaccaucauauguagcauuuacugauaccgaaagauuagucggagaugcagcaaagucacaagcagcauuaaauccucacaauacaguuuuugaugcaaaaagauuaauaggaagaaaauucgcugauacaacaguacaaagcgacaugaaacauuggccauuccaaguuguaagcgaagguggaaaaccaaaaguacgaguauguuauagaggagaagacaaaacauucuaccccgaagaaauaucaaguaugguucuaucaaaaaugaaagaaacagcagaagcauauuuaggacaaccaguuaaacaugcaguaauaaccguuccaacauauuuuagcaauagucaaagacaagcaacuaaagaugcaggagcaauagcaggacuuaaaguacugccaauaauaaaugaagcaacagcagcagcaauagccuauggccuagacagaagaggagcuggaaaaagaaacguauuaauauuugauuuaggaggaggaacuuuugauguaaguguauuaaguauugacgcaggcguuuuugaaguaaaagcaacugcuggugauacucacuuggguggagaagauuuugauaauagauuaguaaaucauuuuauggaagaauuuagaagaaaacacggaaaagaucuaaguggaaauaaaagggcauugagaagauuaagaacagcaugugaaagagcaaaaagaacaccuagcucaaguacacaagcaacgcuagaaauagauucauuauucgaaggaguagauuuuuauaaaucaaucacaagggcaagauuugaagaauuaugcagugacuuauucaggagcacauuagaaccaguagaaaaagcauuaagagaugcaaaauuagauaaagcacaaauacaugauuuugugcuaggagggggauuacauucacauccacaaggagcagaaguugcagcaggauuauuacaaagacaaggagcagaacaagaacaccaaccauaa

SEQ ID NO: 754 - RNA, 1941 nt, Artificial Sequence
  derived and/or modified CDS sequence (opt6) from Homo sapiens__NP_006588.1 __HsHSPA8
augagcaaagggccagcaguaggaauagauuuagguaccaccuacagcuguguaggaguauuccaacacggaaaaguggaaauaauagcaaaugaccaaggcaauaggacaacaccaucauacguugcauucacagauaccgagcgacuaauuggagaugcagcuaaaaaucaaguagcaaugaauccaacaaauacgguauuugacgcaaaaagacuaauaggcaggagguuugaugacgcaguuguacaaagcgauaugaaacacuggccauuuaugguaguaaaugaugcuggaagaccaaaaguacaaguagaauacaaaggcgaaacuaaaaguuucuaccccgaagaaguaucuucaaugguauuaacaaaaaugaaagaaaucgcagaagcauacuuaggaaaaacgguuacaaacgcaguaguaacaguaccagcauauuuuaacgacucccaaaggcaagcaacaaaagacgcugggacaauugccgggcuuaauguauuaagaaucauaaaugaaccaacagcagcagcaauagccuacggauuagauaagaaaguaggugcagaaagaaacguauuaauauuugacuuaggcgguggaacauuugauguaucaauauuaacaauagaagacggaauauuugaaguaaaaucuacagcuggagacacacaccuaggaggagaagauuucgauaacagaaugguaaaucauuuuauagccgaauuuaaaaggaaacauaagaaagauauaagugaaaauaaaagagcaguaagaagauuaagaacagcaugcgagcgagcgaaaaggacuuuaucaucgagcacacaagcaagcauagaaauugauagccuauaugaagguauagacuuuuacacaucaauaacaagagcccgauucgaagaauuaaacgcagaucuauuuagaggaacguuagacccaguagaaaaagcauuaagagaugcaaaauuagauaaaagccaaauacaugacaucguauugguuggaggaucuacaagaauaccuaaaauacaaaaauuacuacaagacuucuuuaacggcaaagaauuaaacaaaucaauaaauccagacgaagcaguagcguauggugcggcgguacaagccgcuauauuauccggagacaaaagugaaaacguacaagaucuacuauuacuagacguaacaccccuaucauuaggaauugaaacagcaggaggaguaaugacaguuuuaauaaaaagaaauacaacaauaccaacuaaacaaacccaaacauuuacaacuuacagugacaaucaaccaggagugcucauacaaguuuacgaaggagaacgagcaaugacaaaagacaacaaucuauuaggaaaauuugaacuaaccggaauaccaccagcaccuagaggcgugccacaaauagaagucacauuugacauagaugcaaauggaauacuaaacgucagcgcagucgauaaaucaacaggaaaagaaaacaaaauaaccauaacaaacgacaaaggacgccugagcaaagaagauaucgaacgaaugguacaagaagcagaaaaauauaaagcggaggacgaaaaacaacgagacaaaguaagcaguaaaaacagcuuagaaucauaugcauuuaauaugaaagcaacuguagaagacgaaaaauuacaaggaaaaauaaacgaugaagauaaacagaaaauacuagacaaauguaacgagauaauaaauuggcuggacaaaaaucaaacggcagaaaaagaagaauuugaacaucaacaaaaagagcuugaaaaaguuuguaauccaauaauaacaaaacuauaucaaagugcaggaggaaugccaggaggaaugcccggaggauucccuggaggaggcgcacccccaaguggaggagccaguucaggcccaacaauagaagaaguagauuag

SEQ ID NO: 755 - RNA, 2040 nt, Artificial Sequence
  derived and/or modified CDS sequence (opt6) from Homo sapiens__NP_004125.3 __HsHSPA9
augauaucagcaagcagagcagcagcagcaagacuugugggagcagcagcaucaagaggaccuacagcagcaaggcaucaagauucguggaauggguuaagccaugaggcguuuagacuugugucuaggagagauuacgccagcgaagcaauuaaaggugcgguuguaggaauagaucuaggaacgacaaacucauguguagcagucauggaaggaaaacaagcaaaagugcuagaaaaugcagaaggcgcaagaacaacaccaucaguaguugcauuuacagcagauggagaaagguuaguugguaugccagcaaaaagacaagcaguaacaaauccgaacaauacauuuuacgcuacaaaaagguuaauaggaagaagauacgaugacccagaagugcaaaaagauauuaaaaauguaccuuuuaaaauagucagagcaucuaauggugaugcauggguagaggcccacggaaaacucuacucuccaagucaaauaggagccuucguauuaaugaagaugaaagaaacagcugaaaauuauuuaggacacacagcgaaaaaugcaguaauaacgguaccagcauacuucaacgacagucaaagacaggcaacaaaagacgcaggacaaauaaguggauuaaacguauuaagaguaauaaaugaaccuacagcagcagcauuagcauauggccuagauaaaucagaagacaaaguaauagcgguauaugauuuaggcggaggaacauuugacauuucaauauuagagauacaaaaagguguauuugaaguuaaaaguacaaauggugacacauuuuugggaggagaagauuucgaucaagcacuacuucgacauauaguuaaagaguuuaaaagagaaacagggguagaucucacuaaagauaauauggcauugcaaaggguaagggaagcagcugaaaaagcaaagugcgagcuaagcucaucuguacaaacggauauuaaucuaccauauuuaacaauggacagcucagguccaaaacaucucaauaugaaauuaacaagagcucaauucgaaggaauaguaacggacuuaauaagaagaacuauagcaccaugucaaaaagcuaugcaggaugcggaagugagcaagagugacauaggagaaguuaucuugguagguggaaugacaagaaugccaaaaguucaacagacaguacaagaucuauucgggagagcuccuaguaaagcuguuaauccagacgaagccguagccauaggagcagcaauacaaggaggaguauuagcaggagauguaacugauguacuacuauuagauguaacaccguugagccuuggaauagaaacuuuaggaggaguguucacuaaauuaaucaauagaaauacaacgauaccuacgaagaaaucacaaguauucaguacagcagccgaugggcaaacacaaguagaaauaaaagucugccaaggagaaagagagauggcaggagauaauaaauuguuagggcaauuuacauuaauagguauaccuccagcaccgagaggaguaccucagauagaaguuacauucgauauagaugcaaaugguauaguucauguaucagcaaaagacaaaggaacuggaagagaacaacaaauagugauacaaagcaguggaggacuaaguaaagaugauauagaaaacaugguuaaaaacgcggaaaaauaugcagaagaagauagaagaaagaaagagagaguagaagcaguuaacauggcugaaggaauaauacaugacacugaaacaaaaauggaagaauuuaaagaucagcuaccagcagaugaauguaauaaacuaaaagaggaaauaaguaaaaugagagaauuguuagcuagaaaagacagugagacuggagaaaauauuagacaagcagcaagcucauuacaacaagcaagccucaaauuauuugagauggcauauaagaaaauggcaucagaaagggaaggauccggaucaagcggaacgggagaacaaaaagaagaucaaaaagaagaaaaacaauag

SEQ ID NO: 756 - RNA, 2028 nt, Artificial Sequence
  derived and/or modified CDS sequence (opt6) from Homo sapiens__NP_079291.2__HsHSPA12A
auggcagacaaagaagcaggcggaagugaugggccaagagaaacagcaccaacaucagcauacaguucaccagcaagaagccuaggagacacaggaauaaccccauuaaguccaucgcacauuguaaacgacacagacuccaacguaagcgaacaacaaaguuuccuaguaguaguagcuguagauuuuggaaccacaucaucaggauacgcauacucauuuacaaaagaaccugaauguauacaugucaugagaagaugggaaggcggagauccuggaguaaguaaucaaaaaacuccaacaacaauacuucucacaccagaacgaaaauuccacucauuuggauaugcagccagagacuuuuaccacgauuuagauccaaaugaagcaaaacaaugguuauaccuagaaaaauucaaaaugaaacuucauaccacuggagauuuaacaauggacacagaccuaacagcagccaauggaaaaaaaguaaaagcacuagagauauuugcauacgcacuacaauacuuuaaagaacaagcacuaaaagaauuaagcgaccaagcagguuccgaauuugaaaauucagacguaagauggguaauaacaguccccgcaauauggaaacaacccgccaagcaauuuaugagacaggcagcauaccaagcgggacuagccuccccagaaaacucagaacaacuaauuauagcacuugaaccagaggcagcgucaauauauuguagaaaacuacgauuacaucaaaugauagaauuaaguucaaaagcagcaguaaauggauacucaggaucagauacagugggagcaggauuuacacaagcuaaagaacauauuagaagaaacagacaaagcagaacauuucuuguagaaaacgucauaggagaaauaugguccgaacuagaagaaggagauaaauauguaguaguugacagcggaggaggaacaguagaucuaacuguccaucaaaucagacuacccgaagggcacuuaaaggaacuauacaaagcaacgggaggcccauacggcucauuaggaguugacuacgaauucgaaaaauuauuauacaaaauauucggagaagauuuuauagaacaauuuaaaaucaaaaggccugcagcauggguagauuuaaugauagcauuugaaagcagaaaaagagccgcagcacccgauagaacaaacccacuaaauauaacacuaccguucucauuuauagauuacuauaaaaaauuuagaggacauucgguagaacaugcacuaagaaaaagcaacguugacuuugucaaauggagcagucaaggaauguuacggaugagcccagaugcaaugaaugcacuauucaaaccaacaauagauaguaucauagaacauuuaagagauuuauuucaaaaaccagaagucaguacaguaaaauuccuauucuuaguaggcggauucgcagaagcaccccuauuacaacaagccguacaagcagcauucggagaucaauguagaauaauaaucccacaagaugucggacucacaauacucaaaggagcaguucuauucggacucgacccagcaguaauuaaaguaagaagaucaccacuuaccuaugguguugguguauuaaauagauauguagaaggaaaacacccuccagaaaaauuauuaguaaaagauggaacaagauggugcacugacguauuugauaaauuuauuucggcagaccaaucaguagcucuaggugaacuuguaaaacgauccuauacaccugcaaaaccaucacaacuagucauaguaauaaauauauacuccucagaacacgauaaugucucauuuaucacugacccaggaguaaaaaaauguggcacauuaagauuagauuugacagguacaagugguacugcaguacccgcacgaagagaaauccagacauuaaugcaauuuggcgacacagaaaucaaagccacagcaauagacauagccacaucuaaaucaguaaaaguaggaauagacuucuuaaauuauuaa

SEQ ID NO: 757 - RNA, 2061 nt, Artificial Sequence
  derived and/or modified CDS sequence (opt6) from Homo sapiens__NP_443202.3 __HsHSPA12B
augcuugcaguuccagaaaugggacuacaaggacuauauauaggcaguucaccagaacgaaguccgguacccaguccaccgggaucaccaaggacacaagaaaguugcggaauagcaccucuaacaccuagccaaucaccuaaaccugaagugagagcaccacaacaagcgaguuucucgguuguaguagcaauagauuucggaacaacaucaagugguuaugcauuuucauuugcuucagauccagaagcuauacauaugaugcgaaaaugggaaggaggcgauccuggcguagcacaucagaaaaccccuacuugucuauugcuaacaccagaaggagcauuucauaguuuuggauauaccgcucgagauuacuaucaugacuuagauccagaagaagcaagggauugguuauacuuugaaaaauuuaaaaugaaaauacauagugccacggaucuaacauuaaaaacacaauuagaagcaguaaauggaaaaacaaugccagcauuagaaguauuugcacacgcauugagauucuuucgcgaacaugccuuacaagaacuacgcgaacaauccccuuccuuaccagaaaaggauacuguacgauggguauuaacaguccccgcuauauggaaacaaccggcuaaacaauuuaugagagaagcagcauauuuggcuggccuagucagccgggaaaacgcugaacaauuacuaauagcauuagaaccagaagcugcaagcguauacuguagaaaacuaagacuucaucaauuacuagaucuaagcggaagggcaccuggaggagggcgauuaggagaaagaagaucuauagauucaucauuuagacaagcuagagaacaauuaagaagaucacgucacucaagaacauuucuaguugaaucagguguaggcgaacuuugggcagaaaugcaagcaggagacagauauguaguggcugacugcggaggggguacaguugaccuaacaguacaucaauuagaacaaccacacggaacacuaaaagaauuauauaaggcuucaggaggaccauacggggcaguaggaguugaucuagcuuuugaacaacuacuuugucgaauauucggugaagauuuuauagcaacauuuaaaaggcaaagaccugcugcauggguagaucuaacuauagcauucgaggcaagaaaacgaacagcaggaccacauagagcuggugcuuuaaacauuucauuaccauuuucauucauagauuuuuacagaaaacaaagaggacauaauguagaaacagcauuaagaagaaguucaguaaauuuuguaaaauggucuagucaaggaaugcuaagaaugucaugcgaagcuaugaacgaacuauuucaacccacaguauccgguauaauacaacauauagaagcacuauuagcuagaccugaaguacaaggaguaaaauuauuauuuuuaguaggaggauucgcagaaucagcuguguuacaacaugcugugcaagcagcguugggcgcuagaggucuaagaguaguaguuccucacgauguaggacuaacaauacuaaaaggagcaguauuauucggccaagcgccuggaguaguucgaguaagaagaucuccauuaacauauggugugggaguauuaaauagauucgugccagguagacauccaccagagaagcuauuaguaagagauggcaggaggugguguacugaugucuucgaaagguuuguugcagccgaacaaagcguugcacuaggagaagaaguuagaagaucauacuguccagcacggccaggacaaagaagagugcuaauuaacuuauauuguugcgcagcagaagaugcaagauuuauuacagacccagguguaagaaaguguggagcccucaguuuagaacuugaaccagcugauugcggccaagauacagcaggcgcacccccaggcagacgagaaauaagagcggcaaugcaauuuggagauacagaaauaaaaguuacagcuguagauguaagcacaaacagaaguguuagagcaucaauagacuuucuaaguaacuaa

SEQ ID NO: 758 - RNA, 1416 nt, Artificial Sequence
  derived and/or modified CDS sequence (opt6) from Homo sapiens__NP_008879.3__HsHSPA13
auggcuagagaaaugacaauacucggcucugcaguauuaaccuuacuauuagcaggauauuuagcacaacaauaccuucccuuaccaacaccaaaaguaauagguauagaucucgguacaacauauuguuccgucggaguuuucuuuccaggaaccggaaaaguuaaaguuauaccagacgaaaauggacacauauccauaccaaguaugguaaguuuuaccgacaacgauguauaugucgguuacgaaagcguagaauuagcagauaguaauccacaaaacacaauauaugacgcaaaaagauucauaggaaaaaucuucaccgcagaagaacuggaagcagaaauaggaagauauccauucaaaguacuaaauaaaaauggaaugguagaauucucaguaacuuccaaugaaacaauaacaguaucaccagaauaugucggcucaagauuauuauuaaaauuaaaagaaauggcagaagcauacuuaggaaugccaguagcaaacgcaguaaucucaguaccagccgaauucgauuuaaaacaaagaaauuccacuauagaagcagcaaaucuagcaggucuuaaaauauuaagaguaauaaaugaacccacagcagcagcaauggcauauggacuacacaaagcagauguuuuucacguacuagugauagauuuaggaggcggcacauuagacguaagucuacucaauaaacaaggcgguauguuucuaacaagagccaugaguggaaacaacaaauuaggaggacaagacuuuaaccaaagacuacuacaauauuuauacaaacaaauuuaccaaacauauggauucgucccaucaagaaaagaggaaauccacagacuaaggcaagcaguagagauggucaaacuaaacuuaacauuacaucaaucagcacaacuaucagucuuauuaacaguagaagagcaagauagaaaagaaccucacuccagugacacagaacucccuaaagauaaacuaucaucagcagaugaccaccgagucaacaguggauucggaagaggccuaagugacaaaaaaagcggagaaucacaaguauuauuugaaacugaaauuagcagaaaacuauuugauacauuaaaugaagaccuauuucaaaaaauacuaguaccaauacaacaaguacucaaagaaggacauuuagaaaaaacagaaauagacgaaguaguacuaguaggaggaagcacacgaauuccuagaauaagacaaguaauacaagaauuuuucggcaaagacccuaauacaucaguagacccagaucuagccgucguaacaggaguagcaauacaggcaggaauagauggaggaagcuggccacuucaagucagugccuuagaaaucccaaacaaacauuuacaaaaaaccaauuucaacuaa

SEQ ID NO: 759 - RNA, 1530 nt, Artificial Sequence
  derived and/or modified CDS sequence (opt6) from Homo sapiens__NP_057383.2__HsHSPA14
auggcagcaauaggaguacaccuaggauguacaucagcauguguagccguauauaaagaugguagagcaggaguuguggccaaugaugccggagauagaguaacuccugcaguaguugcauacagcgaaaaugaagagauaguuggacuagcugcaaaacaaagcagaauaagaaauauaaguaauacaguaaugaaagucaaacaaauauuaggaagaucaaguucagacccucaagcucaaaaauacauugcugaaagcaaaugucuaguaauagagaaaaauggaaaacuaagauaugaaauugauacgggugaagaaacuaaauucguaaacccagaagauguagcaagacuaauauuuaguaaaaugaaagaaacagcucauucaguauuaggaucagacgcaaaugacguaguaauaacuguaccauucgauuuuggagaaaaacaaaagaacgcuuuaggagaagcggcuagagcagcagguuuuaauguauuaagacuaauacaugaaccauccgcugcacuauuagcauacggaauaggacaagauaguccaacagguaaaucaaauauccuaguauucaaauuaggaggaacaucauuaucguuaucaguaauggaaguaaauagugggauauauagaguauugagcacaaauacagaugauaauauaggcggagcacauuuuacagaaacucuagcacaauaucuagcaagugaauuucaaagaaguuuuaaacaugauguucgaggaaaugcaagagcaaugaugaaauuaacaaauucagcggaaguagcaaaacacucauuaagcacguuagguagugcaaauuguuucuuagauaguuuauaugaaggacaagauuuugauuguaauguaucacgagcccgauuugaauuauuauguagcccucuauuuaauaaauguauagaagcaauaaggggauuacucgaucaaaauggauucacagcugaugauauaaauaaaguaguauuauguggagguucaaguagaauaccuaaauuacaacaacuaauaaaagacuuauuuccagcaguagaacugcuaaauaguauaccgccagacgaaguaauaccaauaggagcagcaauugaagccggaauacuaauuggaaaagaaaaucuauuaguagaagacagccuuaugauagaauguagugcaagagacauacucgucaaaggcguagaugaauccggagcaaguagauucacuguauuauucccaucaggaacgccacuaccagcaagaagacaacauacacuacaagcaccaggaagcauaucaaguguaugucuagaacuauaugaaucagacgggaaaaauagcgcaaaagaagaaacaaaauuugcacaaguaguauuacaagauuuagacaagaaagaaaauggauuaagagauauauuagcaguauuaacuaugaaacgagacggaagucuacauguaacauguacagaucaagagacaggaaaaugugaagcgauaucaauagaaauugcuagcuaa

SEQ ID NO: 760 - RNA, 2577 nt, Artificial Sequence
  derived and/or modified CDS sequence (opt6) from Homo sapiens__NP_006635.2 __HsHSPH1
augucaguaguaggacuugauguaggaucacaaucauguuauauagcaguagcacgagcaggagguauagaaacaauagcaaaugaauucagcgauagauguacaccuucagucauaucuuucggaucaaagaaucgaaccauuggcguagccgcaaaaaaccaacaaaucacgcacgcuaacaauacaguaucaaacuuuaaaagauuucacggucgagcguuuaaugaccccuucauucaaaaagaaaaagaaaacuuaagcuaugaccuuguaccacuuaaaaauggaggaguaggcauuaaaguaauguacaugggagaagaacaccuauuuaguguagaacaaaucaccgcgaugcuacuaacaaaacuaaaagaaacagcagagaauagccuaaaaaaaccaguuacugacugcguaauaaguguaccaucuuucuuuaccgacgcagaaagacgguccguucuagaugcagcccaaauaguaggauuaaacugucucagacuaaugaaugauaugacugcaguggcucuaaauuauggaauauauaaacaagacuugccaucacuagaugaaaaaccaagaaucguagucuucgucgauaugggccauagcgcauuucaaguuucagcaugugcuuucaacaaaggaaaacugaaaguucuaggaacggcauucgauccauuucuagggggaaaaaauuuugacgaaaaauuaguagaacacuuuugcgccgaauucaaaacaaaauacaaacuagacgcaaaaaguaaaauaagagcauuauugagauuauaccaagaaugcgaaaaacuaaaaaaauuaaugagcuccaacucaacagacuugccauuaaacauagaaugcuucaugaaugauaaagacguauccgguaaaaugaauagaucccaguucgaggaacuaugugccgaacuacuucaaaaaauagaaguaccauuauacucacuauuagaacaaacucaccuaaaagucgaagacguaagugcaguagaaauuguagguggagcaacaagaauaccggcuguaaaagaaagaauagcaaaauucuuuggaaaagauauaucaacaacauuaaacgccgaugaagccguagcuagagggugcgcacuucaaugcgccauauuaucaccagcguuuaaagucagagaauucaguguuaccgaugcaguaccauucccaauaaguuuaauauggaaccaugacucagaagacaccgaaggaguucaugaaguauuuagccgaaaccacgccgcaccauuuaguaaaguauuaacauuucuaagacgugguccauuugagcuugaagcauuuuauucugauccacaaggaguaccauacccagaagcaaaaauaggcagauuugucguacaaaacguaucggcacaaaaagauggagaaaaaucacgagucaaaguaaaggugagaguaaacacacauggaauauucacaauaaguacagccagcaugguggaaaaaguuccaacagaagaaaacgaaaugagcagcgaagcagauauggaaugucuaaaccaaagaccgccagaaaacccagacacagauaagaauguccaacaagacaacucugaagcaggcacucaaccacaaguucaaacagaugcacaacaaacuucacaaucaccaccgucuccagaauuaaccagugaagaaaacaaaauacccgacgcagauaaagcaaacgaaaaaaaaguagaccaaccaccagaagcaaagaaaccaaaaauuaaagucgugaacguagaauuaccaauagaagcaaaucuaguauggcaauuaggcaaagaccuauuaaauauguauaucgagaccgaagguaaaaugauaaugcaagacaaauuagagaaagaacgaaaugaugcaaaaaaugcaguagaagaauauguauaugaauuuagagauaaacuauguggaccguacgaaaaauuuauaugugaacaagaccaucaaaauuuucuacgacuucuaacugagacagaagacuggcuauacgaagaaggagaagaucaagcaaaacaagcguauguagacaaacuagaagaauuaaugaagauagguacaccaguaaaaguacgauuccaagaagcagaagagagaccaaaaauguuugaagaacugggucaaagauuacaacacuaugcaaaaaucgccgcagacuuucgaaacaaagacgaaaaguauaaucauauagaugaaucagaaaugaaaaaagucgaaaaaagugucaacgaagugauggaguggaugaauaacguuaugaaugcacaagccaaaaaaagccuagaucaagauccuguaguaagagcacaagagaucaaaaccaaaauaaaagaacuaaauaacaccugcgagccagugguuacccagccaaaaccaaaaauagaaagucccaaauuagagagaacccccaauggaccaaauauagauaaaaaagaagaagaccuagaggauaaaaauaacuucggagccgaaccaccacaccaaaauggggaauguuaccccaacgaaaaaaauaguguaaacauggauuuagacuaa

SEQ ID NO: 761 - RNA, 3000 nt, Artificial Sequence
  derived and/or modified CDS sequence (opt6) from Homo sapiens__NP_006380.1 __HsHYOU1
auggcugauaaagucagacgacaacggccaagaagaaggguaugcugggcacugguagcaguucugcuagccgauuuauuagcguuaucagauacccuagcuguaaugagcguagacuuaggcagugaaaguaugaaaguggcaauaguaaaaccaggaguacccauggagauuguuuuaaauaaagaaucaagaagaaagacgccaguaauaguaacgcuaaaagagaacgaaagauucuuuggagacucagcagcaaguauggcaauuaaaaacccaaaagcaacccugagauacuuucaacaucuguugggcaaacaagcagacaacccacauguagcgcuauaccaagcgagguuuccugaacacgaacuaacauucgacccacaaagacaaacaguacacuuccaaauaucuucacaacuccaauuuucaccugaggaaguacuuggaauggucuuaaacuacagucgaaguuuggcggaagauuuugccgaacaaccuauaaaagaugcaguaauaacaguaccuguauucuuuaaucaagccgagaggagagcuguauuacaagcugcaagaauggcuggacuuaaaguacuacaacucauaaaugacaauacagcuacugcacuaucauaugguguuuuuagaagaaaagacauaaacacaacugcacaaaauaucauguuuuacgauaugggaagcggaagcacagucugcacuauagucaccuaucagauggugaaaacaaaagaagcaggaaugcagccucaauuacaaauaagaggaguagguuuugacagaacgcuggguggauuagaaauggaacugagauuaagagaacgauuggcaggacuauucaaugagcaacgaaagggucagagagcuaaagacguuagagaaaauccucgcgcaauggcuaaacuuuuacgcgaagcaaauagauuaaagacaguacuuagugcaaacgcagaccauauggcucaaauagaaggacuaauggaugacguagacuuuaaagcaaaaguaacacgaguagaguucgaagaacuaugugcagaucucuuugaaagaguaccugguccaguacaacaagcucuacaaagugcugaaaugucuuuagacgaaauugaacaaguaauauuggucggcggagcaacacgaguuccuagaguacaagaaguauugcuuaaggcaguaggaaaagaagaacuagggaaaaauauaaacgcugacgaagcagcagcaaugggagccguuuaccaagcggcagcacuaagcaaggcuuuuaaaguuaaaccauuuguaguaagagaugcaguuguauauccaauuuuaguagaauuuacucgagaaguagaagaagaaccagggauacacucacuaaaacacaacaaaagaguacucuuuagcaggaugggaccguauccacaacguaaagucauaacauuuaacagauauucucaugauuuuaauuuccauauaaacuacggagacuuaggcuuuuuagguccagaagaucuaaggguauuugguucacaaaaucucacaacgguuaaacuaaaagggguaggagauaguuucaagaaauacccagacuaugaaucuaaaggaauaaaagcacauuuuaaucuagaugaaagugggguauugagucuagaccgagucgagagcguauucgaaacucugguugaagauagugccgaagaggaaucaaccuugacuaaacuagguaauacgauaagcagcuuauucggagguggcacaacaccagaugcaaaagaaaauggaacagacacaguacaggaagaagaagaaagcccggcagagggcucaaaagaugaaccuggggaacaaguagaguuaaaagaagaagcagaagcaccaguggaagacgguucgcaaccaccucccccagagccaaaaggugaugcaacaccagaaggcgaaaaagcaacagaaaaagaaaauggggauaaaucagaagcacaaaagccaagugaaaaagcagaagcuggaccagaaggaguugcuccugcaccagaaggagaaaagaaacaaaaacccgcacgcaaaagaagaaugguagaggaaauaggugucgagcuaguaguauuagaucuaccagaucucccagaagacaaauuggcacaaaguguacaaaaacugcaggacuuaaccuuaagagacuuagaaaaacaagaaagggaaaaagcugcaaauucuuuggaagcauucauauucgaaacacaggacaaauuauaucaacccgaauaucaggaaguauccacagaagaacaaagagaagaaauaucaggaaaacucucagcagcaucaacgugguuggaagaugaaggaguaggugcaacaacaguaauguuaaaagaaaaauuagcagaacuaaggaaacugugccaaggauuauuuuucagagucgaagaaagaaagaaauggccagaacgguuaucugcauuagauaauuuacuaaaccacucuaguauguuucuaaaaggggccagauuaauaccagaaauggaucaaauuuuuacugaaguagaaaugacaacacuagaaaaaguaaucaacgaaacaugggcauggaaaaaugcaacuuuagcagaacaagcaaaauuaccggcaacagaaaaaccagucuuacuaucaaaagacauagaagcgaaaaugauggcauuagacagagaaguccaauaccuacuaaacaaagcaaaguucacaaaacccagaccgcggccaaaagauaaaaacggaacccgagccgagccaccacuaaaugcaagcgcaagugaucaaggggagaagguaauaccgccugcaggacaaacagaagacgcagaaccaaucuccgaaccagaaaaaguagaaacaggaucggaaccuggagauacagaaccccuagaauuaggaggaccuggagcugagccagaacaaaaagaacaaaguacaggacaaaaacgaccucuuaaaaaugacgaacuauaa

SEQ ID NO: 762 - RNA, 2199 nt, Artificial Sequence
  derived and/or modified CDS sequence (opt6) from Homo sapiens__NP_005339.3 __HsHSP90AA1
augccagaagaaacccaaacacaagaccaacccauggaagaagaggaaguagaaacauucgcuuuccaagcagaaauugcacaauuaaugagucuaauuauaaacacauucuacucaaacaaagaaauauuuuuacgcgaacuaauaagcaacucaagcgaugcauuagauaaaauuagauaugaaucguuaacagauccaagcaaauuagacucaggaaaagaauuacacauaaaucuuaucccaaacaaacaagauagaacacuuaccauagucgacaccggaauaggaaugacaaaagcugaccuaauaaacaauuuagguacaauagcaaaaucggguaccaaagcauucauggaagcacuacaagcaggugccgacaucucgaugauaggacaauuuggaguaggauucuacagcgcauaccuaguagcagagaaaguaacaguuauaacaaagcacaacgacgacgaacaauacgccugggaaucaagugcaggaggaucauucacaguaagaacagacacaggugaaccaaugggcagagguacgaaaguaauacuucaucuuaaagaagaccaaacagaauaccuagaggaaagaagaaucaaagaaauaguaaaaaaacacucacaauucauaggauauccaauaacacucuuuguagagaaagaaagagacaaagaagucagugacgaugaagcagaggaaaaagaagauaaagaagaagaaaaagaaaaagaagaaaaagaaagugaagacaaaccagaaauagaagacguaggaucggaugaggaggaagaaaaaaaagauggagacaaaaaaaaaaagaaaaaaauaaaagaaaaauacauagaucaagaagaacugaacaaaaccaaaccaauauggacaaggaaccccgacgacaucacaaacgaagaauacggagaauuuuacaaaucacuuacaaaugacugggaagaccaccucgccgucaaacacuuuagcguagaaggucaauuagaauucagagcccuacuguuuguaccuagaagagcaccauucgauuuguuugagaauagaaaaaaaaaaaauaauaucaaacuauacguaagaagaguauuuauaauggacaauugcgaagaauuaauaccagaauaucuaaauuuuaucaggggaguagucgacagcgaagauuuaccauuaaacauaucgcgagagauguuacaacaaucaaaaauucugaaaguaauaagaaaaaaucuagucaaaaaaugucuagaacuauucacagaacuagcagaagacaaagaaaacuacaaaaaauucuaugaacaauucucaaaaaauauaaaauugggcauacacgaagacucucagaauagaaaaaaacuaucagaauuacuaagauauuauacgucagcuaguggagacgagaugguaucccuaaaagacuacugcacaaggaugaaagaaaaucaaaaacauauauacuacauaacuggagaaaccaaggaccaagucgcaaacucagcauucguagaaagauuacgaaagcauggacuggaaguaauauacaugauagaacccauagaugaauauugcguacaacaauuaaaagaauucgaaggaaaaacuuuaguaagcguaacgaaagaaggacuagaauuacccgaagaugaagaagagaaaaaaaaacaagaagagaaaaaaaccaaauucgaaaacuuauguaaaauaaugaaagacauauuagaaaaaaaaguagaaaaaguuguaguaucaaacagacuaguaacaagcccauguugcauaguaacaaguaccuacggguggacggcaaacauggaaagaauaaugaaagcccaagcuuuacgagacaauaguacgaugggauacauggcagccaaaaagcauuuagaaauaaacccagaccacagcauaaucgaaacacuuagacaaaaagccgaagcugauaaaaacgacaaauccgugaaagaccucgucaucuuacuuuaugaaacagcauuauuaaguaguggauucucccuagaagacccgcaaacacacgcuaaucgaauauaccgaaugauuaagcucggauuaggaauagacgaagaugacccaacagcggaugauacaagcgcagcaguaacugaagagaugccaccauuagaaggagaugaugauacgucaaggauggaagaagucgacuaa

SEQ ID NO: 763 - RNA, 339 nt, Artificial Sequence
  derived and/or modified CDS sequence (opt6) from Homo sapiens__NG_005218__HsHSP90AA3P
auggacucaagcaaacuagacagcggaaaaggacuacacauaaacuuaguaccaaacaaacaaaaccaaacacuaacaauaguagacacaagaauaggaaugacaaaaacagacuuaauaaacaaccuaggaacaguaacaaaaucaggaacaaaagcauucauggaagcacuacaagcagacgcagacauaucaaugauaggacacuucggaguaggauucuacucagcauaccuaguagcaaaaaaaguaacaguaauaucaaaacacaacaacgacgaacaauacacaugggaaucaucagcaggaggaucauucacaguaagaacagacgaauaa

SEQ ID NO: 764 - RNA, 2175 nt, Artificial Sequence
  derived and/or modified CDS sequence (opt6) from Homo sapiens__NP_031381.2__HsHSP90AB1
augcccgaagaagugcaucauggcgaagaggagguagaaacauucgcuuuucaagcugaaauagcucagcuaaugagccuaauaauaaacacuuuuuacagcaacaaagaaauauuucuccgcgaguuaauaucaaacgcuucagaugcacuugauaaaauaagauacgagagccuaacagacccuaguaaacuagauagcgguaaagaacuaaaaauagacauaauacccaacccgcaagaaagaacacuuacacuugucgauacuggaauaggaaugacaaaagcagaucuaauaaauaacuuaggaacaauagcaaaaucagggacgaaagcguuuauggaagcauuacaagcaggagcagauauuaguaugauaggacaauuuggaguaggauucuacagugcuuaucuuguagcagaaaaaguaguaguaauaacaaaacacaaugacgacgaacaauaugcuugggaaucuucagccggagggucauucacgguuagagcagaccacggagaaccaauaggaagaggcacuaagguaauacuacauuuaaaggaagaucagacagaauaccuugaagaacgaagaguaaaagaaguaguaaaaaaacauucacaauuuauaggauaccccauaacauuauaccuggaaaaagaaagagaaaaagaaauaucugacgacgaagccgaagaagaaaaaggagaaaaagaagaagaagacaaagaugaugaagaaaaaccgaaaaucgaagacguaggaucagacgaagaagacgacucaggaaaagacaaaaaaaaaaaaacaaaaaaaauaaaagaaaaauacauagaucaagaagaauugaacaaaacaaaaccaauauggacaagaaauccagaugauauaacacaagaagaauauggagaauucuacaaaagucuuacaaaugacugggaagaccaucuagcagucaaacauuuuucaguagaaggacaacuagaauucagagcguuauuauuuauaccaagaagagcgccauucgaccuauuugaaaacaaaaaaaaaaaaaacaauauaaaacuauacguaagaagagucuucauaauggacucgugcgaugaauuaauaccagaauacuuaaauuucauaagaggaguagucgauuccgaagacuuaccacuaaauauaucucgagaaauguuacaacaauccaaaauacuaaaagugauaagaaaaaauaucguaaaaaaaugucuugaacuauuuucggaacuugcggaagacaaggaaaauuauaaaaaauuuuaugaagcguucaguaaaaacuuaaagcuaggcauacaugaagacuccacaaauagaagaagacuaagcgaacuauuaagauaccauacaucacaaucaggagacgaaaugacaucucuaagugaauaugugagcaggaugaaagaaacccaaaaaucaauauacuacauaacaggagaaucgaaagaacagguagcaaauucagcauucgucgaacguguacgcaaaagaggauuugaaguaguauacaugacugagccaauagacgaauauuguguacaacaacuaaaagaauucgacggaaaaagucuagucaguguaacaaaagaaggacuagaacuaccagaagaugaagaagaaaaaaaaaaaauggaagaaagcaaagcaaaguucgaaaauuuaugcaaauuaaugaaagaaauacuagauaaaaaagucgaaaaaguuacaauuucaaauagacuagucucaucaccaugcugcauagucacaagcacauacggauggaccgccaauauggaaagaauaaugaaggcacaagcauuaagagauaacagcacgaugggauacaugauggcaaaaaaacaucuugaaauaaauccagaccacccaauagucgaaacacuaagacagaaagcagaagcagauaaaaacgacaaagcuguaaaagaccucgugguccugcucuucgaaacagcauuacugaguucaggauucucgcuggaagacccacagacucauucaaauagaauuuacagaaugauaaaacuaggauuaggaaucgaugaagacgaaguggcagcagaagaaccaaacgccgcggucccagacgaaauaccuccauuagaaggagacgaggaugcaagccgaauggaagaaguagauuaa

SEQ ID NO: 765 - RNA, 2412 nt, Artificial Sequence
  derived and/or modified CDS sequence (opt6) from Homo sapiens__NP_003290.1__HsHSP90B1
augcgagcuuuauggguacuaggcuuauguugcguauuacuuacauucggaucaguacgugcagacgaugaaguagauguagaugguacaguagaagaagauuuaggcaaaucaagagaaggaaguaggacagacgaugagguaguacaaagagaagaagaagcaauucaacuagacggacuuaacgcaucucaaauaagagaauuacgagaaaaaucagaaaaauuugcauuccaggcagaaguaaauagaaugaugaaacuaaucauaaauagucucuauaaaaacaaagaaauauucuuacgagaacuaauaucaaaugcaagugaugcuuuagacaaaauacgacuuaucagucuaacagaugaaaaugcacucaguggcaaugaagaacuaacaguuaaaauaaaaugcgauaaagagaaaaauuuacuacauguuacagacaccgguguaggaaugacaagagaagaauuaguuaaaaauuuaggaacaauagcaaaaaguggaacaagugaauuucuaaauaaaaugacugaagcucaggaagauggacaaagcacuucagaacuaauuggacaauucggaguaggauucuacucagcauuccuuguagcugauaaaguaaucguaacuagcaaacacaauaacgacacacaacauauaugggaaucagauucaaacgaauuuagcguaauugcagauccaagaggaaauacacuaggaagagggaccacaauaacauuaguacuaaaagaggaagcaagcgacuacuuagaacucgauacgauuaaaaauuuaguaaagaaauacucacaguuuauaaauuucccaauauacgucuggaguaguaaaacagaaacaguagaagaaccaauggaggaagaagaagcagccaaagaagaaaaagaagaaucggacgacgaagcugcugucgaagaagaagaagaagaaaagaaaccaaaaacaaagaaaguagagaaaacuguuugggauugggaauuaaugaacgauaucaaaccaauauggcaaagacccucaaaagaagucgaagaagacgaauauaaagccuuuuacaagucauuuuccaaagaaucggaugacccaauggcauauauucacuuuacagcagagggagaagucacauuuaaaucuauacuuuuugucccaacaagugcaccgagaggauuauuugaugaauacgguucaaagaaaucagacuauauaaaauuauauguaagaagaguguucauaacagacgacuuucacgauaugaugccgaaauacuuaaacuuuguuaaaggagucguugacagcgaugaccuaccacucaacguaaguagagaaacacuacaacaacauaaacuauugaaaguuauaagaaagaaacucguaagaaaaacuuuagacaugauuaagaaaauagcagacgacaaauauaacgauacauuuuggaaagaguucgguacaaauauaaaacuaggaguaauagaagaccacaguaauagaacccgauuagccaaauuacucagguuccaaucaucgcaucacccaacagacaucacgagcuuagaucaauauguagaaagaaugaaagaaaaacaagauaaaauauacuuuauggcgggaucaucaagaaaagaagccgaaucuucuccauucguugaacgacuauuaaagaaaggauaugaaguaauauaccuaacagaaccuguagaugaauauuguauacaagcacuaccagaauuugauggcaaacgcuuccaaaauguagcaaaagaaggcguuaaauuugaugaaagcgaaaagacaaaagaaaguagagaagcgguugaaaaagaguucgaaccauuauuaaauuggaugaaagacaaagcacuaaaagauaaaauagaaaaagcuguaguaucucaaagauuaaccgaauccccgugcgcacucguagccagucaauauggcuggucagguaacauggaaagaauaaugaaagcucaagcauaucaaacaggaaaagauauaaguacgaacuauuacgcaucucaaaagaaaacauucgaaauaaauccaagacacccacugauaagagauauguuaaggcgaauaaaagaagaugaagacgacaaaacaguucuagacuuagcugucguacuauucgaaacagcaacauuaagaagcggauacuuacuaccagacacaaaagcauauggagauaggauagaacggauguuacgacuaagucucaacauagauccagaugccaaaguugaagaagaaccagaagaggaaccagaagagaccgcagaagacacaacagaagacacagaacaggacgaagacgaagaaauggacguaggaacugacgaagaagaagaaacagcaaaagaaucuacagcagaaaaagacgagcuguaa

SEQ ID NO: 766 - RNA, 2115 nt, Artificial Sequence
  derived and/or modified CDS sequence (opt6) from Homo sapiens__NP_057376.2__HsTRAP1
auggcacgagaauuaagagcucuuuuacuaugggguagacgacugagaccauuauuaagggcgccagcccucgcagcaguaccaggaggaaaaccaauacucugcccaagaagaacaaccgcacaauuaggcccaagaagaaauccagcauggucauuacaagcuggaagacuauuuuccacccaaacagcagaagauaaagaagaacccuuacauucaauaauaucaagcacagaaucaguccaaggaucaacaucaaaacaugaauuucaagcagaaacaaagaaacuauuagauauuguugcuagaagccuuuauucugaaaaagaaguauuuauaagagaacuaauuaguaacgcuagcgacgccuuagaaaagcuaagacacaaguuaguaagugauggacaagcauuaccagaaauggaaauacaccugcaaaccaaugcagaaaaaggaacaauaaccauacaagauaccggcauaggaaugacacaagaagaauuaguaaguaaccuuggaacaauagcuagaagcggaucaaaagcauuccucgacgcacuacaaaaccaagcagaagcaucauccaaaauaauuggacaauuuggcguaggauucuauagugccuuuaugguagcagaucgugucgaagucuauucacgaucagcagcaccaggaucacuaggguaucaaugguuaucagacggauccgguguauucgaaauugccgaagccucgggcguaagaacggguacuaaaauaauaauacauuuaaaaucagauugcaaagaauucucuucagaagcacgaguccgagauguaguaacgaaauauucaaacuuuguuaguuuucccuuauauuuaaauggucguagaaugaauaccuuacaagcaauauggaugauggauccaaaagauguuagagaauggcaacaugaagaauuuuauagauauguugcucaagcucaugacaaaccccgauauacuuuacacuacaaaacagacgcaccauuaaauaucaggaguauauuuuaugugccagauaugaaacccucgauguuugaugucaguagagaauuaggaagcaguguggcucuauauucuagaaaaguacucauacaaaccaaagcaacggauauauuaccaaaauggcucagauuuauaagaggaguuguugauucagaagacauacccuuaaaucuuaguagagaacuacuucaagaaucagcauuaauaagaaaauuaagagacguccuucaacaaagauuaauuaaauucuuuauagaccaaucaaaaaaagaugcagaaaaauaugcaaaauucuucgaagacuauggauuauuuaugagagaaggaauaguaacagcaacagaacaagaaguaaaagaggauauagcaaaauuauuacgguacgaaucaucagcauuaccaucaggacaacuuacaucauuauccgaauacgccagucgaaugagagcaggcacaagaaacauauauuaccuaugugcaccaaacagacaucuagcagagcacucaccuuauuacgaagcaaugaaaaaaaaagauacagaaguucuauuuugcuuugaacaauuugacgagcuuaccuuacuccaucuaagagaauuugacaaaaaaaaauuaauaaguguugaaacagacauaguaguugaucauuauaaagaagaaaaauuugaagaucgaagcccagcagcagaaugccuaucagaaaaagaaaccgaagaauuaauggccuggaugcguaauguucuaggaagcagaguuacaaacguaaaaguaacgcuaagauuagauacucauccagccaugguaacugugcuagaaaugggcgcagccaggcacuuccuaagaaugcaacaauuagcaaaaacacaagaagaaagagcacaauuacuucaaccaacacuugagauaaaucccagacaugcauuaaucaaaaaacuaaaccaacuucgugcaagcgaaccaggauuagcacaacuuuuaguugaucaaauauaugaaaacgcaaugauagcagcuggacucgucgaugauccaagagcaauggugggacgccuuaaugaauuauugguaaaagcauuggaacgacauuaa

SEQ ID NO: 767 - RNA, 462 nt, Artificial Sequence
  derived and/or modified CDS sequence (opt6) from Homo sapiens__NP_000609.1__HsIGF1
augggaaaaauaucaucacuaccaacacaacuauucaaaugcugcuucugcgacuuccuaaaaguaaaaaugcacacaaugucaucaucacaccuauucuaccuagcacuaugccuacuaacauucacaucaucagcaacagcaggaccagaaacacuaugcggcgcagaacuaguagacgcauuacaauucguaugcggagacagaggauucuacuucaacaaaccaacaggauacggaucaucaucaagaagagcaccacaaacaggcauaguagacgaaugcugcuuccgaucaugcgaccuaagaagacuagaaauguacugcgcaccacuaaaaccagcaaaaucagcaagaucaguaagagcacaaagacacacagacaugcccaaaacacaaaaagaaguacaccuaaaaaacgcauccagaggaucagcaggaaacaaaaacuacagaauguaa

SEQ ID NO: 768 - RNA, 543 nt, Artificial Sequence
  derived and/or modified CDS sequence (opt6) from Homo sapiens__NP_000603.1__HsIGF2
augggaauaccaaugggaaaaucaaugcuaguacuauuaacauuucuagcauuugcaagcuguugcauugcagcauacagaccaucagaaacacuauguggaggagaauuaguagauacauuacaauuuguauguggagauagaggauucuauuucucaagaccagcaucaagaguuagcagaagaaguagaggaauaguagaagaaugcuguuucagaagcugugauuuagcauuacuagaaacauauugcgcaacaccagcaaaaagugaaagagauguaucaacaccaccaacuguauuaccagauaacuuuccaagauacccaguaggaaaauucuuucaauacgauacauggaaacaaagcacacaaagacuaagaagaggacuaccagcauuauuaagagcaagaagaggacacguucuagcaaaagaacuagaagcauuuagagaagcaaaaagacauagaccacuaauagcauuaccaacacaagauccagcacacggaggagcaccaccagaaauggcaucaaacagaaaauaa

SEQ ID NO: 769 - RNA, 639 nt, Artificial Sequence
  derived and/or modified CDS sequence (opt6) from Homo sapiens__NP_000591.1__HsIL6
augaauuccuucucaacaucagccuucggaccaguagccuucucacuaggacuacuacuaguacuacccgcagcauucccagcaccagucccaccaggagaagacucaaaagacguagcagcaccacacagacaaccauuaacaucaucagaacgaauagacaaacaaauaagauacauauuagacggaauaucagcacuaagaaaagaaacaugcaacaaaucaaacaugugcgaaucaucaaaagaagcccuagcagaaaacaaccuuaaucuaccaaaaauggcagaaaaagacggaugcuuccaaucaggauucaacgaagaaacaugccuaguaaaaauaauaacaggacuacuagaauucgaaguauaccucgaauaccuacaaaacagauucgaauccucagaagaacaagcccgagcaguccaaaugucaacaaaaguacuaauacaauucuuacaaaaaaaagcaaaaaaucuagacgcaauaacaacaccagacccaacaacaaacgccuccuuacuaacaaaacuacaagcacaaaaccaaugguuacaagacaugacaacacaccucauacuaagaucauucaaagaauuccuacaauccucacuaagagcacuuagacaaauguaa

SEQ ID NO: 770 - RNA, 1281 nt, Artificial Sequence
  derived and/or modified CDS sequence (opt6) from Homo sapiens__NP_002183.1__HsINHBA
augccacuacugugguuaagagguuuccuauuagcaagcugcuggauaauaguaagaagcaguccaacaccagggagcgaaggacacagugcggcaccagacugcccaucaugugcgcuagcagcauuaccaaaagacguuccaaauagucaaccagaaaugguugaagcaguaaaaaaacauauauuaaauaugcuacaucuaaaaaaaagaccagauguaacacaaccaguaccgaaagcagcauuauuaaaugcaauacgaaaauuacaugucggaaaaguaggagaaaacggauauguagaaauagaagacgacauuggaagaagagcagaaaugaacgaauuaauggaacaaacaagugaaauuauaacguuugcagaaucaggaacagccagaaaaacacuacacuuugaaauaucaaaagaaggcucagaccuaucaguuguagaaagagcggaaguaugguuauuucuaaaaguaccuaaagcaaacagaacaagaacaaaaguaacaauuagacuauuucaacaacaaaaacacccacaaggaagucuagauacaggagaagaagcagaagaaguaggauuaaaaggagaaaggagugaauuacuauuaagugaaaaaguaguagacgcaagaaaaucaacauggcacguauuuccaguaucaucaagcauacaacgacuacuagaccaaggaaaauccucauuagauguaagaaucgcaugcgaacaaugucaagaaaguggugcaucauuaguacuauuaggaaaaaaaaaaaaaaaagaagaagaaggagaaggaaaaaaaaaaggaggaggagaaggaggugcaggagcagacgaagaaaaagaacaaagccauagaccauucuuaauguuacaagcaagacaaagugaagaccauccucauaggagaagaagaagaggacuugaaugcgacggaaaaguaaauauauguuguaaaaaacaauucuuuguaagcuuuaaagauauaggauggaacgauuggauaauagcuccaaguggauaucacgcaaauuacugcgaaggagaaugcccaucacacauagcgggaacaagcggaagcucacuaucauuccauagcacaguaauaaaccauuacagaaugagaggacauaguccauucgcaaacuuaaaaucaugcugugucccaacaaaacuaagaccaauguccauguuauauuaugaugacggucaaaauauaauaaaaaaagauauacaaaacaugauaguagaagaauguggcuguagcuaa

SEQ ID NO: 771 - RNA, 1224 nt, Artificial Sequence
  derived and/or modified CDS sequence (opt6) from Homo sapiens__NP_002184.2__HsINHBB
auggauggauuacccgggagggcacuaggugcagcuugccuauuacuacuagcagcaggauggcuaggaccagaagcauggggaagcccgacaccaccuccuacaccagcagcaccaccaccaccuccuccaccaggaucaccaggaggaagucaagacacauguacaucaugcggaggauuccgaagaccagaagaacuaggaagaguagauggagauuuucuagaagcaguuaaacgacauauacuaucuagacuacaaaugcgaggaagaccaaauauaacacacgcaguuccaaaagcagcaaugguaacagcacuuagaaaauuacaugcagguaaaguacgugaagauggaagaguagaaauaccacaucuagacggucacgcuucaccaggagcugacggucaagaaagaguaucagaaaucaucagcuuugccgaaacugauggacuagcaucaucacgaguuagauuauauuuuuuuauuaguaaugaaggaaaucaaaauuuauucguuguccaagcuucauuauggcuuuauuuaaaauuacuaccuuauguauuagaaaaaggaucaagaagaaaaguaagaguuaaagucuauuuccaagaacaaggucauggagauagauggaauaugguagaaaaaagaguagaccuaaaaagaucaggauggcacacuuucccauuaacagaagcaauacaagcauuauucgaaagaggagaaagaagacuaaauuuagacguucaaugugacucaugucaagaauuagcaguaguaccaguuuuugucgauccaggagaagaaagucauagaccuuuuguaguaguacaagcgagauuaggagauucaagacacagaauaaggaaaagaggauuagaaugugacgggagaacaaacuuauguuguagacaacaauuuuuuauagauuuucgacuaauaggauggaaugauuggauaauagcaccuacaggauauuauggaaauuauugugaaggaaguuguccagcauauuuagcaggaguaccaggaucagcaagcaguuuucauacagcaguaguuaaucaauauagaaugagaggacuaaauccuggaacgguaaauucguguugcauuccuacaaaacuaucaacaaugagcauguuauacuucgaugacgaauauaauauaguuaaaagagacguaccaaacaugauuguagaagaauguggaugugcuuga

SEQ ID NO: 772 - RNA, 3459 nt, Artificial Sequence
  derived and/or modified CDS sequence (opt6) from Homo sapiens__NP_000623.2__HsITGAM
auggcucucagaguacuacuacuaacugcacuaacuuuaugccacggcuucaacuuagauaccgaaaacgccaugacuuuucaagaaaaugcaagagguuucggacaaucuguaguacaacuacaaggcucaaggguaguuguaggcgccccucaagaaaucguagccgcuaaucagcgagguucucuuuaucaaugugauuauucaacuggauccugugaacccauccgauuacaaguaccuguagaagcuguaaauaugucacuuggacuaagucucgcugcaacaacaucacccccgcaacuacucgcauguggcccaaccguacaucagacauguucugaaaacacauacguaaaaggauuauguuuccuauuuggcaguaacuuacgacaacaaccacaaaaauucccagaagccuuaagaggauguccucaagaagauagcgauauugcauuccucauagauggaucugguuccauuauaccucaugauuuccggcgaaugaaagaauuuguuucaacagucauggaacaacuaaagaaaucaaaaacauuauuuuccuuaaugcaauauagugaagaguuccgaauacauuuuaccuucaaagaauuucaaaauaacccaaacccgcgaagucucguaaaacccauuacccaacuucuagguagaacucacacagcaacagguauuagaaaaguuguucgagaguuauuuaauauuacaaacggagcacguaaaaacgcuuucaaaauccuaguuguaauaacagacggagaaaaauuuggugacccacuagguuaugaagauguuaucccagaggcugacagagaaggagucauuagauaugucauaggaguaggagaugcauuccgcagugagaaaaguagacaggaacuuaacacgauagccucuaaacccccaagggaucacgucuuccaaguaaacaacuuugaggcuuuaaaaaccauacaaaaccaauugcgugagaaaauuuuugcuauagaagggacacaaacuggauccucaucuucauuugaacaugaaaugucucaagaaggauuuucagcagccaucacaucaaacggaccuuuacuaucaaccguuggcuccuaugauugggcuggaggagucuuccuuuauacuucuaaagaaaaauccacuuuuauaaauaugacccggguugauagcgacaugaaugacgccuauuuggguuaugcagcugcuauaauacuacgaaaucguguccaaaguuuaguccuaggagcucccagauaucagcauauugguuuaguugcgauguuuagacaaaacacagguaugugggaaucaaaugcaaauguuaaaggaacacaaauuggggcauauuucggcgcuucccuauguucaguagacgucgauucaaauggauccacggauuuaguucucauaggugcaccacacuauuaugaacaaacccgagguggccaagucuccguaugcccccuaccacgcggccgugcacguuggcagugcgacgcuguacuuuauggugaacaaggacaaccuuggggacguuuuggagcagcccuaacuguacuuggagacguuaauggcgacaaauuaacggauguugcgaucggggcaccaggcgaagaagauaauagaggagccguauacuuauuucauggcacaagcggcucaggaauaucaccuucacauagucaaagaauagcaggaucaaaacuaucuccaagauuacaauacuuugggcaaagucuaagcggcggacaagaccuuacaauggauggauuaguagaucuaaccguuggagcacaaggacauguauuauuauuaagaucccaaccuguucuuagagucaaagcuauuauggaauuuaacccuagagaaguagcucgcaauguuuuugaauguaaugaucagguuguuaaagguaaagaagcaggagaaguccguguuugucuucacguacagaaaucaacuagggauagacuaagagaaggacaaauacaaaguguuguuacauaugauuuagcacuagacucuggucgaccacauucaagagcaguuuucaacgagacuaaaaacucaacacgaagacaaacccagguauuagguuuaacacaaacuugcgaaacacuuaaacuacaauuaccuaauugcauagaagauccaguuucaccaauaguccuacgauuaaacuucucauuaguuggcaccccacuguccgcuuucggaaaccuacgucccguccucgcagaagacgcacaaagacuauuuacagcuuuauucccuuuugaaaagaauugcggcaaugauaauauaugucaagacgaucuuucaauuacuuuuaguuuuaugucacuagauugccuaguaguaggaggaccaagagaauuuaauguaacaguuacaguacgcaacgacggagaagacucuuaucgaacacaaguuacauuuuucuuuccauuagacuuaaguuaccgaaaaguaucaacccuucaaaaucaacgaucacaaagaucauggagguuagccugcgaaucggcaucauccacugaaguaucuggugcacucaaaaguacuucauguuccauuaaucauccuauauuuccugaaaauuccgaaguaaccuuuaacauaacauuugauguugauucaaaagccucucucgguaauaaauuacuacuuaaagcaaacgugacauccgaaaauaacaugccaagaacuaauaaaacggaauuucaauuagaauuaccuguuaaguacgcagucuacaugguugugacaagucauggcguuuccacaaaauaucuuaacuuuacagcaagugaaaacacaucaaggguuaugcaacaucaauaucaagucaguaaccuuggucaacgaagccuaccaaucucauuggucuuucucgucccaguaagacuaaaucaaaccguaauaugggaucgaccgcaaguuacuuucagugaaaacuuaaguucuacaugccacacaaaagaaagacuuccaucucacucugacuuucuagcugaacuacgaaaagcucccguuguaaacuguucuauagcaguuugucaacguauacaaugugauauuccauucuuuggaauacaagaagaguucaaugcuacauuaaaagguaauuuaucguuugauugguacauuaaaacuagccauaaucauuuauuaauaguuucuacugcagaaauccuguuuaaugauuccguauucacucuauuacccggacaaggagcauuuguaagaucccaaaccgaaacaaaaguagaaccuuuugaaguccccaacccucuuccuuuaaucguuggaucaagcguuggcggacuauuacuuuuagccuuaauaacggcggcauuauauaaauuaggauucuucaaacgccaauauaaagauaugaugucugaagguggaccuccuggagcagaaccacaauaa

SEQ ID NO: 773 - RNA, 1404 nt, Artificial Sequence
  derived and/or modified CDS sequence (opt6) from Homo sapiens__NP_002415.1__HsMMP8
auguuuucacuaaaaacauuaccuuuccuacuucuacuacacguacaaauaucaaaagcauuuccagucucaucaaaagaaaaaaacacaaaaacaguacaagauuaucucgaaaaauuuuaccaauuaccaucaaaucaauaucaaucaacacgaaaaaauggaacaaacguaauaguugaaaaauuaaaagaaaugcaaagauucuuuggacucaaugucacaggcaaaccuaacgaagaaacacuagacaugaugaaaaaaccaagaugcggaguaccagacucaggaggauucauguuaaccccaggcaacccuaaaugggaaagaacaaaucuaacauacagaauacgaaacuauacaccacaacuauccgaagcagaagucgaaagagcaauaaaagacgcuuuugaacuuuggucaguagccuccccacuaauauucacacgaauaucacaaggagaagccgacaucaacauagcauuuuaucaacgagaccacggagacaauucccccuucgacggaccaaauggaauacuagcacacgcauuccaaccuggacaaggaauaggaggagaugcacauuucgacgcagaagaaacauggacaaacacaucagcaaacuacaaccuauucuuagucgcagcacacgaauucggacauucucuaggacuagcccauucaucugaccccggcgcacuaauguauccaaacuacgcauuuagagaaacauccaacuacucccuaccccaagacgauauagaugguauccaagcaauauacggacuauccucaaauccaauacaaccaacaggccccucuacaccaaaaccaugcgacccaucccuuacauucgacgcaauaacaacccuccgaggagaaauauuauucuuuaaagacagauacuucuggagaagacacccucaacuccaacgaguugaaaugaacuucauaucuuuauuuuggccaucucuaccaacagggauccaagcagcuuacgaagauuuugaucgcgacuuaauauuuuuauucaaaggaaaucaauacugggcauuaucaggauaugauauacuacaaggauaccccaaagacauaucaaauuauggauuccccuccucaguccaagccaucgacgcugcaguauucuaccgaucaaaaaccuacuucuuuguaaaugaccaauuuuggagauacgauaaucaacgucaauucauggaaccugguuauccaaaaucaauaucuggcgcauuucccggaauagaaagcaaaguagacgcagucuuucaacaagaacacuucuuccacguauuuagcggaccaagauacuacgccuuugacuuaauagcacaaagaguaacacgaguugcaagaggaaacaaauggcuaaacuguagauacggauaa

SEQ ID NO: 774 - RNA, 2124 nt, Artificial Sequence
  derived and/or modified CDS sequence (opt6) from Homo sapiens__NP_004985.2__HsMMP9
augagucuauggcaaccauuaguauuaguuuuacuuguacucgguuguugcuucgcugcaccuagacaacgucaaucaacccucgugcucuuuccaggagaucuucgaacuaauuuaacagauagacaauuagcagaagaauauuuauauagguauggcuauacacgaguagcugaaaugcgaggagaaaguaaaagccuaggaccugccuuauuacuacuacaaaaacaacuaucauuaccagaaacuggagaauuagacuccgcuacucuaaaagcaaugcgcaccccacguugcggaguaccagauuuaggacgauuucaaacauuugaaggagauuuaaaauggcaucaucacaauauaacauacuggauucaaaacuacagugaagauuuacccagggcaguaauagacgaugcauuugcaagggcauuugcauuauggucagcuguuacuccacucacuuucacuagaguuuacaguagagaugcagauaucguaauacaauuuggaguagcagaacacggcgacggauacccauucgacgguaaagauggacuacuagcucaugccuucccaccagguccagguauacaaggagacgcacauuuugaugaugaugaauuauggaguuuaggcaagggaguugucguaccaacucgauuuggaaaugcugauggugcagcuugccauuuucccuuuauuuucgaagggagaucguauucagcuugcacaacagacggaagauccgauggucuaccauggugcucuacaacagcuaacuaugacacagacgauagauucggauucugcccauccgaacgauuauauacucaagauggaaaugcagacgguaaaccaugucaauucccauuuauauuccaaggacaaucauauagcgcuugcacaacagauggaagaagcgauggauacagauggugcgcaacaacagcuaacuaugaucgagacaaacuauuuggauuuuguccaacacgugcugauuccacaguaaugggaggaaauucugcuggugaacuauguguauucccauuuacauuccuugguaaagaauacucuacauguacaagcgaaggcagaggcgacggaagacuuuggugugcuacaacaucuaauuuugauagugauaaaaaauggggauucuguccagaccaaggauacucauuauuucuaguagcugcacaugaauuuggacaugccuuaggauuagaucauaguucuguaccagaagcucugauguauccuauguaccgauucacugaaggaccaccacuccauaaagacgauguuaauggaauaagacauuuguacggacccaggccagaaccagaaccaagaccaccaacaacaacaacuccucaaccgacagcaccaccaacaguuuguccaacaggaccccccacaguacauccaucagaaagaccuacagcaggaccaacagguccgccaucagccggaccaacuggaccuccaacagcaggccccuccacagcaacaacaguaccauuaucaccaguagaugaugcaugcaauguaaauauauuugaugcuauagcagagauaggcaaucaacuauaucucuuuaaagacggaaaauauuggagauucucagagggcagaggaucaagaccccaaggaccauuuuuaauugcagauaaauggccagcuuuaccaaggaaauuagauucagucuuugaagagcgccucucaaaaaaauuauuuuuuuucucaggaagacaagucuggguuuauaccggagcauccguauuaggaccaagaagauuagacaaauuagguuuaggugcugaugucgcacaaguuacaggagcuuuacgaagcggucgaggaaaaaugcuacuguucucugguagaagacuauggagauuugacguaaaagcgcaaaugguagacccucgaagcgcuagugaaguagauagaauguucccugguguaccucuugacacccaugacguuuuucaauacagagaaaaagcauauuuuugccaagaucgcuucuacuggcgaguuaguucacguagcgaacuaaaucaaguagaccaaguuggauaugucacauacgauauacuacaauguccagaagacuaa

SEQ ID NO: 775 - RNA, 1416 nt, Artificial Sequence
  derived and/or modified CDS sequence (opt6) from Homo sapiens__NP_002418.1__HsMMP13
augcacccagguguacuugcagccuucuuauuuuuaucauggacucacuguagagcacucccacuaccaucaggaggagacgaagaugauuuaucagaagaagaccuccaauucgcagaaagauaucuaagaucuuacuaucacccaacaaacuuagcagguauacuaaaagaaaacgcagcaucaucaaugacagaaagacuaagagaaaugcaaucauucuuuggauuagaaguaacaggaaaacuagaugauaauacacuagacguaaugaaaaaacccagaugcggaguaccugauguaggagaauacaacguauucccaagaacacuaaaauggucaaaaaugaaucuaacauacagaaucguaaacuauaccccagacaugacacauagugaaguagaaaaagcauucaaaaaagcauucaaaguauggucagacguaacaccauuaaacuucaccagacuucacgauggaauagcagacauuaugauuucauuuggcauaaaagaacauggcgacuucuacccauucgacgguccaagcgguuuacuagcccaugcauucccaccuggaccuaacuauggcggagacgcacacuuugacgaugacgaaacauggaccaguucaaguaaaggauacaaucuauuuuugguagcugcccacgaauucggccacucacuaggacuagaccauucaaaagacccuggugcauuaauguucccaauauauaccuauacaggaaaaucacauuucauguuaccagaugaugauguacaaggcauccaaucauuauacggcccaggagacgaagauccaaacccaaaacacccaaaaacaccagacaaaugcgacccuucacuaucucuagacgcaauaacuucuuuaagaggagaaacaaugauauucaaagaucgauucuucuggagacuucacccacaacaaguagaugcagaacuauucuuaacaaaaucuuucuggccagaacuaccaaaccguaucgacgcagcauaugaacacccaucacaugacuuaauauuuauauuuagaggacgaaaauuuugggcauuaaacggauaugauauauuagaaggauacccuaaaaaaauaucagaacucggauuaccaaaagaaguuaaaaaaauaucggcagcuguacacuucgaagacacaggcaaaacccuauuauuuucaggaaaccaaguauggcgauaugacgacacaaaucauauaauggauaaagauuacccaagauuaauagaagaagauuucccaggaauaggugacaaaguagacgcaguauacgaaaaaaaugguuacauauauuuuuuuaacggacccauacaauucgaauacucaauauggucaaacagaauaguacgagucaugccagcaaauucgauacuuuggugcuaa

SEQ ID NO: 776 - RNA, 1068 nt, Artificial Sequence
  derived and/or modified CDS sequence (opt6) from Homo sapiens__NP_001286.1__HsCCR1
auggaaacaccaaacacaacagaagacuacgauacaacaacugaauucgacuacggagacgcaacaccaugucaaaaagucaacgaacgagcauucggagcacaauuacuaccuccacuauacucauuaguauuuguaauaggcuuagucggaaacauacuaguaguacuaguuuuaguucaauacaaaagacuaaaaaacaugacaucuauauacuuacuaaacuuagcaauaucagaucuucuauucuuauucacccuuccauucuggauagacuacaaauuaaaagacgacuggguauucggcgacgcaaugugcaaaauauuauccggauucuauuacacaggacuauacucagaaauauuuuucauaauacuccuaacaauagacagauaccuagcaauaguucacgcaguauucgcuuuaagagcaagaaccguaacauucggaguuauaacaucaauuauaaucugggcacuagccauacuagccucaaugccaggacuauacuucucuaaaacucaaugggaauucacacaccauacauguucacuccacuuuccccaugaauccuuaagagaauggaaacucuuccaagcacuaaaauuaaacuuauucggacuaguauuaccacuacuaguaaugauaauaugcuacacaggaauuauaaaaauccuacuuagaagaccaaacgaaaaaaaaucaaaagcagucagacuaauauucgucauaaugauaaucuuuuuuuuauucuggacaccuuacaaucucacuaucuuaauaucaguuuuccaagacuuccuauucacacacgaaugugaacaaucaagacacuuagacuuagcaguacaagucacugaaguaauagcauacacacacugcugcguaaacccaguaaucuacgcauucguaggagaaagauuuagaaaauaccuaagacaacuauuccacagaagaguugcuguacaccuaguaaaaugguuacccuucuuaucagucgaucguuuagaaagagucucaucaacaucacccucaacaggugaacacgaacuaucagccggauuuuaa

SEQ ID NO: 777 - RNA, 636 nt, Artificial Sequence
  derived and/or modified CDS sequence (opt6) from Homo sapiens__NP_002598.4__HsPDGFA
augagaacauuagcaugcuuauuacuauuaggauguggauacuuagcacacguauuagcggaagaagcagaaauaccaagagaaguaauagaaagacuagcacgaucacaaauacacucaauaagggaccuacaaagauuacuagaaauagacucaguaggaagcgaagacucacuagacacaucauuaagagcacacggaguacacgcaacaaaacacguaccagaaaaaagaccacuaccaauaagaagaaaaagaagcauagaagaagcaguaccagcaguaugcaaaacaagaacaguaauauaugaaauaccacgaucacaaguagacccaacaucagcaaacuucuuaauauggccaccaugcguagaagugaaaagaugcacaggcugcugcaacacaucgucaguaaaaugccaaccaagcagaguacaccacagaucaguaaaaguagcuaaaguagaauacguaagaaaaaaaccaaaacuaaaagaaguacaaguaagacuagaagaacaccuagaaugcgcaugcgcaacaacaagccuaaacccagacuaccgagaagaagauacaggaagaccgcgagaaaguggaaaaaaacgaaaaagaaaaagacuaaaaccaaccuaa

SEQ ID NO: 778 - RNA, 726 nt, Artificial Sequence
  derived and/or modified CDS sequence (opt6) from Homo sapiens__NP_002599.1__HsPDGFB
augaauagaugcugggcacuauucuuaagcuuauguugcuacuuaagacuaguaucagcagaaggagauccaauaccagaagaauuauacgaaaugcuaagcgaccacucaaucagaagcuuugacgauuuacaaagacuacuacauggagauccaggagaagaagacggagcagaacuagacuuaaauaugacaagaucacacucaggaggagaauuagaaucacuagcaagaggaagaagaagucuaggaucacuaacaauagcggaaccagcaaugauagcagaauguaaaacacgaacagaaguauucgaaauaucaagaagauuaauagacagaacaaaugcaaacuuccuaguauggccaccaugcguagaaguacaaagaugcucaggauguugcaauaacagaaacguacaauguaggccaacacaaguacaauuaagaccagugcaaguaagaaaaauagaaauaguacguaaaaaaccaauauuuaaaaaagcaacaguaacacuagaagaccaucuagcauguaaaugcgaaacaguagcagcggccagaccaguaacaagaagcccaggaggaagucaagaacaaagagcaaaaacaccacaaacuagaguuacaauaagaacaguaagaguaagaagaccaccaaaaggaaaacauagaaaauucaaacacacacaugauaaaacagcacuaaaagaaaccuuaggagcauga

SEQ ID NO: 779 - RNA, 1038 nt, Artificial Sequence
  derived and/or modified CDS sequence (opt6) from Homo sapiens__NP_057289.1__HsPDGFC
augagcuuauucggacuacuacuccuuacuucagcacuagcaggacaaagacaaggaacacaagcagaaucaaaccuaagcucaaaauuccaauuuucaucaaacaaagaacaaaauggaguacaagauccacaacacgaaaggauuauuacagucucaacaaacggaaguauacacaguccaagauucccacauacauacccaagaaacacaguuuuagucuggcgacuaguagcaguagaagaaaauguauggauacaacuaacauucgaugaaagauucggauuagaagacccagaagacgacauaugcaaauaugacuuuguagaagucgaagaaccaagugacgguacaauacuaggaagauggugcggaucaggaacaguaccaggcaaacaaauaaguaaaggaaaccaaauuagaauaagauucguaucagaugaauacuuuccaucagaaccaggauucugcauacauuacaacauaguaaugccacaauucaccgaagcaguuucaccaucaguuuuaccaccaagugcccucccauuagaccuacuaaacaacgcaauaacugcauucaguacucuagaagaccuaauaagauaccuagaaccagaaagauggcaauuagaucucgaagaccuauauagaccaacauggcaacuauuaggcaaagcauuuguauucggaagaaaaucaagaguaguagacuuaaaccuauuaacagaagaaguaagacuauacagcugcacaccaagaaacuuuucaguuucaauaagagaagaauuaaaaagaacagauacaaucuucuggccaggaugucuauuagucaaaagaugcggcggaaacugcgcaugcugccuacauaacugcaacgaaugccaaugcguaccaaguaaaguaacaaaaaaauaccacgaaguauuacaacuaagaccaaaaacuggaguaagaggucuacacaaaucacuaacugacguagcauuagaacaucacgaagaaugugacugcgucugcagaggaucaacaggaggauaa

SEQ ID NO: 780 - RNA, 1095 nt, Artificial Sequence
  derived and/or modified CDS sequence (opt6) from Homo sapiens__NP_149126.1__HsPDGFD
augcacagacuaauauucguauacacacucauaugcgcaaauuucugcucauguagagacacaucagcaacaccacaaucagcaucaauaaaagcacuaagaaacgccaaccuaagacgagacgauuuauacagaagagacgaaacaauacaaguaaaagguaacggauauguacaaucaccaagauucccaaacaguuacccaagaaaucuacuacuaacauggagacuacacucacaagaaaacacaagaauacaacuaguauuugacaaccaauuuggacuagaagaagcugaaaacgacauauguagauaugacuucguagaaguagaagacauaagugaaacaucaacaauaauuagaggaagauggugcggccacaaagaaguaccaccccgaauaaaaucaaggacaaaccaaaucaaaauaacuuucaaaucagacgacuacuuuguagcaaaaccaggcuuuaaaauauacuauagcuuacuagaagacuuccaaccagcagccgcaagugaaacaaacugggaaagcguaacaucaagcaucucaggaguaagcuauaacucaccaucaguaacagacccaacacuaauagcagacgcauuagacaaaaaaauagcagaauucgacacaguagaagauuuauuaaaauacuucaacccagaaucauggcaagaagaccuagaaaauauguaccucgacacaccaagauauagaggaagaagcuaucacgauagaaaaucaaaaguagaccuagacagacuaaaugacgacgcuaaacgauauaguuguacaccaagaaacuacagugucaacauacgagaagaacuaaaacuagcaaacguaguauucuuuccacgaugucuacuaguacaaagauguggaggaaacugcggaugcggaacaguaaauuggagaucaugcaccugcaacagcggaaaaacaguuaaaaaauaccacgaaguacuacaauucgaaccuggccacauaaaacgaaggggaagagcaaaaaccauggcacuaguagauauccaacuagaucaucacgagagaugugacuguauauguaguucaagaccaccaagauaa

SEQ ID NO: 781 - RNA, 678 nt, Artificial Sequence
  derived and/or modified CDS sequence (opt6) from Homo sapiens__NP_003946.3__HsSOCS3
augguaacacacucaaaauucccagcagcaggaaugucaagaccauuagacacaucauuaagacuaaaaacauucucaucaaaaucagaauaucaacuaguaguaaacgcaguaagaaaacuacaagaaucaggauucuacuggucagcaguaacaggaggagaagccaaccuacuccuaucagcagaaccagcaggaaccuuccuaauaagagacucaucagaccaacgacacuucuucacacuaucaguaaaaacacaauccggaacaaaaaaccucagaauacaaugcgaaggaggaucauucucacuacaaucagacccacgcuccacacaaccaguaccaagauucgacugcguacuaaaacuaguacaccacuacaugccaccaccaggagccccaucauuuccaucaccaccaacagaaccaucaucagaaguacccgaacaaccaucagcacaaccacuccccggaucaccaccaagaagagcauacuacauauacucaggaggagaaaaaauaccauuaguacuauccagaccauuaucuucaaacgucgcaacacuacaacaucuaugcagaaaaacaguaaacggacacuuagacucauacgaaaaaguaacccaacuaccaggccccauacgagaauuccuagaccaauacgacgcaccacuauaa

SEQ ID NO: 782 - RNA, 483 nt, Artificial Sequence
  derived and/or modified CDS sequence (opt6) from Homo sapiens__NP_003227.1__HsTGFA
augguaccaucagcaggacaauuagcauuauucgcauuaggaauaguauuagcagcaugucaagcauuagaaaauucaacaucaccacuaucagcagauccaccaguagcagcagcuguaguaucacauuuuaaugacuguccagauucacauacucaauucuguuuucauggaacauguagauucuuaguacaagaagacaaaccagcauguguaugucauucaggauauguaggagcaagaugugaacaugcagauuuauuagcaguagucgcagcaucacaaaaaaaacaagcaauaacagcauuaguaguaguaucaauaguagcauuagcaguacuaauuauaacauguguacuaauacauuguugucaaguaagaaaacauugugaauggugcagagcauuaauauguagacaugaaaaaccaucagcauuauuaaaaggaagaacagcauguugucauucagaaacaguaguauaa

SEQ ID NO: 783 - RNA, 1173 nt, Artificial Sequence
  derived and/or modified CDS sequence (opt6) from Homo sapiens__NP_000651.3__HsTGFB1
augccaccuagcggacucagauuauuacccuuacuacucccacuccuauggcuacuaguacuaacuccaggaagaccagcagcaggacuaaguacauguaaaacuauagacauggaauuaguaaaaagaaaaagaauagaagccauacguggacaaauccuaucuaaauugagacuagccucaccuccaucacaaggagaaguaccaccaggaccccuacccgaagcaguacuagcacuauacaacucaacaagagauagaguagcaggagaaucagcagaaccagaaccagaaccagaagcagauuauuacgcaaaagaaguaacacgcguauuaaugguagaaacacauaacgaaauauaugauaaauucaaacaaucuacacacucuauauacauguucuuuaauacaucagaacucagagaagccguacccgaaccaguauuauuaucaagagcagaacuaagacuucuaagacuaaaacucaaaguugaacaacacguagaacuauaccaaaaauacucaaacaauucuuggagauauuuaucuaacagacuacuagcccccucagacuccccugaauggcuaucauucgacguaacaggaguagucagacaaugguuaucuagaggaggagaaauagaaggauuccgacuuucagcacacuguucuugugauagucgcgacaacacauuacaaguagacauaaacgguuucacaacuggacguagaggagaccuugcaacaauacaugguaugaacagaccauucuuacuacuaauggcaacaccacucgaacgagcacaacaucuacaauccucacgccacagacgagcccuagacacaaacuacugcuucucaucaaccgaaaaaaauuguugcguaagacaauuauacauagauuucagaaaagaccuaggauggaaauggauacaugaaccuaaaggauaccacgccaauuuuuguuuaggcccauguccauacauauggucacuagacacacaauacucuaaaguauuagcucuauacaaccaacacaacccaggcgcaucagcagcaccaugcuguguuccacaagcuuuagaaccauuaccaaucguauauuacguaggaagaaaacccaaaguagaacaauuaucaaacaugauagucagaucauguaaaugcucuuaa

SEQ ID NO: 784 - RNA, 1245 nt, Artificial Sequence
  derived and/or modified CDS sequence (opt6) from Homo sapiens__NP_003229.1__HsTGFB2
augcauuacugcguacuaucagcauuccuaauacuacaccuaguaacaguagcauuaucccuaucaacuugcuccacccuagacauggaccaauuuaugagaaaacgcauagaagcaauaagaggacaaauuuuaucaaaacucaaacuaacaagcccaccagaagacuacccagaaccagaagaaguaccaccggaagucauuucaauauacaauucaacaagagaccuacuacaagaaaaagcaucaagaagagcugcagcaugugaaagagaacgcagcgacgaagaauacuacgcaaaagaaguauacaaaaucgacaugccuccauucuucccaagcgaaaacgcaauaccaccaacauucuaucgaccauauuuuagaauaguaagauucgacgucucagccauggaaaaaaaugcuagcaauuuaguaaaagcagaauuuagaguuuucagacuacaaaacccaaaagcacgaguccccgaacaacgaauagaauuauaccaaauacuaaaaucaaaagaccuaacauccccaacacaaagauacauagacucaaaaguaguuaaaacccgagcagaaggcgaauggcuaucuuucgauguaacagacgcaguacacgaaugguuacaccacaaagauagaaaccuagguuucaaaauaucucuccacugcccaugcugcacauucguaccauccaacaacuacauaauaccaaacaaaucugaagaauuagaagcaagauucgcaggaauagacgguacaucaaccuacacaucaggagaucaaaaaacaauaaaauccacaagaaaaaaaaauucaggaaaaacaccacaccuacuacuaaugcuacuaccaagcuacagauuagaaucacaacaaacaaacagacgaaaaaaaagagcacuagaugcagcauacugcuucagaaacguacaagacaacugcugucuccgcccacuauacauagauuucaaacgagauuuaggauggaaauggauacacgaacccaaaggauauaacgccaacuucugcgcaggagcaugcccauauuuauggucauccgacacccaacacuccagaguccuaucucucuacaacaccauaaacccagaagcaucagcaucacccugcuguguaucccaagacuuagaaccacuuacaauauuauacuacauaggaaaaacaccaaaaauagaacaacuaucaaacaugauagucaaauccuguaaaugcucauaa

SEQ ID NO: 785 - RNA, 1239 nt, Artificial Sequence
  derived and/or modified CDS sequence (opt6) from Homo sapiens__NP_003230.1__HsTGFB3
augaaaaugcacuuacaaagagcauuaguuguacuagcacuucucaacuuugcaacaguaucacuaucauuaucaaccugcacaacacuagacuuuggacacauaaaaaaaaaacgaguagaagccauaagaggacaaauacuaucaaaacuaagacuaacaucaccaccagaaccaaccguaaugacacacgucccauaccaaguauuagcccuauacaacaguacaagagaacuacucgaagaaaugcacggagaacgagaagaaggaugcacucaagaaaauacagaaucagaauacuacgcaaaagaaauacacaaauuugauaugauacaaggauuagcagaacacaaugaacuagccguaugcccaaaaggaauaacaucaaaaguauuuagauuuaacguaucaucagucgaaaaaaaccgcacaaaucuuuucagagcagaauuucgagugcuacgaguaccaaauccaucaucaaaaagaaacgaacaacgcauagaacuauuucaaauccuacgaccagacgaacacauagcaaaacaaagauacauaggaggcaaaaaccuccccacaagagguaccgcagaaugguuaucauucgaugucaccgacacaguacgagaaugguuacuaagaagagaaucaaaccuaggcuuagaaauaucaauccacugcccaugccacaccuuucaaccaaauggagacauauuagaaaacauacacgaaguuauggaaauaaaauucaaaggaguagauaaugaagaugaccacggacgaggugaucuuggaagacuaaaaaaacaaaaagaccaccacaacccacaucuaauauuaaugaugauaccuccacacagauuagacaaccccggacagggaggacaaagaaaaaaaagagcacuagauacaaacuauugcuucagaaaccuagaagaaaacugcugcgucagaccuuuauacauagauuucagacaagaucucggauggaaauggguccacgaaccaaaaggauacuaugcaaacuuuugcuccggccccugcccauaucuacgaucagcagacacaacacacucaacaguacucggacuuuauaacacucuaaaccccgaagcauccgccuccccaugcuguguuccacaagacuuagaaccacuaacaauauuauacuauguaggacgaacaccaaaaguugaacaauuaagcaacaugguaguaaaaucaugcaaauguagcuaa

SEQ ID NO: 786 - RNA, 1386 nt, Artificial Sequence
  derived and/or modified CDS sequence (opt6) from Homo sapiens__NP_001057.1__HsTNFRSF1B
auggcacccguagcugucugggcagcauuagcaguuggauuagaauuaugggcagcugcccacgcacuaccagcccaaguagcauucacaccuuacgccccagaaccuggaucuaccugcagacuaagagaauauuacgaucaaacagcucaaauguguuguucaaaauguucaccaggccaacaugcaaaaguauucuguacaaaaacaucagauacaguaugugauucaugcgaagauucaacuuauacacaauuauggaauuggguucccgaaugccuauccuguggaucaagauguucaucagaucaaguagaaacccaagcauguacaagagaacaaaauagaauauguacaugcagaccagguugguauugugcacuaagcaaacaagaaggaugcagauuaugugccccauuaagaaaaugucgaccaggcuucggaguagcacgaccuggaaccgaaaccucugauguaguaugcaaaccaugugcaccaggaacauuuucaaacacaacaucuucaacagacauaugcagaccacaccaaauauguaacguuguagcaauaccuggcaaugccucaauggaugcaguuuguacaucaacauccccaacaagaucuauggcaccaggagccguacauuuaccacaaccaguuaguacucgaucacaacauacccaacccacacccgaaccauccacugcuccguccaccucauuccuacuaccaaugggacccucuccaccagcugaagguucuacaggagacuucgcacuaccaguuggauuaauaguaggaguaaccgcacuaggacuucuaaucauaggaguaguuaauuguguaaucaugacucaaguuaaaaaaaaaccuuuauguuuacaacgagaagcaaaaguaccacauuuaccggcagauaaagcaagaggaacucaaggaccagaacaacaacaucuauuaauuacagcuccaucaucaucaucaucaucacuagaaucaucagcuucagcacuugaucgaagagcaccuacacguaaccaaccacaagcaccagguguggaagcuucaggugcaggagaagcaagagcaaguacaggaucaucagacaguucaccaggaggucauggaacacaaguaaauguaacuuguauaguaaaugucuguagcucaucagaucauucaucccaaugcucaucucaagccuccucaacaaugggagacacagauuccucuccaucagaaucaccaaaagacgaacaaguaccauuuucaaaagaagaaugugccuucagaucacaacuagaaacaccagaaacuuuauuaggaucaacugaagaaaaaccgcuacccuuaggaguaccagacgccggaaugaaacccucuuaa

SEQ ID NO: 787 - RNA, 513 nt, Artificial Sequence
  derived and/or modified CDS sequence (opt6) from Homo sapiens__NP_002623.2__HsPGF
augccaguaaugagauuauuuccauguuuucuacaauuauuagcaggauuagcacuaccagcaguaccaccacaacaaugggcauuaucagcaggaaauggaaguucagaaguagaaguaguaccauuucaagaaguguggggaagaucauauuguagagcauuagaaagauuaguagauguaguaagugaauauccaagugaaguagaacauauguuuucaccaaguuguguaaguuuauuaagauguacagguuguuguggagaugaaaaccuacauuguguaccaguagaaacagcaaauguaacaaugcaauuauuaaaaauaagaaguggagauagaccaucauauguugaauuaacauuuagucaacauguaagaugugaaugcagaccacuaagagaaaaaaugaaaccagaaagaagacgaccaaaaggaagaggaaaaagaagaagagaaaaacaaagaccaacagauugucauuuauguggagaugcaguaccaagaagauaa

SEQ ID NO: 788 - RNA, 1239 nt, Artificial Sequence
  derived and/or modified CDS sequence (opt6) from Homo sapiens__NP_001020537.2__HsVEGFA
augacagauagacaaacugauacagcaccgaguccgaguuaucauuuauuaccaggaagaaggagaacaguagaugcagcagcaucaagaggacaaggaccugaaccagcaccaggaggagggguagaaggaguuggagcuagaggaguagcauuaaaauuauuuguccaguuauuaggaugcaguagauuuggaggagccguaguaagggcaggagaagcagaaccaucaggggcagcacgaagugcaucaaguggaagagaagaaccacaaccagaagaaggagaagaagaagaggagaaagaagaagaaagaggaccacaauggcggcugggugcgagaaaaccaggaaguuggacaggagaagcagcaguaugcgcagauucagcucccgcagcgagagcaccucaagcauuagcaagagcaagcggaagaggaggaagaguagcaagaagaggagcagaagaaucagggccaccucauagcccaaguagaagggguagugcaaguagagcaggaccaggaagagcaagcgaaacaaugaauuuuuuauuaagcuggguacauuggucauuagcgcuauuacuauauuuacaucaugcaaaauggagccaagcagcaccaauggcagaaggaggaggucaaaaccaucacgaaguaguaaaauuuauggauguuuaucaaaggucauacugccacccaauagaaacacuaguagauauauuucaagaauacccagacgaaauagaauauauauuuaaaccaagcuguguaccacuaaugagaugugguggauguugcaacgaugaaggacuagaauguguaccaacagaagaaucuaauauaacaaugcagauaaugagaauaaaaccacaccaaggacaacauauaggagaaaugaguuuuuuacaacauaauaaaugugaauguagaccaaaaaaggauagagcaaggcaagaaaaaaaaucaguaagaggcaaaggaaaaggacaaaaaaggaaaagaaaaaagagcagauauaaaaguuggagcguguauguaggagcaagaugcugucuaaugccauggucacuaccaggaccucauccauguggaccauguagugaacgaagaaaacaucuauuuguacaggauccacaaacauguaaauguagcuguaaaaauacagauaguagauguaaagcaaggcaauuagaauuaaaugaaaggacuuguagaugcgauaaaccuagaagguag

SEQ ID NO: 789 - RNA, 699 nt, Artificial Sequence
  derived and/or modified CDS sequence (opt6) from Homo sapiens__NP_001165094.1__HsVEGFA
augaacuuucuauuaagcuggguacauuggucacuugcauuauuacuauauuuacaucacgcaaaauggagccaagcagcaccaauggcagaaggaggaggacaaaaccaucacgaaguaguaaaauuuauggauguauaucaaaggaguuacugccauccaauagaaacacuaguggacauauuccaagaauauccagaugaaauagaauauauauuuaaaccaagcuguguaccacuaaugagauguggaggaugcuguaacgaugaaggacuagaaugcguaccaacagaagaaagcaauauaacaaugcaaauaaugagaauaaaaccacaccaaggacaacacauaggagaaaugucauucuuacaacauaacaaaugcgaaugcagaccaaaaaaagaucgagcaagacaagaaaaaaaaucaguaagaggaaaaggaaaaggacaaaaaagaaaaagaaaaaaaagcagauacaaaaguuggagcguauacguaggagcaagauguugcuuaaugccauggucacuaccaggaccacacccaugcggacccuguagcgaaagaagaaaacaucuauucguacaagacccacaaacaugcaaaugcucaugcaaaaacacagacucaagauguaaagcaagacaacuagaacuaaaugaaagaacauguagaugugacaaaccaagaagauaa

SEQ ID NO: 790 - RNA, 624 nt, Artificial Sequence
  derived and/or modified CDS sequence (opt6) from Homo sapiens__NP_003368.1__HsVEGFB
augucaccauuacuaagaagacuauuacuagcagcauuauuacaacuagcaccagcacaagcaccaguaucacaaccugaugcaccaggacaucaaagaaaaguaguaucauggauagauguauauacaagagcaacaugccaaccaagagaaguaguaguaccacuaacaguagaauuaaugggaacaguagcaaaacaauuaguacccucaugcguaacaguacaaagaugcggagguuguuguccagacgauggacuagaauguguaccuacaggucaacaucaaguaagaaugcaaauauuaaugauaagauacccaaguucacaauuaggagaaaugucauuagaagaacauucacaaugcgaauguagaccaaaaaaaaaagacucagcaguaaaaccagacagagcagcaacaccacaccauagaccucaaccaagaucuguaccaggaugggacucagcaccaggagcuccaucaccagcagacauaacucauccaacaccagcaccaggacccucagcacaugcagcuccaucaacuacaucagcauuaacaccaggaccagcagcagcugcugcagacgcagcagccucaucaguagcaaaaggaggagcauaa

SEQ ID NO: 791 - RNA, 1260 nt, Artificial Sequence
  derived and/or modified CDS sequence (opt6) from Homo sapiens__NP_005420.1__HsVEGFC
augcaccuauuaggauuuuucucaguagcauguucauuacuugcagcagcauuacuccccggaccaagagaagcaccagcugcagcagcagcauucgaaucaggacuagaccuaagcgaugcagaaccagacgcaggagaagcaacagcauaugcaaguaaagaccuagaagaacaauuaagaaguguaucaucaguagacgaacuaaugacaguacucuaccccgaauacuggaaaauguacaaaugccaauuaagaaaaggaggauggcaacacaacagagaacaagcuaaccuaaacucaagaacugaagaaacaauaaaauuugcagcagcccacuacaauacagaaauauuaaaaucaaucgauaacgaauggcgaaaaacacaauguaugccaagagaaguuuguauagacguaggaaaagaauuuggaguugcaacaaauacauuuuuuaaaccaccaugcgucucaguauacagaugcggaggaugcugcaauagcgaaggauuacaauguaugaauacaucaacaagcuacuuaagcaaaacacuauuugaaauaacaguacccuuaucacaaggacccaaaccaguuacaauaaguuuugcaaaucauacuucaugcagauguaugaguaaauuagauguuuaucgccaaguacauucaauaauacgacgcagucuaccagcaacauuaccacaaugccaagcugcaaauaaaacaugcccaacuaauuauauguggaauaaucacaucugcagaugucuugcacaagaagacuucauguuuuccucagaugcaggagacgauucaacagacggcuuccacgacauauguggaccaaauaaagaacuagaugaagaaacaugucaaugcgucugcagagcaggauuaagaccagcaucauguggaccacacaaagaauuagacaggaauuccugccaauguguauguaaaaauaaacuauuuccaucacaaugcggagccaaucgagaauucgacgaaaauacaugccaaugugucuguaaaagaaccugucccagaaaucaaccauuaaacccuggaaaaugugccugugaaugcacagagucaccacaaaaauguuuacuaaaaggaaaaaaauuccaucaucaaacaugcuccuguuacagaagacccugcacaaacagacaaaaagcaugcgaaccaggauucagcuacagugaagaaguaugcagauguguaccaucauauuggaaacgaccacaaaugucauaa

SEQ ID NO: 792 - RNA, 1065 nt, Artificial Sequence
  derived and/or modified CDS sequence (opt6) from Homo sapiens__NP_004460.1__HsVEGFD
auguacagagaauggguaguaguaaacguauucaugaugcuauacguacaauuaguacaagguuccucaaacgaacacggcccaguaaaaagaucaucccaaagcacacuagaaagaucugaacaacaaauaagagcagcaucuucacuagaagaacuuuuaagaauaacacacucagaagacuggaaacuauggagaugcagacuaagacuaaaaucauucacaucuauggacagcagguccgcaagucacagaucaaccagauucgccgcaacauuuuaugacauagaaacacucaaaguaauagacgaagaauggcaaagaacacaaugcaguccaagagaaacauguguagaaguagccucagaacuaggaaaaagcacuaacacauucuucaaaccaccaugcguaaauguauucagaugcggcggauguugcaacgaagaaucucucauauguaugaacacaaguacaucauacaucucaaaacaacuauucgaaauaucagucccauuaacaucaguaccagaacuaguaccaguaaaaguagcaaaccacacaggauguaaaugccuaccaacagcaccaagacacccauacaguaucauaagaagaucaauccaaauaccagaagaagaccgaugcucccacucaaaaaaauuaugcccaauagacaugcuaugggauucaaacaaaugcaaaugcguacuacaagaagaaaacccauuagcaggaacagaagaccacucucacuuacaagaaccagcauuaugcggaccacauaugauguucgacgaagauagaugugaauguguaugcaaaacuccaugcccaaaagaccuaauacaacacccaaaaaacugcucauguuucgaaugcaaagaaucucuagaaacaugcugccaaaaacacaaauuauuucacccagacacaugcucaugcgaagacagaugcccuuuccacaccagaccaugugccagcggaaaaacagcaugugcaaaacacuguagauuuccaaaagaaaaacgagcagcccaaggaccacacucaagaaaaaauccauaa

SEQ ID NO: 793 - RNA, 72 nt, Artificial Sequence
  derived and/or modified CDS sequence (opt7) from Homo sapiens__AAA59606.1__signal peptide-HLA-A2-SP
auggccgugauggcacccaggacccugguccuccuguugagcggcgcccuggcgcucacucagaccugggcc

SEQ ID NO: 794 - RNA, 69 nt, Artificial Sequence
  derived and/or modified CDS sequence (opt7) from Homo sapiens__AAA61213.1__signal peptide-HsPLAT
auggacgccaugaagaggggccugugcugugugcuccuguugugcggggcagucuucgugagccccucc

SEQ ID NO: 795 - RNA, 81 nt, Artificial Sequence
  derived and/or modified CDS sequence (opt7) from Homo sapiens__NP_000790.2__signal peptide-HsEPO
augggcgugcacgagugccccgccuggcuguggcuccuguugagccugcucucccugccauuggggcugccgguccucggu

SEQ ID NO: 796 - RNA, 54 nt, Artificial Sequence
  derived and/or modified CDS sequence (opt7) from Homo sapiens__NP_000468.1__signal peptide-HsALB
augaagugggugaccuucaucagccugcucuuucuguucuccagugccuacagc

SEQ ID NO: 797 - RNA, 18 nt, Artificial Sequence
  derived and/or modified CDS sequence (opt7) from Artificial____cleavage site-Furin
aggcggcgcaggaagcgg

SEQ ID NO: 798 - RNA, 630 nt, Artificial Sequence
  derived and/or modified CDS sequence (opt7) from Homo sapiens__NP_061986.1__HsFGF21
auggacagcgaugagaccggcuucgaacacuccgggcugugggugaguguccucgccggucuguugcugggcgcaugccaggcccaucccaucccagacagcuccccgcuccugcaauuugggggccaggugaggcagcgguacuuguauacugaugacgcgcagcaaaccgaggcccaccuggaaauucgcgaggaugguacgguagggggcgcagccgaccagagucccgaaagccuccugcagcugaaggcacucaaaccaggcgugauccagauucugggggucaagacuuccagguucuugugucaacggcccgauggugcccuguacggcagccuccauuuugacccagaggcgugcuccuuccgcgagcugcuguuggaagauggguauaacguguaccagagugaggcccacggccucccccugcaucugccagguaauaaaagcccgcacagggaccccgcaccacgggggcccgcccgcuuucucccacugcccggcuugccgcccgcccugccagaacccccaggcauccucgcaccccagccaccggaugugggguccagcgacccccugaguauggucgguccaucccagggcaggagccccuccuaugccaguuga

SEQ ID NO: 799 - RNA, 1410 nt, Artificial Sequence
  derived and/or modified CDS sequence (opt7) from Homo sapiens__NP_002412.1__HsMMP1
augcacagcuuucccccacugcuccuguugcuguucuggggcguggucucccauaguuucccggccacccucgagacucaggaacaagacguggaucugguacagaaguacuuggagaaauauuacaaccugaagaaugacgggaggcaaguggaaaaacggcgcaacagcggucccgucguggagaagcucaaacagaugcaggaauuuuucggccugaaggugaccgggaagccagaugcagagacgcugaaagucaugaagcagcccaggugcggcgugccagacguagcccaguuugugcucacugaggguaauccccggugggaacagacccaccugaccuaucgcaucgagaacuacacuccagauuugccgagggcggacgucgaucaugccauugaaaaagcauuccaacugugguccaaugugacgccccucaccuuuacuaaggugagugaggggcaggccgacaucaugauuagcuucguccggggcgaucaccgcgacaacuccccauuugauggccccggggguaaucuggcacaugccuuccagccaggccccgggaucggcggugacgcgcacuuugaugaggacgaaagguggaccaacaauuuccgggaguauaaccugcaccgcguggccgcacaugaauuggggcacagccucggccugucccauaguacugacauuggcgcccugauguacccgagcuauaccuucuccggggauguacagcucgcccaagacgauaucgacgguauccaggcaauuuacggcaggagccagaaucccgugcaaccaaucgggccccagaccccaaaagccugugauaguaagcugacguuugacgcgauuacuaccauccggggcgaggucauguucuuuaaagaucgcuucuacaugaggacuaaccccuuuuauccagaaguggaguugaauuucauuuccguguuuuggccgcagcugcccaacggucucgaggccgcauacgaguucgccgaccgggaugaaguccgcuuuuucaagggcaauaaguauugggcagugcaggggcaaaacguacugcacggcuacccaaaagacaucuauagcuccuuuggguuccccaggaccgugaagcacauugaugccgcccugagugaagagaacaccgguaaaacuuacuuuuucgucgcgaauaaguauuggcgguacgacgaauacaaacgcagcauggacccaggcuaucccaagaugaucgcacaugauuucccggggaucggccacaagguggacgccgucuuuaugaaagaugguuucuuuuacuucuuucauggcacgaggcaguauaaguucgacccaaaaaccaagcggauuuugacucuccagaaagccaacuccugguuuaauugcaggaagaacuga

SEQ ID NO: 800 - RNA, 1170 nt, Artificial Sequence
  derived and/or modified CDS sequence (opt7) from Homo sapiens__NP_002412.1__HsMMP1(1-19,100-469)
augcacagcuuucccccacugcuccuguugcuguucuggggcguggucucccauaguuucgugcucaccgaggggaacccgaggugggaacagacucaccugaccuaccggaucgagaauuauacgcccgacuugccacgcgccgauguagaccaugcaauugaaaaggccuuucaacuguggagcaacgugacuccccucaccuucaccaaagucuccgagggucaggcggauaucaugauuaguuuugugaggggcgaccaccgggauaauagcccauucgacgggcccggcgguaaccuggcccaugcauuucagccagggccgggcaucggcggggaugcccacuucgacgaagaugagcgcuggacuaauaacuuuagggaguacaaucugcaccggguggcagcccaugaacucggucacucccugggcuugagccauuccaccgacauuggggcgcugauguaucccaguuacacguucagcggcgauguccagcucgcccaagacgauaucgacgguauccaggcaauuuaugggcgcucccagaacccagugcagcccaucggcccacaaacucccaaggccugcgacagcaaacugaccuuugaugccauuacuaccaucaggggcgagguaauguucuucaaggaccgguuuuacaugcgcaccaauccguucuaucccgaaguggagcugaacuuuauuagugucuucuggccacaguugcccaaugggcucgaggcagccuacgaauuugcggauagggacgaggugcgguucuuuaaagguaacaaguacugggccgugcagggccagaauguccugcacggguauccaaaggauaucuacuccagcuucggcuuuccccgcacggugaaacacauugacgcagcccuguccgaagagaacacugguaagaccuauuucuuuguagcaaauaaauacuggagguaugaugaauacaagcggaguauggacccaggcuauccgaaaaugaucgcccaugauuuccccgggaucggccacaagguggacgccgucuuuaugaaagauggguucuucuacuuuuuccaugguacucgccaauacaaguuugacccaaagaccaaaaggauucucacccugcagaaggcgaacagcugguucaacugucggaaaaauuga

SEQ ID NO: 801 - RNA, 3357 nt, Artificial Sequence
  derived and/or modified CDS sequence (opt7) from Clostridium histolyticum__BAA77453.1__ColG
augaagaaaaacauccugaagauucucauggacagcuacuccaaagagaguaagauccagaccgugaggcgggucacuagcgugucccuguuggccguauaucugaccaugaauacgaguagccucgugcuggcaaaacccauugaaaacacuaaugauaccuccaucaagaacgucgagaaguugcgcaaugccccaaacgaagagaauagcaaaaagguggaagacuccaaaaacgauaagguggagcacgucaaaaauauugaggaagcgaagguggagcaaguagccccggaagugaaaaguaagagcacccugagguccgcaagcaucgccaacacuaauagugagaaguacgacuucgaguaucucaacggccuguccuacaccgaacugacgaaucucaucaaaaacauuaaguggaaucagaucaacgggcuguuuaacuauagcacugguucccagaaauucuuuggcgauaagaaucggguccaggcaauuaucaacgccuugcaagagagugggcgcaccuacacugcgaaugacaugaaaggcauugaaaccuucaccgaggugcugagggccgguuuuuaucucggguacuacaacgauggccugagcuaucugaaugaccggaacuuccaggauaagugcauccccgcaaugauugccauccagaagaauccaaacuuuaaauugggcacggccgugcaggacgaagucaucacuucccucgggaagcugauugguaaugcaagcgccaacgcggaggugguaaauaacugugugcccguccugaaacaauuccgcgagaaucucaaccaguacgccccagauuaugugaagggcaccgcagugaaugaacugaucaaagggauugaguuugacuucaguggcgccgcauacgaaaaggaugucaagacuaugcccugguaugguaaaaucgacccauuuauuaacgaguugaaggcccuggggcucuacggcaacaucaccuccgccaccgaaugggcgagcgacgugggcaucuauuaccugaguaaauucgggcuguacuccacuaauaggaacgauauuguacagagcuuggagaaggcaguggacauguauaaauacgguaagaucgccuucgucgccauggagcggauuacgugggauuaugacggcaucgggagcaauggcaagaaaguggaucaugacaaguuucucgaugacgcagaaaaacacuaccugccgaagaccuauacuuucgauaacgguaccuuuauuauccgcgccggcgacaaagucuccgaggaaaagaucaaaaggcuguacugggcgagucgggagguaaagagccaguuccaucgcgugguggggaaugauaaggcccucgaagugggcaacgcagacgacguccugaccaugaaaauuuuuaauucccccgaggaguauaaguucaacacuaauaucaacggggugagcacggauaaugguggcuuguacauugaaccaagggggaccuuuuacacuuaugagcggacuccccaacagaguaucuucucccuggaggaacucuuucgccacgaguacacccauuaucugcaggccagguaccuggucgacggcuuguggggucaaggcccauucuaugagaaaaaccggcucaccugguuugaugaagggacggcagaguucuuugccggcagcacccgcacuuccggggugcugcccaggaagaguauucugggcuaccucgccaaagacaagguggaucaccgguauagccugaagaaaaccuugaacuccgguuacgacgauagcgacuggauguucuacaauuauggguucgcaguagcccacuaccuguaugaaaaggauaugccgacuuuuaucaaaaugaauaaggcgauucucaacaccgacgugaaaaguuacgaugaaaucaucaagaagcuguccgacgaugccaacaaaaauacggaguaucagaaccauauucaggagcuggcagacaaguaccagggcgccgguauccccuuggucagcgacgauuaucugaaagaccacggcuacaagaaagccuccgaaguguacagugagauuagcaaggcagcgucccucaccaauacuagcgucaccgccgagaaaagucaauauuucaacacuuuuacccugagggggacguacaccggcgaaacuuccaagggggaguucaaggauugggacgaaaugagcaaaaagcucgauggcacccuggaguccuuggccaaaaauagcuggagugguuauaagacucugaccgcauacuuuacgaacuaucgcgugaccagcgacaauaaagugcaguacgauguagucuuccauggggugcucacugacaacgccgauaucuccaauaacaaggcaccaauugccaaggugaccggccccaguacuggcgcggucgggcggaauaucgaauuuagcgguaaagacuccaaggaugaggacggcaaaaucgugagcuacgacugggauuucggggacggcgccaccuccagggguaagaacagugugcacgcauauaaaaaggccgggacguacaauguaacccugaaggucacugaugacaaaggcgccaccgcaacugagagcuuuaccauugaaaucaagaacgaagauacuaccacgccaauuaccaaagagauggagcccaaugacgauaucaaggaagccaacggcccaauuguggagggggugacugucaaaggugaccugaacggcuccgaugacgcggauaccuucuauuuugacgugaaggaagauggggacguaacuaucgaguugccguacaguggcagcuccaauuucaccuggcugguguauaaagagggugacgaucagaaccacaucgccagcgggauugacaagaauaacaguaaggucggcacguucaaauccaccaagggccgccauuacguguuuaucuauaaacacgauagcgcauccaauauuagcuacagucucaacaucaaggggcuggguaaugaaaaacucaaggagaaggaaaacaaugacuccagcgauaaagccacugugauucccaacuucaauaccacuaugcagggcagucuguugggggacgauucccgggacuacuauagcuuugaggucaaggaagagggcgaggugaacaucgaacuggauaaaaaggacgaguucgguguaaccuggacgcugcauccagaauccaauauuaacgauaggaucaccuacgggcaaguggacggcaauaaagucagcaacaaggugaagcuccgccccggcaaauauuaccuguugguguauaaguacagugggagcgguaacuaugagcugcgggucaauaaauga

SEQ ID NO: 802 - RNA, 3081 nt, Artificial Sequence
  derived and/or modified CDS sequence (opt7) from Clostridium histolyticum__BAA77453.1__HsALB(1-18)_ColG(111-1118)
augaagugggugaccuucaucagccugcucuuucuguucuccagugccuacagcauugcaaacacuaauuccgagaaauaugacuuugaauacuugaacggccugaguuauaccgagcucacgaaucugaucaagaacauuaaauggaaucagaucaacggguuguucaauuacagcacugguucccaaaaguuuuucggcgauaaaaacaggguccaggccauuaucaaugcgcugcaggaaagcgggcggaccuauaccgccaacgacaugaagggcaucgagacuuuuaccgaagugcuccgcgcagguuucuaccugggguauuacaaugauggccuguccuaccucaacgacaggaauuuucaggauaagugcauucccgccaugaucgcaauucagaaaaacccaaauuucaagcugggcacggccguacaggacgaggugaucacuagcuuggggaaacugauugguaacgcgagcgccaacgcagaggucgugaauaacugugugccgguccucaagcaguuucgggaaaaucugaaccaguaugcccccgauuacgugaaaggcaccgccguaaaugagcugaucaaggggauugaguucgacuucuccggcgcagccuaugaaaaagaugugaagacuaugccaugguacgguaagaucgaccccuuuaucaacgaguugaaagcgcucgggcuguauggcaauauuaccagcgccaccgaaugggcaagugaugucggcaucuacuaucuguccaaguucgggcucuacagcacgaaccgcaaugacauugugcaaucccuggagaaagccguggauauguacaaguaugguaaaaucgcauuugucgccauggaaaggauuacuugggacuacgacggcaucgggaguaacggcaagaagguggaucacgacaaauucuuggaugacgccgagaagcauuaucugccaaaaaccuacacuuuugauaaugguaccuucaucauucgggcgggcgacaagguaagcgaagagaaaaucaagcgccucuauugggcauccagggaggugaagagucaguuucaccgggucguggggaacgauaaagcccuggaagugggcaaugccgacgauguccugaccaugaagauuuucaacagucccgaggaauacaaauuuaauacuaacaucaacgggguguccacggacaaugguggcuuguauauugagccacgcgggaccuucuacacuuacgaaaggaccccgcagcagagcaucuuuagucucgaggagcuguuccggcaugaauauacccacuaccugcaagcacgcuaucucguagauggccuguggggucagggccccuuuuacgagaagaacagguugacuugguucgacgaagggacggccgaguucuuugcgggcuccacccggacuagcggggugcugccacgcaaaagcauccucggcuaucuggccaaggacaaggucgaucauagguacucccugaaaaagaccuugaauagugguuaugacgauagcgacuggauguucuacaacuacggguuugcaguggcccacuaucucuacgaaaaagauaugcccaccuucauuaagaugaauaaagcaauccugaacacugacgucaaguccuaugaugagauuaucaaaaagcugagcgacgaugccaauaagaacacggaguaccagaaucacauucaagaacucgccgacaaauaucagggcgcagguaucccacuggugagugaugacuacuugaaggaucauggcuauaaaaaggccuccgagguguacagcgaaauuuccaaagcggccagucugaccaacacuagcguaaccgcagagaagucccaguacuuuaauacuuucacccuccgggggacguauaccggcgagacuagcaagggggaauuuaaagacugggacgagaugaguaagaaacuggauggcacccuggaauccuuggccaagaacagcugguccgguuacaaaacucugaccgccuauuucacgaauuaccgcgugaccagugacaacaagguccaguaugauguggucuuucacggggugcucacugacaaugcagauaucagcaacaacaaggcgcccaucgccaaagugaccggcccguccacuggcgcaguagggaggaauauugaguucagcgguaaggacaguaaagaugaagacggcaagaucguguccuacgauugggacuuuggggauggcgccaccagccgggguaaaaacuccguccaugccuacaagaaagcagggacguauaaugugacccugaaggucacugacgacaagggcgccaccgcgacugagagcuucaccauugagaucaaaaacgaagauacgaccacucccauuaccaaggagauggaaccaaaugacgauaucaaagaggccaacggccccaucguggaaggggugacuguaaagggugaccucaauggcagugaugacgcagauaccuucuacuuugacgucaaagaggauggggacgugacuauugagcugccauauagcggcuccaguaacuucaccugguugguguacaaggaaggugaugaccaaaaucacaucgccagcgggauugauaagaacaauuccaaagucggcacguuuaagagcaccaaaggcaggcacuauguguucaucuacaagcaugacuccgccaguaacauuagcuauucccugaauaucaaagggcucgguaacgagaagcugaaggaaaaagagaauaacgacaguagcgauaaggcaacugugauccccaacuuuaauaccacuaugcagggcucccuguugggggacgauagccgcgacuacuacaguuucgaaguaaaagaggagggcgaagucaacauugagcuggauaagaaagacgaauuuggugugaccuggacgcuccacccagaguccaauaucaacgaucggauuaccuaugggcaaguggacggcaauaaggucagcaacaaagugaagcugaggccgggcaaguacuaucuccugguauacaaauauuccgggagcgguaauuacgaguugcgcgugaacaaguga

SEQ ID NO: 803 - RNA, 3429 nt, Artificial Sequence
  derived and/or modified CDS sequence (opt7) from Clostridium histolyticum__BAA77453.1__HsALB(1-18)_ColG(1-110)_CS-F_ColG(111-1 118)
augaagugggugaccuucaucagccugcucuuucuguucuccagugccuacagcaugaaaaagaacauuuugaaaauccugauggacuccuauaguaaggagagcaaaauucagacugucaggcgggugaccuccguaagccuccuggcaguguacuugacgaugaauacuuccagucugguccucgccaagcccaucgaaaacaccaaugauaccagcauuaagaacguggagaaacugcgcaaugcgccaaacgaagaaaauuccaagaaaguggaagacagcaagaacgauaaagucgagcacgugaagaauaucgaggaagccaaaguagagcaaguggcaccggaagucaagaguaaguccacucugaggagcgccucccggcgcaggcggaaacgcaucgcaaacaccaauagugagaaguaugacuuugaguaccucaacggccugagcuauacggaauugacuaaucugauuaaaaacaucaaguggaaucagauuaacggucucuucaacuacuccaccgggagccagaaauuuuucggcgauaagaauagggugcaggccaucauuaacgcgcugcaagagagugggcggacuuauaccgccaaugacaugaagggcaucgaaaccuuuacggaggugcugcgcgcagguuucuacuugggguacuauaacgauggccucuccuaccugaaugacaggaacuuucaggauaaaugcauucccgccaugaucgccauccagaagaauccaaacuucaaacugggcacugcaguccaggacgaagugauuaccagccucgggaagcugaucgguaaugccagugcgaacgccgagguagugaauaacuguguccccguguugaaacaauuucgggagaaucugaaccaguaugcaccagauuacgugaagggcacugccgucaaugaacucauuaaggggaucgaguucgacuucuccggcgcagccuaugaaaaagaugugaagaccaugcccugguacgguaaaauugacccauuuaucaacgagcugaaggcccugggguuguauggcaacaucaccagcgcgacugaaugggcaagcgacguaggcauuuacuaccucuccaaauucgggcuguauaguacgaaucgcaacgauaucgugcagagccuggagaaggccgucgacauguacaaguaugguaaaauugccuuuguggcaauggagaggaucaccugggauuacgacggcauuggguccaauggcaagaaagucgaucaugacaaguuccucgaugacgccgaaaaacacuaucugccgaagacuuacaccuuugauaacgguaccuucaucauccgggcgggcgacaaagugagcgaggaaaagauuaagcgcuuguauugggccaguagggaggugaaaucccaguuucaucggguaguggggaaugauaaggcacuggaagucggcaacgccgacgacgugcucacuaugaaaaucuucaauagccccgaggaguacaaguuuaacacgaauauuaacggggucuccaccgauaaugguggccuguacaucgaaccacgcgggacuuucuauaccuacgagaggacuccccaacagaguauuuuuagccuggaagaguuguuccggcacgaguauacccauuaccuccaggcaagguaucugguggacggccuguggggucaaggcccauuuuacgagaaaaaccgccucacgugguucgaugaggggaccgccgaguucuuugccggcuccacucggaccagcggggugcugcccaggaagaguaucuugggcuaucuggcaaaggacaaaguagaucaccgcuacucccucaagaaaacucugaauagcgguuacgacgauuccgacuggauguucuauaacuacggguuugccguggcgcacuaucuguacgaaaaggauaugccgaccuucauuaaaaugaauaaggccaucuugaacacggacgucaagaguuaugaugaaaucauuaaaaagcugagcgacgaugcaaacaaaaauaccgaguaccagaaccauauccaggagcucgccgacaaguaucagggcgccgguauuccccugguguccgacgauuaccucaaagaccacggcuacaagaaagcaagcgaagucuauagugagaucuccaaggcggccagccugacuaauaccuccgugacugcagaaaagagccaauacuuuaacaccuucacguugcgggggaccuauacuggcgagaccaguaaaggggaauuuaaggauugggacgagaugagcaaaaagcuggauggcacucucgagucccuggccaaaaauaguuggagcgguuacaagacccugacggccuauuucaccaacuacagggugacuuccgacaauaagguacaguacgaugucguguuucaugggguguugaccgacaacgcagauauuagcaauaacaaagccccaaucgcgaaggucacuggccccuccaccggcgccguggggcgcaauaucgaguucagugguaaagacagcaaggaugaagacggcaaaauuguguccuaugacugggauuuuggggacggcgcaacgagucgggguaagaacagcguacacgccuacaagaaagccgggaccuauaaugucacucugaaggugaccgaugacaaaggcgcaacugccaccgaauccuucacuaucgagauuaagaacgaagauaccacgaccccaaucacuaaagagauggagcccaaugacgauauuaaggaagcgaacggcccaaucguggagggggucaccgugaaaggugaccucaacggcagcgaugacgccgauacuuucuacuuugacguaaaggaagauggggacgugaccaucgagcugccguauaguggcuccagcaauuucacguggcucgucuacaaggagggugacgaucagaaccacauugcauccgggaucgacaaaaauaacagcaaggugggcaccuuuaaaaguacuaagggcaggcauuauguguucauuuacaaacacgauuccgccagcaauaucaguuacucccugaacauuaagggguuggguaaugaaaagcugaaagagaaggaaaacaaugacagcuccgauaaagcaaccgucauccccaacuuuaauacuaccaugcagggcagccugcucggggacgauagucgggacuauuacagcuucgaggugaaggaagagggcgagguaaacauugaacuggauaaaaaggacgaguuuggugugacguggaccuugcauccagaauccaauaucaacgaucgcaucacuuaugggcaagucgacggcaauaaggugaguaacaaagugaagcugaggcccggcaaauacuaucuccuggucuacaaguauagcggguccgguaacuacgagcuccgggugaauaaauga

SEQ ID NO: 804 - RNA, 3105 nt, Artificial Sequence
  derived and/or modified CDS sequence (opt7) from Clostridium histolyticum__BAA34542.1__ColH
augaacuuccugaagaucauucucaauaggggcaaaaccaugaagcggaaaugccugagcaagcgcuugaugcuggccaucacuauggcaaccauuuuuacggugaacuccacucuccccaucuacgccgcggucgacaaaaauaacgccaccgcagccgugcagaaugagaguaagagguauaccguaagcuaccugaagacuuugaacuauuacgaucugguggaccuccuggucaaaaccgaaauugagaaucugccagaucucuuccaauauuccagugacgcaaaggaauuuuacgggaacaaaacgcggaugagcuucaucauggaugagaucggucgcagggccccgcaguauacugaaauugaccacaagggcauccccacccugguggaggugguccgggcgggguuuuacuugggcuuccauaauaaagagcugaacgaaauuaauaagcgcuccuuuaaagagagggugaucccaagcauucucgccauccagaagaaccccaauuucaagcuggguacugaaguacaggauaaaauuguguccgcaaccgggcuguuggccggcaacgagaccgccccacccgaggucgugaauaacuuuacgccaauccuccaagacuguaucaagaacauugaucgguacgcacuggacgaucugaaaaguaaggcccucuucaaugugcuggcggccccgacuuaugacaucaccgaauacuugcgcgcaacuaaagagaagcccgaaaacaccccaugguauggcaagauugauggguuuaucaaugagcugaaaaagcucgcccuguacgguaaaauuaacgacaauaacagcuggaucaucgacaauggcauuuaucacaucgcaccccuggggaaguugcauuccaacaauaaaauuggcaucgaaacccucacugaggucaugaagguguacccauaucugagcaugcagcaucugcagagugccgaucagauuaagaggcacuacgacuccaaagaugccgaggguaacaagaucccccucgacaaauucaagaaagaagggaaggagaaguacugcccgaaaacguauaccuucgaugacggcaagguaaucauuaaagcgggcgcacggguggaagaggaaaaggucaaacgccuguacugggccagcaaggaggugaauagucaauuuuucaggguguaugggaucgauaaacccuuggaggaagguaacccagacgauauucugacuauggucaucuacaauagucccgaggaauauaagcucaacagcgugcuguacggcuaugacaccaauaacgggggcauguacauugagccagaagguaccuuuuucacuuacgagcgggaggcccaggaauccacguauacccuggaggaauuguuucgccacgaguacacucacuaucuccagggcagguacgcaguacccgggcaguggggccggaccaagcuguaugauaacgaccgccugaccugguacgaggaagggggugccgaacucuucgcgggcagcacuaggacgagugggauccugccacggaaauccauugugagcaauauccauaacaccacuaggaauaaccgcuauaaguugagugacaccguccacuccaaauacggcgccagcuuugaguucuacaauuaugcauguauguuuauggauuacauguauaacaaggacauggguauccugaauaaacucaacgaucuggccaagaauaacgacguggauggcuacgacaauuauauucgggaucugagcuccaacuacgcauugaaugacaaguaucaagaucauaugcaggagaggaucgacaacuacgaaaaucugacugucccguucguggccgaugacuaccucgugcgccacgccuauaaaaaccccaacgagauuuacagugagaucagcgaaguagcaaagcugaaagaugccaaguccgaggugaaaaagagccaguauuuuaguaccuucacgcuccggggguccuacaccggcggggcgagcaagggcaaacuggaagaccaaaaggccaugaauaaauuuauugacgauuccuugaagaaacuggacacuuauaguuggagcgguuacaagacccucacugcauacuucaccaacuauaaagucgauuccagcaauagggugacguacgacgucguguuccacggguaucugccaaacgagggcgauaguaaaaauucccugcccuacgguaagaucaacggcaccuauaaggggacugaaaaggagaaaaucaaguuuagcuccgagggcaguuucgacccagaugggaaaauugugagcuacgaaugggacuuuggcgaugguaauaaguccaacgaggaaaaucccgagcauagcuaugacaagguagggaccuacacugugaaauugaaggucaccgaugacaaaggcgaaaguuccgugagcacgaccacugccgagaucaaggaccuguccgagaacaaacucccggucauuuacaugcacgugccaaagagcggcgcccugaaucagaaggugguauucuaugggaaagguaccuacgaucccgacggcaguaucgcaggguaucagugggauuuuggcgacgguagcgauuucuccagugaacagaaccccagccaugucuacacuaagaaaggggaguauaccgugacgcuccgcgugauggacuccagcggccaaauguccgaaaagaccaugaaaauuaagaucacugauccagucuaccccaucggcaccgagaaagagccaaauaacaguaaggaaacugcgagcgggccgauugugcccgguaucccaguguccggcaccauugagaauacuuccgaccaggauuauuuuuacuucgacguaaucacccccggggaagucaagauugauaucaacaaacugggcuacgguggggccacgugggugguguaugacgagaacaauaacgcagucagcuacgccaccgaugacggccagaauuuguccggcaaguuuaaagccgacaagccagggcgguauuacauucaccuguauauguucaacgguagcuacaugcccuauaggaucaauaucgaaggcaguguggggcgguga

SEQ ID NO: 805 - RNA, 3066 nt, Artificial Sequence
  derived and/or modified CDS sequence (opt7) from Clostridium histolyticum__BAA34542.1__ColH
augaagaggaaaugccugagcaagcggcucaugcuggccaucaccauggcaacuauuuucaccgugaacuccacguugcccaucuacgccgcggucgacaaaaauaacgccacugcagccgugcagaaugagaguaagcgcuauaccguaagcuaccugaaaacccucaacuauuacgaucugguggacuugcuggucaagacugaaauugagaaucucccagaucuguuucaauauuccagugacgcaaaggaguucuacggcaacaaaaccaggaugagcuuuaucauggaugaaauugggcggcgcgccccgcaguauacggaaaucgaccacaaggguauccccacucugguggagguggucagggcgggcuucuaccucggguuucauaauaaagagcugaacgaaauuaauaagcgguccuucaaagagcgcgugaucccaagcauuuuggccauccagaagaaccccaauuuuaaacugggcaccgaaguacaggauaagauuguguccgcaacuggucuccuggccgggaacgagaccgccccacccgaggucgugaauaacuucaccccaauccugcaagacuguauuaagaauaucgauagguacgcauuggacgaucucaaaaguaaggcccuguuuaacgugcuggcggccccgacguaugacaucacugaauaccuccgggcaaccaaagagaagcccgaaaacacuccaugguauggcaaaauugauggcuucaucaaugagcugaagaaguuggcccuguacgggaaaauuaacgacaauaacagcuggaucauugacaaugguaucuaucacaucgcaccccucggcaagcugcauuccaacaauaaaauugggaucgaaacccugaccgaggucaugaagguguacccauauuugagcaugcagcaccuccagagugccgaucagauuaaacgccauuacgacuccaaggaugccgagggcaacaagaucccccuggacaaauuuaagaaagaagguaaggagaaauacugcccgaagacuuauacguucgaugacgggaagguaauuaucaaagcgggcgcaaggguggaagaggaaaaggucaaacggcuguacugggccagcaaggaggugaauagucaauucuuucgcguguauggcaucgauaaaccccucgaggaagggaacccagacgauauucugaccauggucaucuacaauagucccgaggaauauaaguugaacagcgugcuguacgguuaugacacuaauaacggcgggauguacauugagccagaaggcaccuucuuuaccuacgagagggaggcccaggaauccacuuauacgcucgaggaacuguuccggcacgaguacacccacuaucugcagggucgcuacgcaguacccggccagugggggaggacuaaauuguaugauaaugaccggcucaccugguacgaggaaggcggggccgagcuguuugcggguagcacccgcacuuccggcauccugccaaggaaguccauugugagcaacauccauaacacgacccggaauaacagguauaagcucagugacacuguccacuccaaauacggggccagcuucgaauuuuacaauuaugcauguauguucauggauuacauguauaacaaggacaugggcauucugaauaaauugaacgaucuggccaagaauaacgacguggaugguuacgacaauuauauccgcgaucucagcuccaacuacgcacugaaugacaaauaucaagaucauaugcaggagcggaucgacaacuacgaaaaucugaccgucccguuuguggccgaugacuacuuggugaggcacgccuauaagaaccccaaugagauuuacagugagaucagcgaaguagcaaagcugaaagaugccaaguccgaggugaaaaagagccaguauuucaguacuuuuacccuccgcggcuccuacacgggcggcgcgagcaaagggaagcuggaagaccaaaaggccaugaacaaauucauugacgauucccucaagaaacuggacaccuauaguuggagcggcuacaagacuuugaccgcauacuuuacuaacuauaaagucgauuccagcaaucgggugaccuacgacgucguguuccacgguuaucugccaaacgagggggauaguaaaaauucccuccccuacggcaagaucaacgguacguauaagggcaccgaaaaggagaaaauuaaguucagcuccgaggggaguuuugacccagauggcaaaaucgugagcuacgaaugggacuucggggauggcaauaaguccaacgaggaaaaucccgagcauagcuaugacaaaguagguacuuacaccgugaagcugaaggucacugaugacaaaggggaaaguuccgugagcaccacgaccgccgagaucaaggaccuguccgagaacaaauugccggucauuuacaugcacgugccaaagagcggcgcccugaaucagaaagugguauuuuauggcaaggggacuuacgaucccgacgguaguaucgcaggcuaucagugggauuucggggacggcagcgauuuuuccagugaacagaaccccagccaugucuacaccaagaaaggugaguauacugugacccucagggugauggacuccagcgggcaaauguccgaaaagacgaugaaaauuaagaucaccgauccagucuaccccauuggcacugagaaagagccaaauaacaguaaggaaaccgcgagcggcccgaucgugcccgggaucccaguguccgguacuauugagaauaccagugaccaggauuauuucuacuuugacguaaucacucccggcgaagucaaaauugauaucaacaagcugggguacggcggugccaccugggugguguaugacgagaauaacaacgcagucagcuacgccacggaugacgggcagaaucucuccggcaaguucaaagccgacaagccaggccgcuauuacauucaccuguauauguuuaacgggagcuacaugcccuaucggaucaauauugaagguaguguggggagguga

SEQ ID NO: 806 - RNA, 3000 nt, Artificial Sequence
  derived and/or modified CDS sequence (opt7) from Clostridium histolyticum__BAA34542.1__HsALB(1-18)_ColH(41-1021)
augaagugggugaccuucaucagccugcucuuucuguucuccagugccuacagcguccagaacgaguccaaaagguauacugugaguuacuugaagacccugaauuauuacgaccucguagaucuguuggugaaaacggaaauugagaaccugcccgaccucuuucaauauagcuccgaugcaaaggaguucuacggcaauaaaacucggaugagcuuuaucauggacgaaauugggcgcagggccccacaguauaccgaaaucgaucacaaggguauuccgacccuggucgagguggugcgggcgggcuucuaccugggguuucauaacaaggagcucaaugaaaucaacaaacgcuccuucaaggagagggucauccccaguauucuggccauccagaaaaauccaaacuuuaaguugggcacugaagugcaggacaaaauuguaagcgcaaccggucugcucgccgggaaugagacggcacccccagagguggucaacaauuucacucccauccugcaagauugcauuaagaacaucgaccgguacgcccuggaugacuugaaauccaaggcgcucuuuaaugugcuggccgcaccaaccuaugauauuacugaauaccugcgcgccaccaaggagaaaccggaaaacacccccugguauggcaagaucgacggcuucaucaaugagcucaaaaagcuggccuuguacgggaaaauuaacgauaacaauagcuggaucauugacaacgguaucuaucacauugcaccacugggcaagcuccauaguaauaacaagaucgggaucgaaacgcugacugaggugaugaaagucuaccccuaucuguccaugcagcacuugcagagcgccgaccagauuaagaggcauuacgauuccaaagacgcggagggcaauaagaucccacucgauaaauucaagaaggaagguaaagagaaguacugucccaaaaccuauacuuuugacgaugggaaggugauuaucaaagccggcgcacggguagaagaggaaaaggugaagcgccuguacugggccaguaaagaggucaacagccaauucuuuaggguguauggcauugacaagccgcuggaggaagggaaucccgaugacauccucaccauggugaucuacaacuccccagaggaauauaaacugaauagcgucuuguacgguuaugauaccaacaauggcgggauguacauugagcccgaaggcacuuucuuuacguacgagcgggaggcacaggaaaguaccuauacucuggaggaacucuuccgccacgaguacacccacuaucugcaggguagguacgccgugccaggccagugggggcggaccaagcuguaugacaacgaucgcuugacuugguacgaggaaggcggggccgagcucuuugcggguuccacgaggaccagcggcauccugccccggaaaaguauuguauccaauauccauaacacuacccgcaauaacagguauaagcugagcgacaccgugcacagcaaauacggggcauccuucgaauuuuacaacuaugccugcauguucauggacuacauguauaauaaggauaugggcauucucaacaagcugaaugacuuggccaaaaacaaugaugucgacgguuacgauaacuauauccgggaccugaguagcaauuacgcacucaacgauaaguaucaagaccauaugcaggagaggauugauaauuacgaaaaccugacugugccauuugucgccgacgauuaccuggugcgccacgcguauaaaaauccgaacgagaucuacuccgagaucagcgaaguggccaaguugaaagacgcaaagagugagguaaagaaaucccaguauuucagcacguuuacccugcggggcuccuacacugggggcgccaguaaggggaaacucgaagaucaaaaggcaaugaauaaauucauugacgacagccugaagaagcucgauaccuauuccuggagcggcuacaaaacucugaccgccuacuucacgaacuauaagguggacaguuccaauagggucaccuacgauguggucuuucacgguuauuugcccaacgagggggacagcaaaaacucccugccauacggcaagaucaaugguacuuauaaaggcaccgaaaaggagaaaauuaaguucaguagcgagggguccuuugaucccgacggcaagaucgugagcuacgaaugggauuucggggacggcaacaaaaguaaugaggaaaacccagagcauuccuaugauaagguggguacuuacaccguaaaacucaaggugacggacgauaaaggggaaagcuccgucagcaccacuaccgccgagauuaaggaccugagugagaauaagcugcccgugaucuacaugcacgucccgaaaagcggcgcauugaaccagaaggugguguuuuauggcaaagggacuuacgacccagaugguuccaucgccggcuaucagugggacuucggggauggcagugacuuuagcuccgaacagaaucccagccauguauacaccaagaaaggugaguauacggucacccugcgcgugauggauuccagugggcaaaugagcgaaaagacuaugaagauuaaaaucaccgaccccguguacccaauuggcacugagaaggagcccaacaauuccaaagaaaccgcgaguggcccaaucgucccggggauucccgugagcgguacgaucgagaacaccuccgaucaggacuauuucuacuuugaugugaucacuccaggcgaaguaaagauugacaucaauaaacucggguacggcggugccaccugggucguguaugaugagaacaauaacgcagugagcuacgccacugacgaugggcagaaucugaguggcaaguucaaagccgacaagcccggccgguauuacauucaccucuauauguuuaacggguccuacaugccauauaggaucaacauugaagguagcgucggccgcuga

SEQ ID NO: 807 - RNA, 3138 nt, Artificial Sequence
  derived and/or modified CDS sequence (opt7) from Clostridium histolyticum__BAA34542.1__HsALB(1-18)_ColH(1-40)_CS-F_ColH(41-102 1)
augaagugggugaccuucaucagccugcucuuucuguucuccagugccuacagcaugaaaaggaagugcuuguccaaacggcugaugcucgcaauuacuauggccaccaucuuuacggucaacaguacucugcccauuuaugcggccguggacaagaauaacgcaaccgccgcacgcaggcggcgcaaaaggguacagaaugagagcaagcgguacaccguguccuauuugaagacucugaacuacuaugaucucgucgaccugcuggugaaaaccgaaaucgagaaucucccagaucuguuccaauacagcuccgacgccaaggaauuuuauggcaacaaaacgcgcaugaguuucauuauggaugagaucgggaggcgggcgccgcaguacacugaaaucgaccacaaggguauucccaccuugguggaggucgugcgcgccggcuuuuaccugggguuccauaauaaagagcucaacgaaaucaauaagaggagcuuuaaagagcggguaauuccauccauccuggcaauucagaagaaccccaauuucaagcugggcacugaagugcaggauaaaaucgucagcgccaccgguuugcucgccgggaacgagaccgcaccacccgagguggugaauaacuuuacgccaauucugcaagacuguaucaagaauaucgaucgcuaugcccuggacgaucucaaaaguaaggcgcuguucaacgucuuggccgcaccgacuuacgacauuaccgaauaucugagggccacuaaagagaagcccgaaaacaccccaugguacggcaagaucgauggcuucauuaaugagcucaaaaagcuggcacuguaugggaaaaucaacgacaauaacuccuggauuaucgacaaugguaucuaccacauugcccccuugggcaagcuccauagcaacaauaaaaucgggauugaaacccugacugaggugaugaagguauauccauaccuguccaugcagcaccuccagagugccgaucagaucaagcggcauuacgacagcaaagaugcggagggcaacaagauuccccuggacaaauuuaagaaagaagguaaggagaaguauugcccgaaaacguacaccuucgaugacgggaaggugaucaucaaagcaggcgcccgcgucgaagaggaaaaggugaaaagguuguauugggccuccaaggaggugaauagccaauuuuuccgggucuacggcauugauaaaccccuggaggaagggaacccagacgauauccucacuauggugauuuauaauagucccgaggaauacaagcugaacuccguacuguaugguuacgacaccaauaacggcgggauguacaucgagccagaaggcaccuuuuucacuuaugagcgcgaggcacaggaaagcacguacaccuuggaggaacucuuuaggcacgaguauacucacuaccugcagggucgguaugccgugcccggccagugggggaggaccaagcuguacgauaaugaccgccucaccugguaugaggaaggcggggcggagcuguucgccgguaguacucggacguccggcauuuugccaaggaaaagcaucgucagcaacauucauaacaccacucgcaauaaccgguacaagcuguccgacaccgugcacaguaaauacggggcgagcuuugaguucuauaauuacgccuguauguuuauggauuauauguacaacaaggacaugggcauccucaauaaacugaacgaucuggcaaagaauaacgacgucgaugguuaugacaauuacaucagggauuuguccagcaacuaugcccugaaugacaaguaccaagaucauaugcaggaacgcauugacaacuacgaaaaucucacugugccguucguggccgaugacuaucugguacggcacgcauacaaaaaccccaaugagaucuauagugagauuuccgaaguggccaagcucaaagaugcaaagagcgaggucaaaaagucccaguacuuuaguaccuucacgcugaggggcagcuauaccgggggcgccuccaaggggaaauuggaagaccaaaaggcaaugaacaaauucaucgacgauagccugaagaaacucgacacuuacaguugguccggcuacaagacccugacugccuauuuuaccaacuacaaaguggauagcuccaaucgggucacguaugacgugguguuccacgguuaccugccaaacgagggggauaguaagaauagcuugcccuauggcaagauuaacgguaccuacaaaggcacugaaaaggagaaaaucaaguuuuccagcgaggggaguuucgacccagauggcaaaaucguauccuaugaaugggacuuuggggauggcaauaagagcaacgaggaaaaucccgagcauuccuacgacaagguggguaccuacacugucaaacugaaggugaccgaugacaaaggggaaagcagugucagcacgaccacugccgagauuaaggaccucuccgagaacaaacugccggugaucuauaugcacgugccaaagaguggcgcacucaaucagaagguagucuucuacggcaaagggaccuaugaucccgacgguagcauugcgggcuaccagugggauuuuggggacggcuccgauuucagcuccgaacagaaccccagucauguguauacuaagaaaggugaguacaccgugacgcugcgcgucauggacagcuccgggcaaaugagugaaaagaccaugaaaaucaagauuacugauccaguguaucccaucggcaccgagaaagagccaaauaacagcaaggaaacugccuccggcccgaucgugcccgggauuccaguaagcgguaccaucgagaauaccagugaccaggauuacuuuuacuucgacgucauuacucccggcgaagugaagaucgauauuaacaaauugggguauggcggugcaacguggguggucuacgacgagaauaacaacgccguguccuaugccaccgaugacgggcagaaucugagcggcaaguuuaaagcagacaagccaggcagguacuauauccaccuguacauguucaacggguccuauaugcccuaccggauuaauaucgaagguagcguaggccgcuga

SEQ ID NO: 808 - RNA, 576 nt, Artificial Sequence
  derived and/or modified CDS sequence (opt7) from Homo sapiens__NP_001133.1__HsAMELX
augggcaccuggauccuguucgccugccuccugggggcagccuuugcgaugcccuugccaccgcaccccggucauccaggcuacauuaacuucagcuaugaggugcugacuccccucaagugguaccaguccaucaggccacccuauccaaguuacggguaugaaccgaugggcgguuggcugcaccaucaaauuauccccgucuugagccagcagcacccacccacccauacgcugcagccacaccaccauauucccgugguaccggcccaacagcccgugaucccacagcagcccaugaugccaguccccgggcaacacuccaugacuccaauccagcaucaccagccgaaucugcccccacccgcacagcaaccauaccagccccagccggugcaaccacagccccaccagcccaugcagccacaacccccagugcauccgaugcagccccucccaccccagccaccccugccgccaauguuucccaugcagccacugcccccgaugcuccccgacuugacccuggaggccuggccaaguaccgauaaaacuaagcgggaagaggucgacuga

SEQ ID NO: 809 - RNA, 135 nt, Artificial Sequence
  derived and/or modified CDS sequence (opt7) from Homo sapiens__NP_001133.1__HsAMELX-TRAP
augccccugccaccgcaccccggccauccaggguacaucaacuucagcuaugaggugcucaccccacugaagugguaccaguccauuaggccacccuaucccaguuacgguuaugaaccgaugggcgggugguga

SEQ ID NO: 810 - RNA, 168 nt, Artificial Sequence
  derived and/or modified CDS sequence (opt7) from Homo sapiens__NP_001133.1__HsAMELX-LRAP
augccccugccaccgcaccccggccauccaggguacaucaacuucagcuaugaggugcucacuccccugaagugguaccaguccauuaggccacccccaauguugccggaccugacccucgaagccuggcccaguaccgauaaaacgaagcgggaggaagucgacuga

SEQ ID NO: 811 - RNA, 207 nt, Artificial Sequence
  derived and/or modified CDS sequence (opt7) from Homo sapiens__NP_001133.1__HLA-A2-SP_HsAMELX(17-60)
auggccgugauggcacccaggacccugguccuccuguugagcggcgcccuggcgcucacucagaccugggccaugccacugccgccccacccagggcaucccgguuacaucaacuucuccuaugagguguugacgccacugaagugguaccaaaguauucggcccccauauccgagcuacggcuaugaacccaugggcgggugguga

SEQ ID NO: 812 - RNA, 240 nt, Artificial Sequence
  derived and/or modified CDS sequence (opt7) from Homo sapiens__NP_001133.1__HLA-A2-SP_HsAMELX(17-47,168-191)
auggccgugauggcacccaggacccugguccuccuguugagcggcgcccuggcgcucacucagaccugggccaugccacugccgccccacccagggcaucccgguuacaucaacuucuccuaugagguguugacgccacugaagugguaccaaaguauucggcccccaccgaugcuccccgaccugacucuggaagcauggccaagcaccgauaaaaccaagcgcgaggaaguagacuga

SEQ ID NO: 813 - RNA, 579 nt, Artificial Sequence
  derived and/or modified CDS sequence (opt7) from Homo sapiens__NP_001134.1__HsAMELY
augggcaccuggauccuguucgccugccucgugggggcagccuuugcgaugccccugccaccgcaccccggucauccaggcuacauuaacuucagcuaugaggucuugacuccccugaagugguaccaguccaugaucaggccacccuauaguagcuacggguaugaaccaaugggcgguuggcuccaccaucaaauuaucccggugguaucccagcagcacccccugacccauacguugcagagucaccaccauauuccagugguccccgcccaacagccacgggugcgccagcaggcacugaugcccgugccggggcaacagagcaugacucccacccagcaccaucagccaaaucucccccugccagcccaacagcccuuucagccacaaccgguccagccccagccacaccagcccaugcaaccacagcccccggugcagccaaugcagccccugcucccccaaccaccccugccaccgauguuccccuugaggccacugcccccaauccuccccgaccugcaccuggaggcauggccggccaccgauaaaacuaagcaggaagagguagacuga

SEQ ID NO: 814 - RNA, 138 nt, Artificial Sequence
  derived and/or modified CDS sequence (opt7) from Homo sapiens__NP_001134.1__HsAMELY-TRAP
augccccugccaccgcaccccggccauccaggguacaucaacuucagcuaugaggugcucaccccacugaagugguaccaguccaugauuaggccacccuauaguagcuacgguuaugaacccaugggcgggugguga

SEQ ID NO: 815 - RNA, 171 nt, Artificial Sequence
  derived and/or modified CDS sequence (opt7) from Homo sapiens__NP_001134.1__HsAMELY-LRAP
augccccugccaccgcaccccggccauccaggguacaucaacuucagcuaugaggugcucacuccccugaagugguaccaguccaugauuaggccacccccaaucuugccggaccugcaccucgaagccuggcccgcaaccgauaaaaccaagcaagaggaagucgacuga

SEQ ID NO: 816 - RNA, 210 nt, Artificial Sequence
  derived and/or modified CDS sequence (opt7) from Homo sapiens__NP_001134.1__HLA-A2-SP_HsAMELY(17-61)
auggccgugauggcacccaggacccugguccuccuguugagcggcgcccuggcgcucacucagaccugggccaugccacugccgccccacccagggcaucccgguuacaucaacuucuccuaugagguguugacgccacugaagugguaccaaaguaugauucggcccccauauagcuccuacggcuaugaaccgaugggcgggugguga

SEQ ID NO: 817 - RNA, 243 nt, Artificial Sequence
  derived and/or modified CDS sequence (opt7) from Homo sapiens__NP_001134.1__HLA-A2-SP_HsAMELY(17-48,169-192)
auggccgugauggcacccaggacccugguccuccuguugagcggcgcccuggcgcucacucagaccugggccaugccacugccgccccacccagggcaucccgguuacaucaacuucuccuaugagguguugacgccacugaagugguaccaaaguaugauucggcccccaccgauccuccccgaccugcaccuggaagcauggccagccacugauaaaaccaagcaggaggaaguagacuga

SEQ ID NO: 818 - RNA, 570 nt, Artificial Sequence
  derived and/or modified CDS sequence (opt7) from Sus scrofa__NP_999071.1__SsAMELX-001-1
augggcaccuggauccuguucgccugccuccugggggcagccuuuagcaugcccuugccaccgcaccccggucauccaggcuacauuaacuucuccuaugaggugcugacuccccucaagugguaccagaauaugaucaggcacccauauaccaguuacggguaugaacccaugggcgguuggcugcaucaccaaauuaucccagucgugagccagcagacgccgcagucccaugcguugcaaccccaccaccauauuccaaugguacccgcccagcagccagggaucccccagcaaccgaugaugccccugccaggccagcacaguaugacucccacccagcaucaccagccaaaccucccccugccagcacaacagccguuucagccccaaccagugcagccccagccacaccagccccugcaaccgcagagcccaaugcaucccauccagccccuccugccacagcccccauugccgcccauguucuccaugcaaagccugcucccagaccugccccuggaggccuggccagcaaccgauaaaacuaagcgggaagaggucgacuga

SEQ ID NO: 819 - RNA, 138 nt, Artificial Sequence
  derived and/or modified CDS sequence (opt7) from Sus scrofa__NP_999071.1__SsAMELX-TRAP
augccccugccaccgcaccccggccauccaggguacaucaacuucagcuaugaggugcucacuccccugaagugguaccagaauaugauuaggcacccauauaccuccuacgguuaugaacccaugggcgggugguga

SEQ ID NO: 820 - RNA, 171 nt, Artificial Sequence
  derived and/or modified CDS sequence (opt7) from Sus scrofa__NP_999071.1__SsAMELX-LRAP
augccccugccaccgcaccccggccauccaggguacaucaacuucagcuaugaggugcucacuccccugaagugguaccagaauaugauuaggcacccauccuugcugcccgaccucccacuggaagccuggccggcaaccgauaaaaccaagcgggaggaagucgacuga

SEQ ID NO: 821 - RNA, 210 nt, Artificial Sequence
  derived and/or modified CDS sequence (opt7) from Sus scrofa__NP_999071.1__HLA-A2-SP_SsAMEL(17-61)
auggccgugauggcacccaggacucugguccuccuguugagcggcgcccuggcgcucacucagaccugggccaugccacugccgccccacccagggcaucccgguuacaucaacuucuccuaugagguguugacgccacugaagugguaccaaaauaugauucggcaccccuauaccaguuacggcuaugaaccaaugggcgggugguga

SEQ ID NO: 822 - RNA, 243 nt, Artificial Sequence
  derived and/or modified CDS sequence (opt7) from Sus scrofa__NP_999071.1__HLA-A2-SP_SsAMEL(17-49,167-189)
auggccgugauggcacccaggacccugguccuccuguugagcggcgcccuggcgcucacucagaccugggccaugccacugccgccccacccagggcaucccgguuacaucaacuucuccuaugagguguugacgccacugaagugguaccaaaauaugauucggcaccccagucuccugccagaccugccgcucgaagcauggcccgccacugauaaaaccaagcgcgaggaaguagacuga

SEQ ID NO: 823 - RNA, 534 nt, Artificial Sequence
  derived and/or modified CDS sequence (opt7) from Sus scrofa__P45561-2__SsAMELX-001-2
augggcaccuggauccuguucgccugccuccugggggcagccuuuagcaugcccuugccaccgcaccccggucauccaggcuacauuaacuucuccuauaucaggcaccccuacaccaguuauggguacgagccaaugggcgguuggcugcaucaccagauuauccccguggucagccaacagacuccacagucccaugcgcuccagccgcaccaccauauucccauggugccagcccaacagcccgggaucccacagcagcccaugaugccgcugcccggccaacacaguaugacgccaacucagcaucaccagcccaauuugccacugcccgcacagcaaccauuucagccgcagcccguacaaccacagccccaccagccacuccagccccaaagcccgaugcauccaauccagccccugcugccccagccaccccucccaccgauguucuccaugcagagccuguugcccgaccugccacucgaagccuggcccgcaaccgauaagaccaaacgggaggaaguggacuga

SEQ ID NO: 824 - RNA, 570 nt, Artificial Sequence
  derived and/or modified CDS sequence (opt7) from Sus scrofa__NP_998965.1__SsAMELX-001-3
augggcaccuggaucuucuuugccugccugcucggggcaagccuggccaugcccuugccaccgcaccccggucauccaggcuacauuaacuucuccuaugaggugcugacuccccucaagugguaccagaauaugaucaggcacccauauaccaguuacggguaugaacccaugggcgguuggcugcaucaccaaauuaucccagucgugagccagcagacgccgcagucccaugcguugcaaccccaccaccauauuccaaugguacccgcccagcagccagggaucccccagcaaccgaugaugccccugccaggccagcacaguaugacucccacccagcaucaccagccaaaccucccccugccagcacaacagccguuucagccccaaccagugcagccccagccacaccagccccugcaaccgcagagcccaaugcaucccauccagccccuccugccacagcccccauugccgcccauguucuccaugcaaagccugcucccagaccugccccuggaggccuggccagcaaccgauaaaacuaagcgggaagaggucgacuga

SEQ ID NO: 825 - RNA, 219 nt, Artificial Sequence
  derived and/or modified CDS sequence (opt7) from Sus scrofa__K7GPB2__SsAMELX-002
augggcaccuggauccuguucgccugccuccugggggcagccuuuagcaugcccuugccaccgcaccccggucauccaggcuacauuaacuucuccuaugaggugcugacuccccucaagugguaccagaauaugaucaggcacccaagucuguugcccgaccugccacucgaagcguggccggccaccgauaaaacgaagcgggaggaagucgacuga

SEQ ID NO: 826 - RNA, 612 nt, Artificial Sequence
  derived and/or modified CDS sequence (opt7) from Sus scrofa__K7GLD0__SsAMELX-003
augggcaccuggauccuguucgccugccuccugggggcagccuuuagcaugcccuugccaccgcaccccggucauccaggcuacauuaacuucuccuaugaggaccuguaccucgaagcgaucaggauugaucggacugccuuugugcugacccccuugaagugguaucagaauaugauccgccacccauacacgaguuauggguacgagcccaugggcgguuggcugcaucaccaaauuaucccagucgugagccagcagacuccgcagucccaugcacuccaaccccaccaccauaucccaaugguacccgcccagcagccagggauuccccagcaaccgaugaugccccugccaggccagcacaguaugacccccacccagcaucaccagccaaaccugccccucccagcacaacagccguuccagccccaaccagugcagccccagccacaccagccccugcaaccgcagagcccaaugcaucccauccagcccuugcugccacagcccccacucccgcccauguuuuccaugcaaagccugcugccagacuugccccucgaagccuggccagcgacugauaaaaccaagagggaggaagucgacuga

SEQ ID NO: 827 - RNA, 498 nt, Artificial Sequence
  derived and/or modified CDS sequence (opt7) from Sus scrofa__K7GPE9__SsAMELX-004
augggcaccuggauccuguucgccugccuccugggggcagccuuuagcaugcccuugccaccgcaccccggucauccaggcuacauuaacuucuccuaugaggugcugacuccccucaagugguaccagaauaugaucaggcacccaacgccccaaagucaugcgcugcagccacaccaucacauuccgaugguccccgcccagcagccagggaucccccaacagccaaugaugcccuugccgggccagcacagcaugacccccacucagcaucaccaaccaaaccugccccucccagcacagcagcccuuucagccacaaccggugcagccccagccacaucaaccccugcagccacagucccccaugcacccgauucagccacugcucccccaacccccacugcccccaauguucaguaugcagagcuugcugccggaccucccccuggaagccuggccagcaaccgauaaaaccaagcgggaggaaguagacuga

SEQ ID NO: 828 - RNA, 522 nt, Artificial Sequence
  derived and/or modified CDS sequence (opt7) from Sus scrofa__J9JIM4__SsAMELX-201
augccccugccaccgcaccccggccauccaggguacaucaacuucagcuaugaggugcucacuccccugaagugguaccagaauaugauuaggcacccauauaccuccuacgguuaugaacccaugggcgggugguugcaucaccaaaucauuccagucgugagucagcagaccccgcagagccaugcccugcaaccccaccaccauaucccaaugguacccgcacagcagccaggcauuccccagcaaccgaugaugccccucccaggucagcacuccaugacgcccacucagcaucaccagccaaaccugcccuugccagcccaacagccguuucagccccaaccagugcagccccagccacaccagccccugcaaccgcagaguccaaugcaucccauccagccccuccugccacagcccccacugccgcccauguucagcaugcaaucccuccugccagacuugccccuggaggcguggccagccaccgauaaaaccaagcgggaagaggucgacuga

SEQ ID NO: 829 - RNA, 2961 nt, Artificial Sequence
  derived and/or modified CDS sequence (opt7) from Homo sapiens__NP_006120.1__HsBMP1
augcccggcguggccaggcugccacuccuguuggggcugcuccuguugccgcggcccggucgcccacuggaccucgcagauuacaccuaugaccuggccgaggaagaugacagcgagccccugaacuacaaggauccaugcaaagcggccgcauuccucggcgacaucgcccuggaugaagaggacuugagggcauuucagguccaacaggccguggaucugcggcgccacacugcgaggaaguccaguauuaaagccgcaguacccgggaauaccagcacgccauccugucagaguacuaacggccagccgcaacggggugccugcgggcgcuggaggggccggagccgcuccaggcgggccgcaaccagccgccccgaaaggguguggccagacggcgucauccccuucgugauuggggguaauuuuaccggcucccagcgggccguguuccgccaggcgaugaggcauugggagaagcacacuugugucaccuuucucgagcggacggaugaagacaguuauaucguguucacuuaccgcccaugcggguguugcagcuauguaggcaggcggggugggggcccccaggccauuuccaucggcaaaaacugugauaaguuugggaucgugguccaugagcugggucacguggugggcuucuggcaugaacacaccaggccggaccgcgaccggcacgucagcauugugagggagaauauccaacccgggcaggaguacaacuuucugaagauggaaccacaggagguagaaaguuugggcgagacuuaugauuucgacuccauuaugcauuacgcacgcaauaccuuuagccgggguaucuuccucgauaccauugugcccaaauacgaagucaacggcgugaagccacccaucgggcagaggacgcgccuguccaaaggcgacauugcccaagcacggaagcuguauaaaugcccagccuguggggagacucuccaggauaguaccgguaauuucagcuccccggaguaccccaacggcuauagcgcccacaugcauugcguguggaggaucagugucacuccaggggaaaagaucauucugaauuuuaccuccuuggaccuguaccggagccgccucugcugguaugauuacguggagguaagggacggcuucuggcggaaagcgccccugcgcgguagguuuuguggcaguaagcugccagaacccaucguguccaccgauagccgguugugggucgaguuccgcagcuccaguaacuggguggggaagggcuuuuucgcagucuaugaagccauuugcgggggcgacgugaaaaaggauuacggucacauccagagcccgaauuacccagacgacuauaggcccuccaaaguguguauuuggcggauccaaguaagcgagggguuucacgugggccucacuuuccagaguuuugagaucgaaaggcaugauuccugcgccuacgacuaucuggagguccgcgauggucacagcgaauccaguacgcugauuggccgguacuguggguaugagaagcccgacgauaucaaaagcaccuccagcaggcucuggcugaaguucgugagugacggcuccauuaacaaggcaggguuugccgucaauuucuuuaaagaaguggaugagugcagccgcccaaaccggggcgguugugagcagaggugcuugaacacucugggguccuacaaguguaguugcgaccccggcuaugaacucgcgccagauaaacgccggugcgaggccgcauguggcggguuccugaccaagcugaaugguagcaucaccuccccgggcuggcccaaagaauacccacccaacaagaauugcauuuggcaguugguggccccaacucaauacaggaucagccuccaguucgacuuuuucgagacggaggggaacgauguauguaaguaugacuuuguggaaguccgcaguggccugaccgcagauuccaaacugcaugguaaguucugcgggagcgagaaacccgaagugaucacuucccaguacaauaacaugcgggucgaguuuaagagcgacaauaccgugaguaaaaagggcuucaaggcccacuuuuucagcgacaaagaugaauguuccaaggacaacggcgggugccagcaagauugugugaauaccuuugguaguuaugagugccaguguaggagcggcuucguacuccaugacaacaaacacgauugcaaggaggccgggugugaccacaaagucacuuccacgagcggcaccauuacuuccccgaauuggccagauaaguaccccaguaaaaaggaaugcaccugggcaaucagcuccacuccaggucaucgcgugaagcugaccuuuauggagauggacauugaaagucagcccgagugcgccuaugaucacuuggaaguguucgacgggcgggaugcgaaagccccgguccugggcagguucuguggcagcaagaaacccgagccagugcucgcaacggggucccgcauguuucugcgguucuacagcgacaacagugugcagaggaaggguuuucaagccucccaugccaccgagugcggcgggcagguacgcgcagacgucaaaacuaaggaucuguauagccacgcgcaguucggcgacaauaacuaccccggugggguggauugugaaugggugaucgucgccgaggaaggcuacggcguggaguugguauuucagaccuucgaaguggaggaggaaacugacugcggguaugauuacauggagcuguuugacgguuaugauuccaccgcaccaaggcucggccgguacugugggagcggucccccagaagaggucuauagugccggcgacuccgugcuggugaaguuccacagcgaugacacgauuaccaaaaagggcuuucaucucagguacaccaguacuaaauuccaagauacucugcacucccgcaaguga

SEQ ID NO: 830 - RNA, 1191 nt, Artificial Sequence
  derived and/or modified CDS sequence (opt7) from Homo sapiens__NP_001191.1__HsBMP2
augguggccggcaccaggugccugcucgcacuguugcugccccagguccuccuggguggggccgcgggcuuggugccagagcuggggcggcgcaaguucgccgcagccagcuccggcaggccgaguagccaacccuccgacgaaguacucagugaguuugaacugcggcugcucagcauguucggucugaaacagcgcccaacucccuccagggaugcaguggucccacccuacauguuggaccuguaucggcgccacagcgggcagccaggcuccccggcccccgaucauaggcucgagcgggcggccagucgcgcaaacaccgugaggagcuuucaccaugaagagucccuggaggaacugccagagacgagcggcaagacuacccggcgcuucuuuuucaauuugaguuccauccccaccgaagaguuuauuacuagcgccgagcuccagguguucagggaacaaaugcaggacgcccuggggaacaauuccaguuuucaccaucggaucaacauuuacgagaucauuaaaccagcaaccgccaauagcaaguuccccgucacgcgccugcucgauacuaggcuggugaaccagaaugcgucccggugggaauccuuugacguaaccccggccgugaugcgcuggacugcacagggucacgccaaccacggcuucgucguggagguggcacauuuggaagagaaacaaggggucaguaagaggcacgugcggaucuccaggagccugcaucaggaugagcacaguuggucccagauccgcccccuccugguaaccuucggccacgacgguaaggggcauccacugcacaaacgggaaaagaggcaggccaaacauaagcaacgcaaacggcucaagagcagcuguaaaaggcaccccuuguauguggauuuuuccgacgucggcuggaaugauuggauuguggccccacccggcuaccaugcguucuauugccacggggaguguccauuuccgcuggcagaccaccugaacaguaccaaucaugccaucgugcagacgcucgucaacagcgugaauagcaagauucccaaggccugcuguguaccaacugaacugagcgcaaucaguauguuguaccuggaugagaacgaaaaagugguccucaagaauuaucaggacaugguggucgaggguugcggcugucgcuga

SEQ ID NO: 831 - RNA, 1227 nt, Artificial Sequence
  derived and/or modified CDS sequence (opt7) from Homo sapiens__NP_001193.2__HsBMP4
augauccccggcaacaggaugcugauggugguccuccugugccagguguugcucgggggugccagccacgcaucccugauuccagagaccggcaagaaaaagguagccgaaauccaagggcaugcgggcggucggcgcagugggcagagccacgagcuguugagggacuucgaagccacucugcuccagauguuuggccugcggcgcaggccgcagcccuccaaaagugcagugauuccagauuacaugcgggaccuguaucgccuccaaagcggcgaggaagaggaggaacagauccauuccaccgggcuggaguaccccgaaaggccagccagccgggcaaauacgguccgcuccuuccaccaugaggagcacuuggaaaacauucccgguaccagugagaauagcgccuuuagguuccuguuuaaccucuccagcaucccagaaaaugaggugaucaguuccgcggaacugcggcuguuccgcgaacagguggaucagggcccggacugggagaggggguuucaccggauuaacaucuaugaggucaugaagcccccagccgaggugguacccggccauuugauuacucgccuccuggauaccaggcuggugcaccauaaugucacucggugggaaaccuucgacgugagcccagcagugcuccgcuggacgagggagaaacaacccaacuacggucuggccaucgaagucacucacuugcaccagacccggacucaucaggggcagcacgugaggauuucccgcagucugccgcaaggcagcggcaauugggcccagcuccggccccugcugguaaccuuugggcaugaugguaggggccacgcauugacccgccggaggcgcgccaagcgguccccaaagcaucacagccagagggcgcggaaaaagaacaaaaauugucgcaggcacagucucuauguggacuucuccgaugucggguggaacgacuggaucguggcacccccaggcuaccaagccuuuuauugccauggugauugucccuucccacuggccgaccaccugaauagcacgaaccaugcaauugugcagacucucgucaauagugugaacuccagcaucccgaaggccugcuguguacccaccgagcugagcgccaucuccauguuguaccuggaugaguacgacaaagugguccucaagaacuaucaggaaaugguggucgagggcugcgggugucgguga

SEQ ID NO: 832 - RNA, 1542 nt, Artificial Sequence
  derived and/or modified CDS sequence (opt7) from Homo sapiens__NP_001709.1__HsBMP6
augcccggccuggggaggcgggcccaguggcucugcuggugguggggucuguuguguagcugcuguggcccaccgccccugcgcccaccccucccagcagccgcggccgcagccgcagggggccaacuguugggugacgggggcucccccggcaggaccgagcagccaccgcccaguccacagagcuccaguggguuccuguaccggcgccucaagacucaggagaaaagggaaaugcaaaaggaaauccugagcgugcugggucucccccaccggccacgcccccugcauggcuugcagcagccgcagcccccagcccugaggcaacaggaggaacagcagcaacagcagcaacucccccgcggggagccacccccaggccggcugaaauccgcgccgcuguuuauguuggaucucuauaacgcccugagcgcagacaaugaugaggacggugccuccgaaggggagaggcagcagaguuggccccacgaagccgcaagcuccagccagcggcgccaaccacccccaggcgccgcgcauccccugaacaggaagagucuccuggccccgggcuccgggagcgguggcgcauccccauugaccagugcccaggauagcgcauuccugaaugacgccgauauggucauguccuuugugaaccucguagaguacgacaaagaguucagcccccggcagcgccaccauaaggaauuuaaguucaaucugagucagauucccgagggggaaguggucacggccgcggaguuuaggaucuauaaagauugcgugaugggcuccuucaagaaccaaacuuuucugauuagcaucuaccagguguugcaggaacaccagcaccgggacagugaucucuuccugcuggacacccgcgucgugugggcauccgaggaggguuggcucgaauuugauauuaccgccacuagcaaucuguggguagugaccccacaacauaacaugggcuugcagcugagcgucgugacgagggacggggugcacguccauccccgggccgcaggccucguggggagggacgguccauaugauaaacagccguucaugguagccuucuuuaagguguccgagguccacgugcgcacuacccggagugcgagcuccaggcgccggcagcaaagcaggaaucgcaguacucagucccaggacguggcccgggucagcuccgcaagugauuacaacagcuccgaacugaaaaccgccuguaggaagcacgagcuguaugugagcuuccaagacuugggcuggcaggauuggaucaucgcacccaaaggguacgccgccaauuacugcgacggcgaauguaguuuuccacucaacgcacauaugaaugccaccaaccacgcgauuguacagacgcuggugcaucugaugaaucccgaguaugucccaaagcccugcugugccccgacuaagcucaacgcaaucuccgugcuguacuucgaugacaacagcaaugucauuuugaaaaaguaucggaacaugguggugcgcgccugcgguugccacuga

SEQ ID NO: 833 - RNA, 1296 nt, Artificial Sequence
  derived and/or modified CDS sequence (opt7) from Homo sapiens__NP_001710.1__HsBMP7
augcacgugaggagccugcgggccgcagcgccccauuccuucgucgcccucugggccccacuguuuuugcugcgcagugcacucgccgacuucagccuggauaacgaggugcacuccaguuuuauccauaggcgguugcgcagccaggaaaggcgggagaugcaacgcgaaauucuguccauccucggccugccgcacaggccccggccacaucugcaggggaagcacaauagcgcacccauguucaugcucgaccuguacaacgccauggcgguagaggaagguggcgggccaggcggucagggguuuuccuaucccuacaaagccguguucaguacccagggcccaccguuggcaagccugcaagauucccacuuucucacugacgccgauauggucaugagcuucgugaaucugguggagcaugacaaggaguuuuuccacccccgcuaucaucacagggaauuucgguucgaucugaguaaaauuccagagggcgaagccgucaccgcagccgaguuccgcaucuacaaggacuauauuagggagcgguuugauaacgaaacguuccgcaucuccguguaccagguauugcaggagcaccucgggagggaaagcgaccuguuucugcucgauucccggacucugugggcgagugaggaagguugguugguguucgacaucaccgccaccagcaaucauugggucgugaacccccgccacaaucugggccuccagcuguccguggagacucuggaugggcaaagcauuaacccaaaauuggcaggccucaucgguaggcaugggccccagaauaagcagccguuuauggucgccuucuuuaaggcaaccgaggugcacuuccggaguauuagguccacgggcagcaaacagcgcagucaaaaccgguccaagacucccaaaaaucaggaagcccugaggauggccaacguagcggagaauagcagcuccgaccagcgccaagcaugcaagaaacaugaacuguaugugaguuuucgggaccucggcuggcaggauuggaucauugccccagagggguacgccgcauacuauugugaaggugagugcgccuucccccugaacagcuacaugaaugcgaccaaccacgccaucguccagacuuuggugcacuuuauuaacccagagaccgugcccaagccauguugcgcaccgacccagcugaaugccaucuccguccucuauuucgacgauagcaguaacgugauccugaaaaaguacaggaauaugguagugcgcgcauguggcugccauuga

SEQ ID NO: 834 - RNA, 300 nt, Artificial Sequence
  derived and/or modified CDS sequence (opt7) from Homo sapiens__NP_006264.2__HsCCL7
augaaggccagcgcagcccugcucugccuguugcugaccgcggccgcauucaguccccagggccucgcccaaccaguggggaucaacacuuccaccacguguugcuacagguuuauuaauaaaaagaucccgaaacagcggcuggagagcuaucgcaggacuaccuccagucacuguccccgggaagcagucauuuucaagaccaaauuggacaaggagaucugcgccgauccaacucagaagugggugcaggacuuuaugaaacaucuggauaagaaaacccaaacgcccaagcucuga

SEQ ID NO: 835 - RNA, 3624 nt, Artificial Sequence
  derived and/or modified CDS sequence (opt7) from Homo sapiens__NP_001954.2__HsEGF
augcugcucacccugaucauuuugcugcccguggucagcaaguucuccuuugugagucucagcgccccacagcacugguccugcccggagggcacucuggcagggaacgguaauaguaccuguguaggccccgccccauucuugaucuuuagccaugggaacuccauuuucaggaucgacacggaaggcacuaauuacgagcaacugguggucgacgcgggugugagcgugauuauggacuuucacuauaacgaaaaacggaucuacugggucgaucucgagcgccagcugcugcagaggguguuccucaaugggucccggcaggaacgcguaugcaacaucgagaagaaugugaguggcauggccauuaacuggaucaaugaggaagucauuuggagcaaccaacaggagggcaucauuaccgugaccgacaugaaagggaauaacucccauauccuguugagcgcacugaaguaucccgccaauguggcagucgauccaguggaaagguuuauuuucuggaguuccgagguagccgguagccucuaccgggcggaccuggauggcgugggggucaaagcccuguuggagacuuccgaaaagaucaccgcagugagucucgacgugcuggauaagcgccuguuuuggauccaguauaacagggagggcagcaauucccucauuuguagcugcgacuacgauggugggaguguccacaucuccaaacaucccacgcagcacaaccuguucgccaugagcuuguuuggcgaccggauuuucuauaguacuuggaagaugaaaaccaucuggauugccaacaagcacacuggcaaagauauggugcgcaucaaucugcauuccagcuucguaccacucggggaacugaaggugguccacccgcuggcacaacccaaagccgaggacgacaccugggaaccagagcagaaguuguguaagcucaggaaagguaacugcagcuccaccguguguggccaggaucugcagagucaucugugcaugugugcggagggguacgcccucagccgggaccgcaaguacugcgaagaugucaaugagugcgcauuuuggaaccacggcuguacgcuggguugcaaaaauacucccggcuccuauuacuguaccugcccagugggguucguguugcugcccgacggcaagaggugucaccaacucguaagcugcccgcggaacgugagugaauguucccaugauugcguccugacuagcgaggggccccuguguuuuugcccagaagguuccguguuggagcgcgacggcaaaaccugcaguggguguagcucccccgauaauggcgguugcagccagcucugugucccacugagucccguguccugggagugcgacuguuucccaggcuaugaucugcagcucgacgaaaagagcugcgccgcauccgggccgcaacccuuucuguuguucgccaacagucaggauaucaggcacaugcauuuugacggcaccgacuacgggacucugcucagccagcagaugggcaugguguaugcccuggaucacgacccaguagagaauaagauuuacuucgcgcauacggcacugaaauggaucgaacgggccaacauggaugguucccaacgcgagagguugauugaagaggggguggacguccccgagggccuggccguggauuggaucggucggagguuuuauuggaccgaccgcggcaagagccucauugggcggagugaucugaauggcaaaagguccaagaucaucacuaaagaaaacauuagccagccacgcgggaucgcaguccaccccauggccaagcggcuguucuggaccgacaccggcauuaauccgaggaucgaguccagcagucuccaggguuuggggcgccuggugauugcgagcuccgaucucaucuggccaaguggcauuacuaucgacuuucugacggauaagcuguacuggugugacgccaaacagagcgugaucgaaauggcaaacuuggauggcuccaagcggaggcggcugacccaaaaugacguagggcaccccuucgccgucgcaguguuugaggacuacgugugguucagcgauugggccaugcccuccgucaugcgcgugaacaaaaggacugguaaggaccgggugcgccuccagggcaguaugcugaaaccaagcucccucguagucgugcauccccuggccaagccaggggcagauccgugcuuguaucagaacggcgguugugagcacauuugcaagaaaaggcuggggaccgccugguguaguugccgggaaggcuucaugaaggcgagcgacggcaaaaccugccuggcccucgaugggcaucagcuguuggccgguggcgagguggaccugaagaaucaagucacuccccucgauauccuguccaaaacgcgcgugagcgaagacaacauuaccgagagucagcacaugcucguagcagaaaucaugguguccgaucaggacgauugugccccagucgggugcagcauguacgcaagguguauuuccgagggcgaggacgcgacuugccagugucugaaggguuuugccggggacggcaaauugugcagcgauaucgacgaaugugagaugggcgugcccgugugcccacccgcaaguuccaaguguaucaauaccgaaggggguuaugucugccggugcagcgagggcuaccaaggggauggcauucacugucuggacaucgaugaaugccagcugggugagcauaguuguggggagaacgccuccugcacuaauaccgaaggcggcuauacguguaugugcgccgggaggcucagcgagccgggucugauuuguccagacuccacucccccaccccacuugcgcgaagaugaccaucacuacagcgugcggaacagugauagcgagugcccgcugucccaugacggcuauugucuccacgaugggguaugcauguacaucgaagcacuggacaaguacgccugcaauuguguggucggcuauauuggugagaggugccaguaccgcgaucugaaauggugggagcuccggcacgcgggccaugggcaacagcagaaggugaucguggucgccguguguguagugguccuggugauguugcugcuccugaguuuguggggcgcacacuauuacaggacccagaaacugcucagcaagaaccccaaaaauccauaugaagaguccagccgcgacgugcgguccaggcgccccgccgacaccgaagaugggaugaguagcugcccacaacccugguucgucgugaucaaggagcaucaggaccugaagaacgguggccagccaguagccggggaggauggccaggcagccgacgguuccaugcaaccgacuagcuggcggcaggaaccccagcuguguggcauggggaccgagcagggcugcuggauuccagugaguuccgauaaagggagcuguccccaagucauggaaagguccuuucacaugccaaguuacgguacgcagacccucgagggcgggguggaaaagccccacagccuguuguccgcgaauccgcuguggcagcaacgcgcccucgaucccccacaucagauggagcugacucaguga

SEQ ID NO: 836 - RNA, 510 nt, Artificial Sequence
  derived and/or modified CDS sequence (opt7) from Homo sapiens__NP_001423.1__HsEREG
augaccgccggcaggcggauggagaugcugugcgcagggcgcgugcccgcccuccuguugugccuggguuuccaccuccugcaggcggucuugagcacuaccgugaucccauccugcauuccgggcgaaaguagcgacaacuguacggcccugguacaaacugaggauaaucccaggguggcacaggucuccaucaccaagugcaguagcgacaugaacggguacugucuccauggccagugcauuuaucugguggauaugucccagaauuacugucggugcgaaguggguuauaccgggguccgcugugagcacuuuuuccugacugugcaucaaccacucagcaaagaauacguagcccugaccgugaucuugauuauccuguuucucaucacggucgugggcuccacuuauuacuucuguaggugguaucggaaccgcaagaguaaagagcccaagaaagaguacgaaagggugaccagcggcgacccagagcugccccaggucuga

SEQ ID NO: 837 - RNA, 468 nt, Artificial Sequence
  derived and/or modified CDS sequence (opt7) from Homo sapiens__NP_000791.1__HsFGF1
auggccgagggcgaaaucaccacuuucaccgcacugacggagaaguuuaaccugcccccagggaauuacaaaaagccgaaacucuuguauugcagcaacgguggccacuuccugaggauucuccccgacgggacuguggauggcacccgggaccgcuccgaucagcauauccaacugcaguugagugccgaaagcgucggugagguguacauuaaguccaccgaaacugggcaguaucuggcgauggacaccgauggccuccuguacggcagucagacgccaaaugaggagugucuguuucucgaaaggcuggaggaaaaccacuauaauacuuacaucagcaaaaagcaugccgagaagaacugguucguaggguugaaaaagaaugguuccugcaaacggggcccccgcacccacuaugggcaaaaggcaauucuguuucucccacugcccgugagcuccgacuga

SEQ ID NO: 838 - RNA, 867 nt, Artificial Sequence
  derived and/or modified CDS sequence (opt7) from Homo sapiens__NP_001997.5__HsFGF2
auggugggcgucggggguggcgacguggaggauguaacccccaggccagggggcugccagaucagcggucgcggggcccggggcuguaacggcauuccgggggcagccgcgugggaagccgcacugcccaggcggcgcccaaggcggcaccccuccgugaauccacgcaguagggccgcagguagcccccggacucgcggcaggcggaccgaggaacgcccauccgggaguaggcucggcgaccggggucgcgggagggcccugccgggcggccgguugggugggcgcggcagggggcgggcgcccgagagggucggcggucgcggccgggggaggggcacggccgcaccacgcgccgcccccgcagcccgggggagcaggccaggucccgcgggcacuauggccgcaggguccaucaccacccugccggcccuccccgaagauggcgguagcggcgcauucccacccgggcauuuuaaggacccaaaacgccuguacugcaagaacggcggguucuuuuugcggauucaccccgauggcaggguggacggugugcgggagaaauccgauccacauaucaagcugcaacuccaggccgaggaacgcggggucgugaguauuaaaggcguaugugccaauagguaucuggcgaugaaggaggacggucggcugcucgcaagcaagugcgugacugaugaauguuucuuuuucgagcgccuggaguccaacaauuacaacaccuauaggagccggaaauacacgaguugguaugucgccuugaagcgcacuggccaguacaaacugggguccaagaccggcccggggcagaaagccauccucuuucugcccaugagcgcaaaguccuga

SEQ ID NO: 839 - RNA, 585 nt, Artificial Sequence
  derived and/or modified CDS sequence (opt7) from Homo sapiens__NP_002000.1__HsFGF7
augcacaaguggauccugaccuggauucuccccacucuguuguacaggagcugcuuccauaucauuugucuggugggcaccaucucccucgccugcaacgacaugacgccagagcagauggcaacuaaugucaacuguaguagcccggaacggcacacccgcuccuaugauuacauggaagggggugacauuagggugcggcgccuguuuugcaggacccaaugguauuugcggaucgauaaacgcggcaagguaaaagggacucaggagaugaagaauaacuacaauaucauggagauuaggaccguggccgucggcaucguggcgauuaaagguguggaaagugaguucuaucuggccaugaacaaggaggggaagcucuacgccaaaaaggaauguaaugaggacugcaacuuuaaagaacugauccuggagaaucauuauaacacguacgcaagcgcaaaguggacucacaauggcggcgagauguucgucgcccucaaccagaaagggauucccgugcgggguaagaaaaccaagaaggaacagaaaacugcgcauuuucugccaauggccaucaccuga

SEQ ID NO: 840 - RNA, 627 nt, Artificial Sequence
  derived and/or modified CDS sequence (opt7) from Homo sapiens__NP_001936.1__HsHBEGF
augaagcugcuccccagcgugguccugaaauuguuccuggccgcagugcucuccgcccugguaaccggcgagaguuuggaaaggcugcggcgcgggcucgcggccgguacuagcaacccagacccgcccaccguguccacggaucagcugcugccacucggcgggggcagggaccggaagguccgcgaucugcaagaggcagacuuggaucugcucagggugacucugaguagcaaaccccaggcccuggcaaccccaaauaaggaggaacacgguaaacggaagaagaaagggaagggcuugggcaaaaagcgcgaccccugccucaggaaauacaaggauuuuuguauccauggggaaugcaaauaugugaaggagcugcgggccccauccuguauuugccacccggguuaccauggcgagcgcugucacgggcugagccuccccgucgaaaacaggcuguauaccuacgaccauacuaccaucuuggcggugguagccgugguccuguccagugugugccuccuggugauugucggccuguugauguuccgguaucaccgcagggguggguacgauguggagaaugaagagaagguaaaacucggcaugacgaacagccacuga

SEQ ID NO: 841 - RNA, 2187 nt, Artificial Sequence
  derived and/or modified CDS sequence (opt7) from Homo sapiens__NP_000592.3__HsHGF
augugggugaccaagcugcuccccgcccuguugcugcagcacguccuccugcauuugcugcuccugccaaucgcaauuccguacgccgagggccaaaggaaacggcgcaacacuauccacgaauuuaagaaaagcgcgaagaccacgcugauuaaaaucgaccccgcccucaagauuaagacuaaaaaggugaauaccgcagaucagugcgccaacagguguacccggaauaaagggcugccauucacuugcaaggcauucguauuugacaaagcccgcaagcaguguuugugguuccccuuuaacuccaugaguagcggugugaaaaaggaguucggccaugaauuugaucuguaugagaauaaggacuacaucaggaacugcaucauugggaaaggccgguccuauaaggguaccgucaguaucacgaaaagcgggauuaagugucagccaugguccagcaugaucccccacgaacauuccuuccucccaaguagcuaccgcggcaaagaucugcaagagaauuauugcaggaacccgcggggcgaggaagggggucccugguguuuuacuuccaauccagaggugcgcuacgaagugugcgacauuccccaguguagcgaggucgagugcaugaccugcaacggcgaaaguuauagggggcugauggaucacacugaguccggcaagaucugucagcggugggaccaccagaccccacaucgccacaaguucuugcccgaaagguacccggauaaagguuuugacgauaauuacugccggaaccccgacgggcaaccacgccccugguguuauacccucgauccacauacgaggugggaguacugcgcgauuaagacuugugccgacaauaccaugaacgacacugaugugccccuggaaaccaccgagugcauccagggccagggcgagggguaucgggguacuguaaauacgaucuggaacggcauuccaugucagcgcugggacagccaauacccgcacgaacacgauaugacccccgagaacuucaaaugcaaggaccugagggaaaauuauugucggaacccagauggguccgagagucccuggugcuucacuaccgacccaaauaucagggugggcuacugcagccagauucccaacugugauaugucccauggucaggacugcuaucgcggcaaugggaaaaacuacaugggcaaucucagccaaacccggagugggcugacuuguuccaugugggauaagaacauggaagacuugcacaggcauaucuuuugggagccggaugcaagcaagcugaaugagaacuacugccgcaauccagacgacgaugcccacggucccugguguuauacgggcaacccccucauuccaugggacuacugccccaucagucggugugaaggggauaccacuccaaccaucgucaaucuggaccauccggugauuuccugcgccaaaaccaagcagcugaggguggucaacggcauccccacucgcacgaauauugguuggauggugagcuugcgguauaggaacaaacacaucuguggcgggagccucauuaaggaguccuggguacugaccgcacggcagugcuucccaagucgcgaucugaaagacuacgaagccuggcucggcauccacgaugugcaugggaggggcgacgagaaguguaagcagguccugaacgugagccaauugguguauggucccgaaggguccgaucugguccucaugaaacuggcgcggccagccgugcuggacgauuuuguaagcacuaucgacuugcccaauuacggcugcaccauuccggagaagaccaguugcuccguguaugguuggggcuacacugggcucaucaacuacgauggccugcugcgcgucgcacaccucuauauuauggggaaugagaaauguagccagcaucacaggggcaaggugacgcugaacgaauccgagaucugcgccggugcagagaaaauugggaguggcccaugugaaggcgacuacgggggucccuuggucugcgagcagcacaagaugcggauggugcugggcgugaucguaccagggcgcggcugugccauucccaauaggccggguaucuucgugcgggucgccuauuacgcgaaauggauccauaagauuauccucaccuauaaggugccccagagcuga

SEQ ID NO: 842 - RNA, 1926 nt, Artificial Sequence
  derived and/or modified CDS sequence (opt7) from Homo sapiens__NP_005336.3 __HsHSPA1A
auggccaaggcagccgcgaucggcauugaccuggggaccacuuacagcugcgugggugucuuccagcacggcaaaguggagaucauugccaacgaucaagggaauaggaccacgcccuccuauguagcauuuacugacaccgaacggcucaucggcgaugccgcaaagaaccagguggcccugaauccacagaacaccgucuucgacgcgaaacgcuugauugguaggaaguuuggggauccgguggugcagagugacaugaaacauuggcccuuccaagucaucaaugauggcgacaagccaaaggugcagguaagcuacaaaggcgagacuaaggccuuuuaucccgaagagaucuccaguauggugcugaccaaaaugaaggaaauugcagaggccuaccucggguauccagucacgaacgccgugaucacugugcccgcauacuucaaugauagccagcggcaggccaccaaagacgcgggugucauugccggccugaacguguugcgcaucauuaaugagccaacugcagccgcaaucgccuaugggcuggauaggaccggcaagggugaacggaacguacucauuuuugaccucgggggcggcaccuucgauguguccauccugacgaucgacgacgggauuuuugaggucaaagccacugcgggugauacccaccugggcggggaagacuucgauaaucgccuggugaaccauuuuguggaggaguucaagaggaagcacaaaaaggacaucagccaaaauaaacgggcaguccgcagguugcggacugccugugaacgcgccaagaggacccuguccaguagcacccaggcaucccucgagauugauagccuguucgaaggcaucgacuuuuacacuagcauuacgcgggcccgcuucgaggaacugugcuccgauuuguuuaggagcacccucgagccgguggagaaagcgcugcgggacgccaagcuggauaaggcacagauccaugaccucguacugguggguggcuccacucgcauccccaaaguccagaaguugcugcaagauuucuuuaacgggagggaccucaauaaaaguauuaacccagacgaagccguggcauacggcgccgccguccaggcagccauccugaugggggauaagagcgagaacgugcaggaccuguugcuccuggauguggcgccccugucccucggucuggaaaccgccggcgggguaaugaccgcauugauuaaacggaauagcacuaucccaacgaagcaaacccagauuuucacuaccuauagugacaaccagcccggcgugcugauccaggucuacgagggugaaagggccaugaccaaggauaauaaccuccugggccgcuuugagcuguccgggaucccgcccgccccacggggcgugccccaaauugaggucacuuucgacaucgaugcaaaugggauuuugaacgugacggcgaccgacaaaagcacuggcaaggccaauaaaaucaccauuacuaacgauaaggguaggcucaguaaagaagagaucgaacgcauggugcaggaggcagaaaaguauaaggccgaggacgagguacagcgggaaaggguguccgccaaaaaugcacuggagagcuacgccuuuaacaugaagagugcggucgaagaugaggggcugaaaggcaagauuuccgaggccgacaaaaagaaagugcucgauaagugucaggaagucaucaguuggcuggacgcaaauaccuuggccgagaaggacgaguucgaacacaaacgcaaggaacuggagcaagugugcaacccaaucauuagcggucucuaucagggcgccgggggccccgggccaggcgguuuuggggcacagggcccgaaaggcggguccgguagcggccccacgaucgaggaaguggauuga

SEQ ID NO: 843 - RNA, 1926 nt, Artificial Sequence; identical to SEQ ID NO: 842
  derived and/or modified CDS sequence (opt7) from Homo sapiens__NP_005337.2 __HsHSPA1B

SEQ ID NO: 844 - RNA, 1926 nt, Artificial Sequence
  derived and/or modified CDS sequence (opt7) from Homo sapiens__NP_005518.3 __HsHSPA1L
auggccaccgcaaagggcaucgccauugggaucgaccuggguacuaccuacagcugcgugggcgucuuccagcacgggaaaguggagauuaucgcgaacgaucaaggcaauaggacgacucccuccuauguagccuuuaccgacaccgaacggcucauuggugaugcagccaagaaccagguggcaaugaauccacagaacacugucuucgacgccaaacgccugaucgggaggaaguuuaaugauccgguggugcaggcggacaugaaauuguggcccuuccaagucaucaacgagggcggcaagccaaaggugcugguaaguuacaaaggggaaaauaaggccuuuuaucccgaggaaauuagcuccauggugcucaccaaacugaaggagacggcagaggccuucuugggucauccagucacuaacgccgugaucaccgugcccgcauacuuuaaugauagucagcggcaggccacuaaagacgcgggcgucauugccgggcugaacgugcuccgcaucauuaaugaaccaaccgcagccgcaaucgccuauggccuggauaagggugggcagggcgagaggcacguacugauuuucgaccucggcggggguaccuuugaugugagcauccugacgaucgacgauggcauuuucgaagucaaagccacugcgggggacacccauuugggcggugaggacuuugauaaccggcuggugucccacuucguggaggaguucaagcgcaagcauaaaaaggacaucagccaaaauaaaagggcaguccggcgccucaggacugccugugagcgggccaagcgcacccuguccaguagcacccaggcaaaccuggaaauugauuccuuguacgagggcaucgacuuuuauacuagcauuacgagggcccgguucgaagaacucugcgcggaucuguuucgcgggacccuggagccgguggaaaaagcccucagggacgcaaagauggauaaggccaaaauccacgacaucguacuggugggcgggaguacucggauucccaagguccagcgcuugcugcaggauuacuucaaugguagggaccucaacaaauccaucaacccagaugaggcaguggccuacggcgccgcaguccaagccgcgauucugaugggggacaagagcgaaaaagugcaggaccuguugcuccuggauguggcaccccugucccucggccuggagaccgccgguggcguaaugaccgccuugaucaagcggaauaguacuauuccaacgaagcagacccaaaucuuuacuaccuauagcgacaaccagcccggggugcugauccaggucuacgaaggcgagagggccaugaccaaagauaauaaccuccuggggcgcuucgaccugacuggcauuccgcccgcaccacggggugugccccagaucgaggucacguuugauauugacgcgaaugggaucuugaacgugaccgccacugauaaguccaccggcaaagugaauaagauuacuaucaccaacgacaaagguaggcucagcaaggaagagauugaacgcaugguacuggaugcagagaaguauaaagccgaagacgaggugcaacgggagaagaucgccgccaaaaaugcacuggaaaguuacgcguucaacaugaaguccgucgugagcgaugagggccucaaagggaagaucagugaauccgacaaaaauaagauucuggauaaguguaacgaguugcugagcuggcucgaggucaaucagcuggccgaaaaagacgaguuugaccacaagaggaaagaacuggagcagaugugcaacccaaucauuacgaaguuguaucagggcggguguaccggccccgcaugcgguacuggguacgugccaggccgcccggccaccggccccacuaucgaagagguggauuga

SEQ ID NO: 845 - RNA, 1920 nt, Artificial Sequence
  derived and/or modified CDS sequence (opt7) from Homo sapiens__NP_068814.2 __HsHSPA2
augagcgccaggggccccgcaaucgggauugaccuggguaccacuuacuccugcgugggcgucuuccagcacgggaagguggagaucauugccaacgaucagggcaaucggaccacgccaaguuauguagcguuuacugacaccgaacgccucaucggugaugccgccaaaaaccagguggcaaugaauccgaccaacacuauuuucgacgcaaagaggcugaucgggcggaaauuugaggaugccaccguccagagcgacaugaagcauuggcccuuccgcgugguguccgaaggcggcaaaccaaagguccagguggaguacaagggggaaacgaaaaccuuuuuccccgaggagaucaguagcaugguauugacuaagaugaaagaaauugcggaggccuaucuggguggcaaggugcacuccgcagucaucacugugccagccuacuuuaaugauagccaaaggcaggccaccaaagacgcagggaccauuacgggccucaacgugcugcggaucauuaaugaacccacugccgcggccaucgcauaugguuuggauaagaaagggugugccggcggcgagaagaacguccugauuuucgaccucggggguggcaccuuugauguguccauccugacuaucgaggacgggauuuucgaaguaaagaguaccgcaggcgauacccaucuggguggcgaggacuuugacaaucgcauggugagccaccucgccgaagaguucaaaaggaagcauaaaaaggauaucgggccaaacaaacgggccguccgcaggcugcggacugcgugcgaacgcgcaaagaggacguuguccagcaguacccaggccuccauugagaucgacagccuguacgagggcguggauuucuauacuuccauuacccgggcccgcuuugaggaacucaaugcagaccuguucagggggacccuggaaccgguggagaaggccuugcgggaugcgaaacucgacaagggucagauccaagaaaucguccuggugggcgggaguacucgcauucccaaaauccagaagcugcuccaggacuuuuucaacggcaaagagcugaauaagagcauuaacccagaugaggccguagcauacggugccgcagugcaggccgccaucuugauuggcgauaaguccgaaaauguccaagaccugcuccugcuggaugugacgcccuugagccucgggaucgagaccgcaggcggggucaugacuccacugaucaaaaggaacaccaccauucccacuaagcagacgcagaccuuuacuaccuacagugacaaccaauccagcgugcuggugcagguauaugaaggcgagcgggccaugacuaaagacaauaaccuccuggguaaguucgauuugaccgggaucccgcccgcgccaaggggcgugccccagauugaagucacguuugacaucgaugccaaugguauucugaacgugaccgcagccgacaaaaguacuggcaaggagaauaagaucaccauuacuaacgauaaagggcgccucuccaaggacgauaucgaccggaugguccaggaggccgaaagguacaaaagcgaggaugaagcaaaucgcgaccggguggcggccaagaacgcacuggagagcuauaccuacaauaucaaacaaacgguggaggaugaaaagcugaggggcaaaauuuccgagcaggacaagaacaagaucuuggauaaaugucaggaaguaauuaauuggcucgaccgcaaccagauggccgagaaggacgaauaugagcacaaacaaaaggagcuggaacgggugugcaauccaaucauuaguaaacuguaccaagggggccccggugggggcagcggcggggguggcuccggggccagcggcgguccaaccaucgaggaagucgauuga

SEQ ID NO: 846 - RNA, 2523 nt, Artificial Sequence
  derived and/or modified CDS sequence (opt7) from Homo sapiens__NP_002145.3 __HsHSPA4
augagcguggucggcaucgaccugggguuccaguccugcuacguggccguagcaagggccgguggcauugagaccaucgcgaacgaauauagugaucgguguacucccgccugcauuagcuuugggccaaagaaucgcuccaucggcgcagccgcaaaaagucaagugauuagcaacgccaagaauaccguccaggguuucaaaagguuucacgggcgggcguucuccgacccguuuguggaggccgaaaagagcaaccucgcauacgauaucgugcagcugcccacgggcuugacuggcaucaaagucaccuauauggaggaagaacgcaauuucaccacugaacaggugaccgccaugcugcucuccaagcugaaggaaacggccgagaguguauugaaaaagccaguggucgacuguguggugagcguccccugcuuuuacacugaugcagaaaggcgguccgugauggacgccacccaaauugcggggcugaacugucuccgccugaugaaugagacuaccgccguagcacuggccuaugguaucuacaaacaggaucucccagcacuggaggaaaagcccaggaacguggucuucguggacaugggccauagcgccuaucaggugagugucugcgccuuuaaucgggggaaauugaaggugcuggcgaccgcauucgauacgacucucggcggucgcaaauuugacgagguacuggugaaccacuucugugaagaguucgggaagaaguacaaacuggauauuaaguccaaaaucagggccuugcuccggcugagccaggaaugcgagaagcugaaaaagcucauguccgccaaugcaagugaccugccauugagcauugaguguuuuaugaacgaugucgacguguccggcaccaugaaucgcggcaaguuccuggaaaugugcaacgaccuccuggccagggucgagccgccccugcggagcguguuggaacaaacuaaacucaagaaagaggauaucuacgcgguggaaauuguagggggugccacccgcaucccagcagugaaggagaaaaucaguaaguuuuucggcaaggagcuguccaccacucugaaugccgacgaagcagucacgagggggugcgcccuccagugugccauucugagccccgcauuuaaagugcgggaguucaguaucaccgaugucgugccauaucccauuuccuugcgcuggaacagcccggccgaagagggcagcuccgacugcgaaguguuuaguaagaaccaugcggcccccuucagcaaaguacugacuuuuuacaggaaggagccauucacccucgaggcauauuacuccagcccccaggaucugccauaucccgacccagccaucgcccaguuuagugugcaaaaagucaccccgcaguccgaugguagcuccaguaaggugaaggucaaagugcgggugaauguacacggcauuuucagcgucuccagcgcaagucugguggaagugcauaaguccgaggaaaacgaggagcccauggaaacugaccagaaugcgaaagaggaagagaagaugcaagucgaucaggaggagccacacguggaggaacagcagcaacagacgcccgccgagaacaaagcagaaagcgaggaaauggagaccucccaggccgggaguaaggacaaaaagauggaucagccaccccaagccaagaaagcaaaggugaaaacuagcaccguagacuugccgaucgagaaucagcuccuguggcagaucgacagggaaaugcugaaccucuacauugagaaugaaggcaagaugaucaugcaggauaaacuggagaaggaacgcaacgacgccaagaaugcggucgaggaguauguguacgaaaugcgggauaaauuguccggggaguacgaaaaguuugugagcgaggacgauaggaacaguuucacccugaaacucgaggacacugaaaauuggcuguaugaggauggugaagaccaaccaaagcaggucuacguggauaaacuggccgaguugaagaaccugggccagcccauuaagauccgcuuccaggaauccgaggagcggcccaaacucuuugaggagcuggggaagcaaauucagcaguauaugaaaaucaucagcuccuucaagaauaaagaagaccaauacgaucaccucgacgcagccgauaugacgaagguagagaaaagcaccaacgaagccauggaguggaugaauaacaagcugaacuugcagaauaagcagagucugacuauggacccaguggucaaaagcaaggagauugaagcaaaaaucaaggagcucaccuccacuuguagucccauuaucagcaaaccaaagccgaagguggaacccccaaaagaggagcagaagaacgccgaacaaaauggccccguggacggucagggcgauaacccagggccccaggcggccgagcagggcaccgacacggcagucccguccgauagcgacaaaaagcugccagaaauggauauugacuga

SEQ ID NO: 847 - RNA, 2520 nt, Artificial Sequence
  derived and/or modified CDS sequence (opt7) from Homo sapiens__NP_055093.2 __HsHSPA4L
augagcguggucggcaucgaccugggguuccucaacugcuacauugccguggcaagguccgguggcaucgagaccauugccaaugaauauagugaucgguguacucccgcgugcaucagccuggggucccgcaccagggccauuggcaacgcagccaagagucagaucguaacgaaugugcggaacacuauccacgguuuuaaaaaguugcaugggcgcagcuucgacgauccaauuguccaaaccgagaggauccggcugccguacgaacuccagaaaaugcccaauggcuccgcaggcgugaaggugcgcuaucuggaggaagagaggccauuugccauugagcaggucaccgggauguugcuggcgaaacucaaggaaacuagcgagaacgcccugaagaaacccguggcagacuguguaaucuccauuccaaguuucuuuaccgaugccgaacggcgcagcgugauggccgcagcccaggucgcgggucugaauugccucaggcugaugaacgagacgacugccguggcauuggccuacggcaucuauaagcaagaccugcccccacucgaugagaaaccgcggaauguggucuucauugacauggggcacuccgcauaccaggugcugguaugugccuuuaacaagggcaaacugaagguguuggccaccacuuucgaucccuaucucggugggcgcaauuuugacgaagcgcuggucgauuacuucugcgacgaguuuaaaaccaaguacaagaucaacgugaaagaaaauagcagggcacugcuccggcuguaucaggagugugaaaaguugaaaaagcugaugagugccaacgccuccgaucucccacugaauaucgagugcuucaugaacgaccuggacgugagcuccaaaaugaaccgcgcacaguucgagcaauugugugccagucuccuggcgagggucgaacccccacugaaggccgugauggagcaggcaaaucuccagcgggaagauauuagcuccaucgagauuguaggcggcgccacccgcauccccgcagugaaggaacagauuacgaaauuuuuccugaaggacaucagcacuaccuugaacgccgaugaggccgucgcaagggggugcgcccugcaaugcgcgauccucaguccggccuuuaaagugcgggaguucuccauuacugaccugguccccuacagcaucacccugagguggaagaccaguuuugaagaugguuccggcgagugugaaguguucugcaaaaaucauccagcacccuuuagcaaggugauuacuuuccacaagaaagagccauuugaauuggaggccuucuauacgaaccuccaugagguacccuacccagacgcccgcaucgggagcuuuaccauucagaauguguucccgcaguccgauggcgacaguagcaaggucaaagugaagguccgggugaacauccacgguaucuuuuccguggcaagcgcgaguguaauugaaaaacaaaaucuggagggcgaucacuccgacgcccccauggaaacugagaccagcuucaagaacgagaauaaggauaacauggacaaaaugcaaguggaccaggaagaggggcaucagaagugucacgcagaacauaccccagaggaagagaucgaucacacuggcgccaaaacgaaguccgccgucagugacaaacaggauaggcugaaucagacccucaagaaagggaaggugaaguccauugaccugcccauccaguccagcuugugccgccagcugggucaagaucuccugaacaguuauauugagaaugaaggcaaaaugaucaugcaggacaagcuggagaaagaacggaacgaugcaaagaaugccgucgaggaauacguguaugacuucagggaucgcuuggggacuguguacgagaaauuuauuaccccagaggaccuguccaagcucagcgcgguacuggaagauaccgagaacuggcucuacgaagacggcgaggaucagcccaagcaggucuauguggacaaacugcaagaauugaagaaauacggucagccgauccagaugaaguauauggagcacgaggaacggccaaaagcccugaacgaccucggcaagaagauccagcuggugaugaaagucauugaggcauacaggaauaaggaugaacgguaugaccaucuggaucccacugagauggagaaaguggaaaaguguaucuccgacgccaugaguugguugaacagcaaaaugaaugcccaaaacaagcugucccucacgcaggaucccgugguaaaagucagcgagauuguggcaaagaguaaggaacuggacaauuucugcaacccaaucauuuacaaacccaagccaaaagccgaggugccggaagauaagcccaaagcgaauagcgagcacaacgggccaauggacggccagagcgggaccgagacuaaguccgauagcaccaaggacaguagccaacauacuaaauccaguggcgaaauggaggucgauuga

SEQ ID NO: 848 - RNA, 1965 nt, Artificial Sequence
  derived and/or modified CDS sequence (opt7) from Homo sapiens__NP_005338.1__HsHSPA5
augaagcugagccucguggccgcaaugcuguugcugcucuccgccgcgagggccgaggaagaggacaaaaaggaagaugucggcaccgugguagggaucgaccuggguacuaccuacaguugcgugggcgucuucaaaaacgggcggguggagauuaucgcaaaugaucagggcaaccgcauuacgcccagcuauguggccuuuacuccagaaggugagagguugaucggggacgcagccaagaaucaacugaccuccaacccggagaauaccgucuucgaugcgaaacggcucauuggccgcacuuggaacgaccccagugugcagcaggauaucaaguuucugccauucaagguaguggagaaaaagaccaaacccuacauccaggucgacauuggcgggggucaaacgaagacuuuugccccagaagaaaucagcgcaauggugcugaccaaaaugaaggagacugccgaggccuaucucggcaaaaaggugacccacgcagucgugaccguacccgccuacuucaaugaugcgcagaggcaggccacgaaggacgcagggacuauugccggccugaacgugaugcggaucauuaaugaaccaaccgcagccgccaucgcguaugguuuggauaaacgcgagggggaaaagaacauucuggucuuugaccucggcggcgggacuuucgaugugucccugcugaccaucgacaaugguguguuugaggucguggcaaccaacggcgacacucaucucgggggcgaagauuucgaccagaggguaauggagcacuuuaucaaauuguacaagaaaaagacggguaaggaugugcggaaagacaaucgcgccguccaaaagcugaggcgggagguggaaaaagccaagcgcgcacugagcucccagcaucaggccaggauugagaucgaaaguuucuaugagggcgaagauuucagcgagacccucacucgggcgaaauuugaggaacugaacauggacuuguuccgcuccaccaugaagccgguccagaaggugcuggaggauagcgaccucaaaaagagugauauugacgaaaucgugcugguagggggcuccaccaggauucccaaaauccaacagcuggugaaggaguuuuucaaugggaaagaaccaagccgggguaucaaccccgaugaggccgucgcauacggcgccgcagugcaggccggggucuuguccggcgaccaagacacuggugaucucgugcugcuggacguguguccacucacgcugggcauugagaccguagggggcgugaugacuaaguugaucccccgcaacaccgucgugccgaccaagaaaagucagauuuuuagcacugccuccgauaaucagcccacggucaccaucaagguguacgaaggggagaggccacugacuaaagacaaccaccuccugggcaccuucgaucugacugguauucccccagcaccccggggcgugccacagaucgaaguaaccuuugagaucgacgucaaugggauuuugagggugacggccgaggauaaggguaccggcaacaaaaauaagaucacuauuaccaacgaccaaaaucgccucacuccggaagagaucgaacggauggugaacgaugcggagaaauucgccgaagaggacaagaagcugaaagagaggauugauacccgcaaugaacuggagagcuaugcauacagucucaagaaccagaucggggacaaagaaaagcugggcgggaaauuguccagcgaggauaaggaaacgauggagaaggccgucgaggagaaaauugaauggcuggaaagucaucaggacgccgacaucgaggauuuuaaggcgaaaaagaaagaacucgaggagaucgugcagcccauuaucuccaagcuguauggcagcgcagguccacccccaaccggggaagaggacacugccgaaaaggaugagcuguga

SEQ ID NO: 849 - RNA, 1932 nt, Artificial Sequence
  derived and/or modified CDS sequence (opt7) from Homo sapiens__NP_002146.2__HsHSPA6
augcaggcccccagggagcuggcagugggcaucgaccucgggaccacuuacagcugcgucgguguguuccaacagggccggguagaaauucuggccaacgaucaggggaaucgcaccacgccauccuauguggcguuuacugacaccgagagguuggucggcgaugccgcaaagagucaggccgcacugaacccgcacaauaccguguucgacgccaaacggcucaucggucgcaaguuugcggauacuaccgugcaaagcgacaugaaacauuggcccuucagggucguguccgaagggggcaagccaaaaguacggguguguuaccgcggcgaggauaagacguuuuaucccgaagagauuaguagcaugguccuguccaagaugaaagagacugccgaagcauacuuggggcagccagugaagcacgccgugaucaccguccccgccuauuucaacgacagccagaggcaggcaacuaaagaugccggugcgauugccggccugaaugugcuccggaucaucaacgagccaaccgcagccgcaauugccuacgggcuggaccgcaggggcgccggugaacggaauguacugaucuuugaucucgggggcggcaccuucgacguguccguccugaguauugaugcggggguguuugaggugaaggcaacggccggugacacucauuugggcggggaggacuucgauaaccgccuggucaaucacuuuauggaagaguucaggcggaaacauggcaaggaccucagcgguaacaaacgcgcccugaggcggcugcgcaccgcaugcgaaagggccaagcggacuuuguccagcaguacccaagcgacccucgagaucgauucccuguucgaaggcguggacuuuuauacuagcauuacgagggcccgcuucgaggagcuguguuccgaucucuuucggaguacccuggaaccgguagagaaggcauugagggacgccaaacuggauaaggcacagauccacgacgugguccucgucgggggcagcacucgcauucccaaagugcagaagcugcugcaggauuucuuuaaugggaaagaauugaacaaguccaucaauccagacgaggccguggccuacggugcagccgugcaagcggccguacucaugggcgauaagugcgaaaaagugcaggaccugcugcuccuggacgucgcacccuugagccuggggcucgagaccgccggcggugugaugaccacucugauccagcggaacgccacgauuccaaccaagcaaacucagaccuucaccacuuacagugauaaucagcccggcgucuuuauccagguguaugagggggaaagggcaaugacgaaagacaacaaccuguugggccgcuucgagcucuccgggauuccgcccgcgccacggggcgugccccaaaucgaaguaaccuuugauauugacgccaaugguauccugagcgugacugcaaccgauaggaguacugggaaggccaacaaaaucaccauuacgaaugacaagggccggcuguccaaggaggaagucgagcgcauggugcacgaggccgaacaguacaaagcagaggaugaagcccagagggaccgggucgcggccaagaacagccucgaggcacauguguuccacgugaaagguagccugcaggaggaauccuugcgcgauaagaucccagaggaagacaggcggaaaaugcaagauaagugucgcgagguacuggccuggcucgaacauaaucagcuggccgagaaggaggaauaugagcaccagaaaagggaacuggagcagauuugccggcccaucuuuaguagguuguacggcgggccaggcguccccgggggcagcuccugugguacccaagcacgccagggggacccgagcacuggcccaauuaucgaagagguggauuga

SEQ ID NO: 850 - RNA, 1104 nt, Artificial Sequence
  derived and/or modified CDS sequence (opt7) from Homo sapiens__P48741__HsHSPA7
augcaggcccccagggagcuggcagugggcaucgaccucgggaccacuuacagcugcgucgguguguuccaacagggccggguagaaauucuggccaacgaucaggggaaucgcaccacgccauccuauguggcguuuacugacaccgagagguuggucggcgaugccgcaaagagucaggccgcacugaacccgcacaauaccguguucgacgccaaacggcucaucggucgcaaguuugcggauacuaccgugcaaagcgacaugaaacauuggcccuuccaggucguguccgaagggggcaagccaaaaguaaggguguguuaccggggcgaggauaagacguuuuaucccgaagagauuaguagcaugguccuguccaagaugaaagagacugccgaagcauacuuggggcagccagugaagcacgccgugaucaccguccccacuuauuucagcaacucccagcgccaagccaccaaagacgcaggggccauugcgggccugaaggugcucccaaucaucaaugaggccaccgcagccgcaauugccuacgggcuggauaggcggggcgccgguaaacgcaacguacugaucuuugaccucgggggcggcacguucgaugugaguguccugagcauugacgcggggguguuugaagugaaggcaacugccggugauacccauuugggcggggaggacuucgacaauaggcuggucaaccacuuuauggaggaguuccggcgcaaacauggcaaggaucucuccgguaauaagagggcccugcggcgccugaggacugcaugcgagcgggccaaacgcaccccgagcaguuccacccaggcgacuuuggaaaucgacagccucuucgagggcguggauuuuuauaaguccauuacgagggcccgguucgaagaacuguguagugaccuguuuaggagcacccucgagcccguagaaaaagcacugcgcgaugccaaguuggacaaagcacagauccacgauuucgugcuggguggcgggcuccacucccauccacagggugccgaggucgccgcaggccugcugcaacggcagggggccgaacaggagcaccaacccuga

SEQ ID NO: 851 - RNA, 1941 nt, Artificial Sequence
  derived and/or modified CDS sequence (opt7) from Homo sapiens__NP_006588.1 __HsHSPA8
augagcaagggccccgccguggggaucgaccuggguaccacuuacuccugcgucggcguguuccagcacgggaaaguagagauuaucgcaaacgaucaaggcaauaggaccacgccaaguuauguggccuuuacugacaccgaacggcucauuggugaugcggccaagaaccaggucgcaaugaauccgaccaacacuguguucgacgccaaacgccugaucgggaggcgguuugaugacgcagugguccagagcgauaugaagcauuggcccuucauggugguaaaugacgccggccgcccaaaagugcaggucgaguacaagggcgaaaccaaguccuuuuaucccgaggaagugaguagcaugguguugacgaaaaugaaggagauugcggaggccuaccuggggaaaacugucaccaacgcagugguaacugugccagccuauuucaaugauucccaaaggcaggccaccaaggacgcagguaccaucgccggccucaacguccugcggaucauuaaugaacccacggcggccgcaaucgccuacggguuggauaaaaaggugggcgcagagcgcaacgugcugauuuuugaccucggugggggcacuuucgaugucagcauccugaccauugaagacggcaucuuugaggugaaauccacugccggggacacccaccuggguggcgaggauuucgacaauaggaugguaaaccauuuuauugccgaauuuaagcggaagcacaaaaaggauaucagugagaauaaacgcgcggugaggcggcuccgcaccgcaugugaaagggccaagcggacucugagcuccagcacgcaggccaguaucgagauugacuccuuguaugaagggaucgauuucuacaccagcauuacucgcgcaagguuugaggagcugaacgccgaccucuuccggggcacccuggauccagucgaaaaagcgcugcgcgacgccaaguuggauaagucccagauccaugacauugugcucgucgguggcaguaccaggaucccgaaaauccaaaagcugcugcaggauuucuucaaugggaaagagcucaacaagagcauuaaccccgacgaagcaguggccuacggcgcagccgugcaggccgcaauccuguccggggacaaaagcgagaauguacaggauuugcugcuccuggacgugacuccacugaguuuggguauugaaacggccggcggggucaugaccgugcucaucaagcggaacacuaccauucccaccaagcaaacucagacguuuaccacuuauuccgauaaucagccaggcguccugauccaaguguacgagggugagagggcgaugaccaaagacaacaaucugcucggcaaguucgaacugacugggauucccccggcaccccgcggcgugccacagaucgagguaaccuuugauaucgacgccaacgggauuuugaaugugagcgccgucgauaaaaguacgggcaaggaaaacaaaaucaccauuacuaaugacaagggucggcuguccaaggaggauaucgaaaggauggugcaggaggccgagaaauauaaggcagaagacgagaaacagcgcgauaaggucagcagcaaaaacucccucgaaaguuacgcguucaauaugaaggccaccguggaggacgagaaacugcaagggaagauuaacgaugaagacaagcagaaaauccuggacaagugcaaugagaucauuaacugguuggauaaaaaucagacugcagaaaaggaggaauuugagcaccagcaaaaagagcucgaaaagguguguaaccccaucauuaccaagcuguaucagagcgccggcgguaugccaggcgggaugcccggcggguucccaggcgguggggccccgcccuccggcggcgcaagcagugggccaacgaucgaggaaguagacuga

SEQ ID NO: 852 - RNA, 2040 nt, Artificial Sequence
  derived and/or modified CDS sequence (opt7) from Homo sapiens__NP_004125.3 __HsHSPA9
augaucagcgccuccagggcagccgcggcccggcuggugggcgcagccgcaagucgcgggcccaccgccgcgaggcaccaggacagcuggaacggucucucccaugaggccuuccggcuggucagucgcagggauuacgcaagcgaagccauuaagggcgccgugguagggaucgacuugggcacuaccaauuccugcguggcagucauggaggguaaacaagccaaggugcuggaaaacgcggagggggcccggacgacuccaagcguggucgcauuuaccgccgauggcgaacgccucgugggcaugccggcaaaaaggcaggccguaaccaaucccaacaauacuuucuaugccaccaagcggcugauugggcgcagguacgacgauccagaggugcagaaagacaucaagaacguccccuuuaagauugugcgggcguccaauggugaugcauggguggaggcccacggcaaauuguauaguccaagccagaucggggccuucguccugaugaagaugaaagaaacggcagagaacuaccucggccauacugccaagaaugcggugaucaccguacccgccuauuuuaacgacucccaacgccaggcaacuaaagaugccggucagauuagcgggcugaaugugcugagggucaucaacgaaccaaccgcagccgcccucgcauacggccuggacaagagugaggauaaagugauugccguguaugacuugggcggggguaccuucgauaucuccauucuggagauccagaagggcgucuuugaaguaaagagcacgaauggggacacuuuccucggcggugaggacuuugaucaagcgcugcugcggcacauugugaaagaguucaagcgcgaaaccggcguggacuugacuaaagauaacauggcccuccagaggguccgggaagcagccgagaaggccaaaugugagcuguccaguagcgugcagaccgacaucaaucugccguaccucaccauggauuccagcgggcccaagcaucugaacaugaaguugacucgcgcacaguuugaaggcaucgucacggaccugauuaggcggaccaucgcgccaugccaaaaagccaugcaggaugcagaggugaguaaguccgacauuggggaagugauccucguagguggcaugacuaggaugcccaaagugcagcaaaccguccaggaucuguucgggcgcgccccaagcaaggccgugaaccccgacgaggcagucgccauuggcgcggccauccaggguggcgugcuggcaggggaugugaccgacguauugcuccuggacgugacuccgcugagucucggcaucgaaacgcugggcggggucuucaccaaauugauuaaucggaacacuaccauccccaccaagaagucccagguguuuagcacugccgccgauggucaaacgcaggucgagauuaaagugugucagggggagagggaaauggcaggcgacaauaagcugcucggucaguucacccugaucggcauuccacccgccccacgcggggugccccaaaucgagguaacuuuugauaucgacgcgaacggcauuguccacgugagcgccaaagauaaggggaccggccgggaacagcagaucgugauucaguccaguggugggcugagcaaagacgauaucgagaauauggucaagaacgcagaaaaguacgccgaggaggacaggcgcaaaaaggaacggguggaggcagugaauauggccgaaggcauuauccacgauacugagaccaaaauggaggaguucaaggaccaauugccagcggaugaaugcaacaaacucaaggaagagauuuccaaaaugagggaacugcuggcccggaaggacagcgagacgggcgagaauauccgccaggcagccaguucccuccagcaggccagccugaaguuguuugaaauggcauauaaaaagauggccuccgagagggaagggagugguagcuccggcaccggggagcaaaaagaagaucagaaggaggagaaacaguga

SEQ ID NO: 853 - RNA, 2028 nt, Artificial Sequence
  derived and/or modified CDS sequence (opt7) from Homo sapiens__NP_079291.2__HsHSPA12A
auggccgacaaggaggcaggcgggagcgauggucccagggaaaccgccccaacuuccgcguacaguagcccggcccggucccugggcgacaccgggaucacgccccucaguccaagccacauugugaacgauacugacuccaaugucagcgagcagcaauccuuccuggugguaguggcagucgauuuuggcaccaccaguagcgguuaugccuacuccuucacuaaagaacccgagugcauccaugugaugaggcgcugggaagggggcgacccaggcgugagcaaccagaagacccccacgacuauuuugcugaccccagagcggaaauuucacaguuucggguaugcagcccgcgauuuuuaccaugaccucgauccgaaugaggcgaagcaguggcuguauuuggaaaaauucaagaugaagcugcacacuaccggugaccucaccauggauacggaccugacugccgcaaacggcaaaaaggucaaagcccuggagaucuuugccuacgcacuccaguauuucaaggaacaagcccugaaagaguuguccgaucaggcggggagcgaguuugaaaauuccgacgugagguggguaauuaccgugcccgccaucuggaagcagccagcaaaacaguucaugcggcaagccgcauaccaggccggccuggccagucccgagaacagcgaacagcucaucauugcgcuggagccagaagcagccuccaucuacugucgcaagcugagguugcaucagaugauugagcucagcaguaaggccgcagucaaugguuauuccgggagcgacacugugggcgccggcuuuacccaagcgaaagagcacauccggcgcaacaggcagagucggaccuuccugguggaaaaugucauuggggagaucugguccgaacuggaggaaggugauaaguacgugguaguggacagcggcgggggcacugucgaucucacggugcaccagauucgccugcccgagggucauuugaaagagcuguauaaggccaccggcgggccguacggcagccucgggguggacuaugaguucgaaaaacugcuguacaagaucuuuggugaagauuucaucgagcaauuuaagauuaaaaggcccgcagccugggucgacuugaugaucgcauucgaaucccggaagcgcgccgccgcaccagauaggacuaacccccucaauauuacccugccauuuaguuucaucgacuauuacaaaaaguuucggggccacagcguggagcaugcccugcgcaaauccaacguagauuucgugaaguggagcagucaggggaugcucaggaugucccccgacgcgaugaaugcccuguuuaagccaaccauugauagcaucaucgagcacuugcgggaccuguuccagaaaccggaagucuccacugugaaguuucucuuccuggucggcgguuuugcagaggcaccccuguugcagcaagccgugcaggccgcguucggcgaccagugcaggauuaucauuccacaggauguggggcucacgauccugaaaggcgccguacuguucgggcucgaccccgcagugauuaagguccgccggaguccacugaccuacggcgugggugucuugaacagguauguggaagggaaacaucccccggagaagcugcucgugaaggauggcacucgcugguguaccgacguauuugauaaauucaucagcgccgaccaauccguggcccugggugagcuggucaagcggagcuacaccccagcaaaacccagucaguuggugaucgucauuaauaucuauuccagcgaacacgauaacguguccuuuauuacugaccccggcgugaagaaaugcgggacgcugaggcucgaucugaccggcaccagugggacugccguaccagcgcgccgggagauccagacucucaugcaguucggcgacaccgaaauuaaggccacggcaaucgauauugccaccagcaaauccgucaagguggguaucgacuuucugaacuacuga

SEQ ID NO: 854 - RNA, 2061 nt, Artificial Sequence
  derived and/or modified CDS sequence (opt7) from Homo sapiens__NP_443202.3 __HsHSPA12B
augcuggccgugcccgagaugggccuccaggggcuguacaucgguagcuccccagaaaggaguccgguccccagcccacccggcuccccacggacccaagagaguugcgggauugcacccuugacuccaagccaguccccgaagcccgaagugcgcgccccacagcaggcgagcuucuccguaguggucgccaucgacuuuggcaccacgaguagcgguuaugcauucuccuuugccagcgaucccgaggcaauucacaugaugaggaaaugggaagggggcgacccaggcguggcccaucaaaagacucccaccugucugcuccugaccccggagggggcguuccacaguuuugguuacacugcccgggauuauuaccaugacuuggaucccgaggaagcacgcgacuggcuguauuucgagaaauuuaagaugaaaauccacuccgccaccgaucucacgcugaagacucagcuggaagccgugaacggcaagaccaugccagcacucgaggucuucgcccaugcgcugagguuuuuccgggagcacgccuugcaggaacugcgcgagcagagccccucccucccagaaaaagacacugugagguggguacugaccgugcccgcaauuuggaagcaaccagccaaacaguuuaugcgggaggcagccuaccuggccggguuggucagucgcgaaaaugcggagcagcuccugaucgcacuggagccggaagccgccagcguguauugcaggaagcuccggcugcaccaguugcuggaucucuccggccgcgcacccggugggggcaggcugggcgagcggcgcagcaucgacaguuccuucaggcaagcccgggaacagcugcgcaggagccggcauaguaggaccuucuugguggaguccggggucggugaacucugggcggagaugcaggccggcgaucgcuacgugguagcagacugugggggcgguacgguggaucugacuguccaccaacuggagcagccacauggcacccucaaagaacuguacaaggccagcgggggccccuauggggcaguggguguggacuuggccuuugagcagcugcucugccggauuuucggcgaagacuuuaucgccacuuucaaaaggcagcgcccagcagccugggucgaucugaccauugcguuugaggcccggaagaggaccgcagggccccaccgcgccggcgcccugaacaucagcuugccguucuccuuuauugacuucuaccggaagcaaaggggucacaauguggaaacugcacuccggcgcaguagcguaaacuuugugaaaugguccagccagggcaugcugaggaugaguugugaggcgaugaaugagcuguuccagccaacggucuccgggaucauucagcauaucgaagcccuccuggcacggcccgaggugcaaggcgucaaguugcuguuucucguagggggcuucgccgaaagcgccgugcugcagcacgcagugcaggccgcgcugggugcccgcggguugaggguggucgugccccaugaugucggccugaccauccucaaaggugcagugcuguuuggccaggccccaggggugguacgggugcgcaggaguccccucacuuauggcgucggggugcugaaccgguucgucccaggcaggcacccgcccgagaaguugcuggugcgcgacggucggagguggugcaccgauguguucgagcgcuuuguagccgcagaacaauccgucgcccucggggaggaagugcggaggagcuacuguccagcgcgccccggccagcggagggugcugauuaaucuguauugcugugccgcagaggacgcccgcuucaucaccgauccaggcguccggaaaugcggggcauugucccuggaacucgagcccgccgacugcggucaggauacugcgggcgccccgccagggaggcgcgagauucgggcagccaugcaguuuggcgacacggaaaucaaggugaccgccguggauguaagcacuaacaggaguguccgcgcauccauugacuuccugagcaauuga

SEQ ID NO: 855 - RNA, 1416 nt, Artificial Sequence
  derived and/or modified CDS sequence (opt7) from Homo sapiens__NP_008879.3__HsHSPA13
auggccagggagaugaccauccugggcagcgcagugcucacucuguugcuggccggguaccucgcgcagcaauaucugcccuugccaaccccgaaggucauugguaucgaccugggcacgacuuacugcuccguggggguauucuuucccggcaccgguaaagugaaggucauuccagaugaaaacgggcacaucaguauucccagcaugguguccuucaccgacaaugauguguaugucggcuacgagaguguggaacucgccgacagcaacccacagaauacuaucuaugaugcaaaacgguuuaucggcaagauuuucaccgccgaggaacuggaggcagagaucgggcgcuaccccuuuaaaguacugaacaagaaugguaugguggaguucuccgucacgagcaacgaaacuauuaccguguccccagaauaugugggcaguaggcuccuguugaagcugaaagagauggccgaggcguaccucgggaugccggucgccaaugcagugaucagcguacccgccgaauuugaccugaagcagcggaacuccacuauugaggccgcaaaucuggccggcuugaaaauccuccgcgugauuaacgaaccaaccgcggccgcaauggccuacggucugcauaaggcagaugucuuccacgugcuggugaucgaccucgggggcggcacccuggaugucagcuugcugaauaaacaaggggguauguuucucacgagggccaugaguggcaacaauaagcucgggggccaggacuucaaccagcggcuguugcaguaucucuacaaacagaucuaucaaacuuacgguuuugugcccucccgcaaggaggaaauucauaggcugcggcaggccguagagauggugaagcugaaucucacccugcaccagagcgcgcaguuguccguccugcucacuguggaggaacaagaucgcaaagagccacauaguagcgacaccgaacugcccaaggauaaacuguccagcgcagacgaccacagggucaacaguggcuucgggcggggcuuguccgauaagaaaagcggggagagucaggugcuguucgaaaccgagaucucccgcaagcuguuugacacucugaacgaggaucucuuccagaagauucuggugccgauccaacagguauugaaagaaggucaccuggagaagacggaaauugacgaggugguccucgugggcgggagcaccaggaucccccggauccgccaggucauucaggaauuuuucggcaaagauccaaauacuagcguggaccccgaucuggccgugguaaccgguguggccauccaagcaggcauugacgggggcuccuggccacugcaggucagugccuuggagauccccaacaagcaucugcagaaaaccaauuuuaacuga

SEQ ID NO: 856 - RNA, 1530 nt, Artificial Sequence
  derived and/or modified CDS sequence (opt7) from Homo sapiens__NP_057383.2__HsHSPA14
auggccgcaaucggcgugcaccuggggugcaccagcgccugugucgcgguguacaaggacgguagggccggcguaguggcaaacgaugccggggaccgggucacucccgcagugguggccuauuccgagaaugaagagauugucggccucgcggccaaacagagucgcaucaggaacauuagcaauaccgugaugaagguaaaacaaauccugggucgguccaguagcgauccacaggcacagaaguacauugccgaauccaaaugcuuggugaucgagaagaacgggaagcugcgcuaugaaaucgacacgggcgaggagacuaaauucgucaauccggaagauguggccaggcucauuuuuagcaagaugaaagagaccgcacauuccgugcugggcagugacgccaacgaugucgugaucaccguacccuucgacuuuggggaaaagcagaaaaaugcguugggugaggccgcacgggccgcaggcuucaacgugcugcgccucauucacgagccaagcgccgcccugcuggcguacgggaucggccaagauucccccacugguaagagcaauauucucgucuuuaaacugggcgggaccaguuugucccugagcgugauggaagugaacuccggcaucuauaggguccucaguacgaauacugacgauaacauugggggugcacauuucaccgagacucuggcccaguaccuggccagcgaauuucagcgguccuucaagcacgacgugcgcggcaaugcaagggccaugaugaaguugaccaacagcgcggagguagccaaacauagucucuccacccuggggagcgcaaauuguuuucuggauagucucuaugaaggccaggacuucgacugcaacgugucccgggcccgcuuugagcuguuguguagcccacuguucaacaagugcaucgaggcaaucaggggucuccuggaucaaaauggcuucacggccgacgauauuaacaaagucgugcugugugggggcagcucccggauccccaaguugcagcagcucauuaaagaccuguuuccagccgucgaacugcucaauaguaucccgcccgaugaggugauuccaaucggggcagccaucgaagcggguauucugaucggcaaggagaacuugcugguggaagacagccucaugauugagugcuccgcccgcgauauccugguaaaggggguggacgagagcggcgcaaguagguucacuguccuguuucccuccgguaccccauugcccgcccggcgccagcacacucuccaagccccgggcagcauuuccagugugugucuggaacuguacgagagcgaugggaaaaauuccgcaaaggaagagaccaaauucgcgcaggucgugcuccaggaccuggauaagaaagaaaacggcuugagggacauccuggccgugcucaccaugaagcgggacgggagccugcacguaacuugcacggaucaagagaccggcaagugcgaggcaaucaguauugaaaucgccuccuga

SEQ ID NO: 857 - RNA, 2577 nt, Artificial Sequence
  derived and/or modified CDS sequence (opt7) from Homo sapiens__NP_006635.2 __HsHSPH1
augagcguggucggccuggacguggggucccagaguugcuacaucgccguagcaagggccgguggcauugaaaccaucgcgaacgaguucagcgaucgguguacucccuccgugauuaguuuugggagcaagaaucgcaccaucggcgucgccgccaaaaaccaacagauuacgcacgcaaauaacacuguguccaauuucaagagguuucauggucgggcauucaacgacccauuuauccagaaagagaaggaaaaucucagcuaugaucuggugccguugaaaaacgggggcgucggcaucaaggugauguacaugggggaggaacaccuguucuccguagagcagauuaccgccaugcuccugaccaaguugaaagagacugcggaaaauagucugaagaaacccgugaccgacugcgucaucagcgugccauccuuuuucacggaugccgagcgcaggagcgugcucgacgcagcccaaauugucggucugaacugucugcggcucaugaaugauaugacugccguggcacugaacuauggcaucuacaagcaggacuugcccagucuggaugaaaaaccacgcauuguaguguuugucgacauggggcauuccgccuuccaggugagcgcgugcgccuuuaauaagggcaaacucaaggugcuggguaccgcauucgaucccuuccugggcgggaagaacuuugacgagaaauuggucgagcacuucugugccgaauuuaagacuaaauauaagcucgaugcaaaauccaagaucagggcccugcugcggcucuaccaggagugcgaaaagcugaaaaaguugaugaguagcaauuccaccgaccugccacucaacauugaguguuucaugaacgacaaagaugugagcggcaagaugaaucgcagucaauuugaagaacugugcgccgagcuguugcagaaaaucgaaguaccgcucuauucccugcuggagcagacccaucucaagguggaagacgucagcgcgguggagaucgucgggggugcaacgaggauucccgccgugaaggaacggaucgccaaauucuuuggcaaggauauuaguacuacccugaacgcagacgaggccguggcgcgcgggugugccuugcagugcgcaauccuguccccagccuucaaaguaagggaguuuagcgugacugaugcaguccccuucccaauuagccucaucuggaaucacgacuccgaagauaccgagggcgugcacgaagucuuuagucggaaccaugccgcccccuucagcaaggugcugaccuuucugcgcagggguccguucgaguuggaagcauucuacuccgacccccaaggcgugccauaccccgaggccaaaaucgggcgguuuguagugcagaaugucagcgcgcagaaggauggcgagaagagucgcgugaaagucaaggugagggugaacacucacgggauuuucacgaucuccaccgccagcaugguagaaaaagucccaacugaggaaaaugagauguccagugaggcagacauggaaugccucaaccaacggcccccagagaauccggauaccgacaagaacgugcagcaggacaauagcgaagccgguacccagccccaagugcagacugaugcccagcagacgucccaaagcccacccaguccagagcugaccuccgaagagaacaaaauucccgacgcagauaaggcgaaugagaaaaaggucgaccagccgccagaagccaagaaacccaagaucaaaguggugaacguagagcugcccauugaagcaaaucucgucuggcagcugggcaaggauuugcugaacauguauaucgagacugaagggaaaaugaucaugcaggacaagcucgagaaggagaggaacgaugccaaaaaugccguggaagaguacguguaugaauuucgcgacaagcuguguggcccauacgagaaauucauuugcgaacaagaucaucagaacuuucugcgguugcugaccgagaccgaggacuggcucuaugaagagggugaagaucaggcaaagcaggccuacgucgacaaacuggaggagcucaugaagaucggcacucccgugaagguaagguuccaagaagcggaggaacgcccaaaaauguuugaggaacuggggcagcgguugcagcacuaugccaagauugcagccgauuucaggaauaaagacgagaaguacaaccacaucgacgagagcgaaaugaaaaagguggagaaauccgucaaugaagugauggaguggaugaacaaugugaugaacgcccaagcaaagaagagucuggaucaggacccggucgugcgcgcccaggaaauuaaaacgaagaucaaagagcucaauaacaccugugagcccguagugacucagccaaagcccaaaauugaaagcccaaagcuggagcggacccccaauggcccgaacaucgauaagaaagaagaggaccuggaggauaagaauaacuuuggggcggaaccaccccaucaaaauggcgagugcuacccaaacgagaaaaacuccgucaauauggacuuggauuga

SEQ ID NO: 858 - RNA, 3000 nt, Artificial Sequence
  derived and/or modified CDS sequence (opt7) from Homo sapiens__NP_006380.1 __HsHYOU1
auggccgacaaggugaggcggcagcgccccaggcggcgcgucugcugggcacugguggccguacuccuggcggauuugcuggcccucagcgacacccuggcagugauguccgucgauuugggcagugagagcaugaaaguggccaucgugaagccaggggucccgauggaaauugugcugaacaaagaguccaggcggaagacucccguaaucgugacccucaaagaaaaugagcgcuucuuuggugacagugcagccagcauggcgauuaagaacccaaaggccacgcugagguacuuccaacaucugcucggcaaacaggcagauaauccccacgucgcccuguaucaggcccgguuuccagaacacgaguugacuuucgacccccagcgccaaaccgugcauuuucagaucuccagccagcugcaguucuccccagaggaagugcucgggaugguccugaacuacaguaggagccuggcagaggauuuugccgaacaaccgauuaaggacgcggugaucaccguacccguguucuuuaaucaggccgagcggcgcgcagucuugcaggccgcaaggauggccggccucaaagugcugcagcugaucaacgauaauacugccaccgcgcucuccuaugguguguuccggcgcaaggacauuaacacgacugcacaaaauaucauguuuuacgauauggggagcggcaguaccgucuguacuauugugaccuaucagaugguaaaaaccaaggaggccggcaugcagccacaacugcagaucaggggugugggguucgaccggacguugggcgggcuggaaauggagcuccgccugagggaacggcuggccggcuuguucaacgagcagaggaaaggucagcgcgcaaaggauguccgggaaaaucccagggccauggcgaagcuccugcgcgaggccaaccggcugaaaacugugcucuccgcaaaugccgaccacauggcacaaauugaggggcugauggacgaugucgacuuuaaggccaaagugaccaggguggaguucgaggaauugugcgccgaucuguuugagcgcguaccaggccccgugcagcaggcacuccagagcgccgaaaugucccuggacgagaucgagcaagucauucuggugggcggggcgacucgggucccgagggugcaggaaguguugcucaaggccguagguaaagaggaacugggcaagaacaucaaugcagaugaggccgccgcaaugggggcgguguaccaggccgcagcccugaguaaggccuucaaagucaagcccuuugugguccgggacgcagugguguauccaauccucguagaguucacccgcgaggucgaggaagaacccggcauucauagccugaaacacaacaagaggguguuguuuucccggauggguccauacccccagcgcaaagugaucaccuucaacagguacagccacgauuuuaauuuccauauuaacuauggcgaccugggguuucucggcccagaagaucugcgggucuucgggagucaaaaucugacuacggugaaguugaagggugugggcgacuccuuuaaaaaguacccggauuaugagagcaaagggaucaaggcccacuucaaccuggacgagaguggcguacucucccuggaccgcgucgaaagcguguucgagacccucguggaagauagcgcggaggaagaguccacucugaccaaauuggguaauaccauuaguagccuguuuggcgggggcacuacgcccgacgccaaggagaacgggaccgauacuguccaggaagaggaagaguccccagcagaaggcagcaaggacgagcccggugaacagguggaacucaaagaggaagccgaggccccaguagaagaugggagucagcccccgccacccgagcccaagggcgacgcaaccccagagggugaaaaagccaccgagaaggaaaauggcgauaaauccgaggcgcaaaagcccagcgagaaagccgaagcagggccagagggcguggccccggcacccgaaggggagaagaagcagaaaccagccaggaagcggaggauggucgaagagaucggcguggagcuggugguccuggacuugcccgaucugccagaagacaaacucgcgcaguccgugcaaaagcugcaggaucucacucugcgcgacuuggagaaacaggaacgggagaaggccgcaaacagucuggaagccuucaucuuugagacgcaggauaagcuguaccaacccgaguaucaggaaguaagcaccgaggaacagagggaggagauuuccgguaaacucagcgccgcaaguacuuggcuggaagacgagggggugggcgccaccacugucauguugaaggaaaaacuggcggagcuccgcaagcugugucagggccucuucuuucggguggaagagaggaaaaaguggccggagcgccuguccgccuuggacaaucugcugaaccauagcuccauguuccucaagggggcacggcugaucccagaaauggaucaaauuuuuaccgagguggaaaugacgaccuuggagaaagucaucaaugaaacuugggccuggaagaacgcaacccuggccgagcaggccaaacuccccgcaacugagaagccagugcugcugaguaaagacauugaagcgaagaugauggcccucgauagggagguacaguaccuguugaauaaagccaaguucaccaagccccgcccgcggcccaaagacaagaacgguacgagggcagaaccaccccugaaugccagcgcauccgaucagggcgagaaagugaucccacccgccgggcaaaccgaagacgcggagccaaucagcgagccggaaaaggucgagacuggcagugaacccggugauaccgagccacucgagcugggcgggcccggcgccgaaccagagcagaaagaacaguccacugggcaaaagcgccccuugaagaacgacgagcuguga

SEQ ID NO: 859 - RNA, 2199 nt, Artificial Sequence
  derived and/or modified CDS sequence (opt7) from Homo sapiens__NP_005339.3 __HsHSP90AA1
augcccgaggaaacccagacucaagaccagccaauggaggaagaggaaguggagaccuucgccuuucaggcagagaucgcccagcugaugagccucauuaucaacacguucuacuccaauaaggaaauuuuucugagggaguugaucaguaacagcuccgaugcgcuggacaaaauucgguaugaaagucucacugauccgagcaagcuggacuccggcaaagaguugcacaucaaucugauccccaacaagcaagaucgcacccucaccauugucgacacugggaucgguaugaccaaagccgaucugauuaauaaccugggcacgaucgcaaagagcgggacuaaggccuucauggaggcacuccaggccggcgcggacauuuccaugaucggucaguuuggggugggcuucuacagugccuaucugguagcagaaaaagugaccgucauuacuaagcauaaugaugacgagcaguacgccugggaaagcuccgccggcgggagcuuuaccgugaggaccgauacgggugagccaaugggccgggggacuaaagugaucuugcaccugaaggaagaccaaaccgaguaucucgaggaacgcaggaucaaagagauugucaagaaacauagucaguucaucggcuaccccauuacucuguuuguggaaaaggagcgggauaaggaaguauccgacgacgaggcagaggaaaaagaggauaaggaagaggaaaaagagaaggaggaaaaagagagcgaagacaagccagagaucgaggauguggguuccgacgaagaggaagagaagaaagauggggacaagaaaaagaaaaagaagauuaaagaaaaguauaucgaucaggaggagcugaacaaaaccaagcccaucuggacccgcaauccagacgauauuacuaacgaagaguacggcgaguucuacaaaaguuugacgaaugacugggaggaucaccucgccgucaagcauuuuagcguggaaggccagcuggaguucagggcgcuccuguucgugccgcggcgcgcccccuuugaccuguucgagaacaggaagaaaaagaauaacaucaaauuguauguccggcgcguguuuauuauggacaauugcgaagaacugaucccagaauaccucaacuucauuagggguguaguggauuccgaggaccugccccugaacaucagccgggaaauguugcaacagaguaagauccucaaagucauucgcaagaaucuggugaaaaagugucuggagcucuuuaccgagcuggcagaagauaaggagaacuauaaaaaguucuacgaacaguuuuccaaaaauaucaaguuggggauucacgaggacagccaaaacaggaaaaagcugagugagcuccugcgguauuacacuuccgccagcggcgaugaaauggugagccugaaggacuauugcacccgcaugaaagagaaucagaagcacaucuacuacauuaccggggaaacuaaagaucaggucgcaaacuccgccuucguggagagguugcggaagcauggccucgaaguaaucuauaugauugagccaaucgacgaguacugugugcagcaacugaaagaauuugaggguaagacgcuggucagugugaccaaggaaggccucgagcugcccgaagaugaggaggagaaaaagaaacaggaagaaaagaaaacuaaguucgagaauuugugcaaaaucaugaaggacauucuggagaagaaagucgaaaagguggugguaagcaacaggcucgugaccuccccguguugcaucgucaccagcacuuauggguggacggccaauauggagcgcauuaugaaagcgcaggcacugcgggauaacaguaccaugggcuacauggccgccaagaaacaccuggaaaucaaucccgaccauuccauuaucgagacuuugaggcagaaggcagaagccgauaagaacgacaaaagcgugaaggaccuggucauccuccuguaugagaccgcgcuccuguccaguggguuuagcuuggaggauccacaaacucacgccaaucgcauuuaccggaugaucaaacugggucucggcauugacgaagaugaccccaccgcagaugacacguccgccgcagugaccgaggaaaugccaccccuggagggggaugacgauacuagcaggauggaagagguggacuga

SEQ ID NO: 860 - RNA, 339 nt, Artificial Sequence
  derived and/or modified CDS sequence (opt7) from Homo sapiens__NG_005218__HsHSP90AA3P
auggacagcuccaagcuggauaguggcaaagggcuccacaucaaccuggugcccaauaagcagaaccaaaccuugacuauugucgacaccaggaucgguaugacgaaaacugaucugauuaauaaccucggcaccgugaccaagagcgggacuaaagccuucauggaggcacugcaggccgacgcggauaucuccaugauuggccauuuugguguaggguucuacagugccuauuugguggcaaagaaggucaccgugaucagcaaacacaauaacgacgaacaguacacgugggaguccagcgccggcggcuccuuuacugugcggaccgaugaauga

SEQ ID NO: 861 - RNA, 2175 nt, Artificial Sequence
  derived and/or modified CDS sequence (opt7) from Homo sapiens__NP_031381.2__HsHSP90AB1
augcccgaggaagugcaccauggcgaggaagaggucgaaaccuucgccuuucaggcagagaucgcccaacugaugagccucauuaucaacacuuucuacuccaauaaggagauuuuucugagggaauugaucaguaacgcgagcgacgcccuggauaaaauucgguaugagucccucaccgacccaaguaagcuggauagcgggaaagaauugaagaucgacaucauuccgaauccccaggagcgcacgcugacucucguggauaccgguaucggcaugaccaaagcagaccugauuaacaaucuggggacuaucgccaaguccggcaccaaggcauucauggaggcccuccaggcgggugccgauauuagcaugaucgggcaguuuggcguaggcuucuacuccgcauaucugguggccgaaaaagucguggugauuacgaagcacaacgacgaugagcaauacgccugggaaaguagcgcaggggguuccuuuacugucagggccgaccauggcgagccaaucgggcggggcaccaaagugaucuugcaccugaaggaagaucagacugaguaucucgaggaacgcaggguaaaagagguggucaagaaacauagccaguucauugguuaccccaucacccuguaucuggaaaaggagcgggaaaaggagauuagugacgaugaggcggaagaggaaaaaggggagaaggaagaggaggacaaagacgaugaagagaagccaaaaaucgaagacgugggcuccgaugaggaggacgauagcggcaaggacaagaaaaagaaaaccaagaaaauuaaggaaaaguacaucgaucaggaggaauugaauaaaacgaagcccaucuggacucgcaacccagacgauauuacccaagaggaauacggggaguuuuauaaaucccucacuaaugacugggaggaucaccuggccgugaagcacuucagugucgaaggucagcuggaguuuagggcacuccuguucaucccgcggcgcgcccccuucgacuuguuugaaaacaaaaagaagaaaaauaacauuaagcuguacgugaggcggguauucaucauggacagcugcgaugagcucauuccagaauaucugaauuuuauccgcggcguggucgacuccgaggaucugcccuugaacaucagcagggagaugcuccagcagaguaaaauucugaaggugauccggaaaaauauugugaagaaaugucuggaacucuucuccgagcuggcagaagacaaggagaacuacaagaaauuuuaugaagccuucagcaagaacuugaaacuggggauccaugaggauaguaccaaucgcaggcggcucuccgagcugcugcgcuaccacaccagccaaagcggcgacgaaaugacuuccuugagugaguaugucagcaggaugaaggaaacgcagaaauccauuuacuacaucaccggugagagcaaggaacagguggccaacagugcguuuguagagcgggugaggaagcgcggcuucgaggucguguauaugacugaaccaauugaugaguacugcguccaacagcucaaagaauuugacgggaagucccuggugagcgugaccaaagagggccuggagcuccccgaagaugaggaagagaagaaaaagauggaagaguccaaggcaaaauucgagaaucuguguaaguugaugaaagaaauccuggacaagaaaguagagaaggugaccaucaguaaccggcucgucagcuccccgugcuguauugugacuagcacguauggguggaccgccaauauggaaaggaucaugaaagcccaggcacugcgcgauaacaguacuauggguuacaugauggccaagaagcaucuggagauuaaucccgaccacccaaucgucgagaccuugcggcagaaagcggaagccgauaagaacgacaaagcagugaaggaccuggugguacuccuguuugagaccgcccuccuguccagcggcuucuccuuggaagauccccaaacucacaguaauaggauuuaucgcaugaucaaacuggggcucggcaucgacgaggaugaaguggcagccgaggagccaaacgccgcaguccccgacgaaauuccaccgcuggagggugaugaagacgccagccggauggaggaaguggauuga

SEQ ID NO: 862 - RNA, 2412 nt, Artificial Sequence
  derived and/or modified CDS sequence (opt7) from Homo sapiens__NP_003290.1__HsHSP90B1
augagggcccugugggugcucggccugugcugugucuugcugaccuucgggagcgugcgggcagacgaugagguagacguggaugguacugucgaagaggaccucggcaagucccgcgaagggaguaggaccgaugacgagguggugcagcgggaagaggaggccauccaacuggauggcuugaacgcgagccagauucgcgaacugagggagaaauccgaaaaguuugccuuccaggcagaggucaaucggaugaugaaacucaucauuaacagucuguacaagaauaaagagaucuuucugcgcgaacucauuagcaacgccuccgacgcacuggauaagaucagguugaucagccugacggacgagaaugcccucuccgguaacgaagaacugacugugaagauuaaaugcgauaaggagaaaaaucuguugcacguaaccgacaccggggugggcaugacucgggaggagcucgucaagaaccugggcaccaucgcgaaaagugggacgagcgaguuccugaauaagaugacugaggcccaggaagauggucaauccaccagcgagcucauuggccaguuuggggugggcuucuauagugcauuucugguggccgacaaagucaucgugacuuccaagcauaacaaugacacccagcacauuugggaaagcgauuccaacgaguucaguguaaucgccgacccccgcgguaauaccuuggggaggggcacgacuauuacccuggugcucaaggaggaagcaagcgauuaccuggagcuggacacuaucaaaaacuuggucaagaaauauucccaguuuaucaauuucccaauuuacguguggagcaguaagaccgaaaccguggaggaaccgauggaggaggaagaggccgcgaaagaagagaaggaggaauccgaugacgaggccgcagucgaagaggaagaggaggaaaagaaacccaagacuaaaaagguggagaaaacgguaugggauugggaacucaugaacgacaucaagccaauuuggcaacggcccagcaaggagguggaagaggaugaguauaaagccuuuuacaagaguuucuccaaagaaagcgacgauccaauggcauauauccauuucaccgccgagggcgaagucacuuuuaagagcauucuguucgugcccaccuccgccccacgcgggcuguuugacgaguacgguaguaaaaagagcgacuacaucaagcucuaugucaggcggguguucaucaccgaugacuuucacgauaugaugccgaaauaccugaacuucgugaagggcguaguggacuccgaugacuugccccugaaugucagccgcgaaacucuccagcagcauaaacugcugaaggugauuaggaaaaaguugguccggaaaacgcucgauaugaucaagaagauugcggacgauaaauauaacgacaccuuuuggaaggaguucgggacuaauaucaaacugggcgugauugaggaucacaguaaccgcaccaggcuggcaaagcuccugcgguuucaguccagccaccauccaaccgacaucacuuccuuggaucaauacguggaaaggaugaaagagaagcaggacaagaucuauuucauggccgguaguagccgcaaagaagccgaguccagccccuuuguagagcggcugcucaagaaaggcuacgaagugauuuaucugacggagccagucgacgaauacuguauccaggcacugcccgaguucgaugggaagagguuucaaaauguggccaaagaaggcgucaaguucgacgagagugagaagaccaaagaaucccgcgaggcgguggaaaaggaguucgaaccguugcugaacuggaugaaagauaaggcccucaaagacaagauugagaaagcagugguaagccagcggcugacugagucccccugcgcccucgucgcaagucaguacggguggagcgguaauauggaaaggaucaugaaggcccaggccuaucaaaccggcaaggauauuuccacuaacuacuaugcaagccagaaaaagaccuuugagaucaauccacgccacccccugauucgggacauguugaggcggaucaaagaagaugaggacgauaagacggugcuggaccucgccgugguccuguucgagaccgcgacucugcgcaguggguacuugcugccagauaccaaagccuauggcgacaggaucgaacggaugcuccgccugucccucaacauugaccccgaugcaaagguggaggaagaaccagaagaggagccggaagagacugccgaagacaccacggaggauaccgaacaggacgaggaugaggaaauggacguggguacugaugaggaagaggaaaccgccaaggagagcacugcagagaaagacgaacuguga

SEQ ID NO: 863 - RNA, 2115 nt, Artificial Sequence
  derived and/or modified CDS sequence (opt7) from Homo sapiens__NP_057376.2__HsTRAP1
auggccagggagcugcgggcacuccuguuguggggccgcaggcugcggccccuccugcgcgccccagcguuggccgcagugcccggggguaagccgauccugugcccaaggcggaccacugcccagcucggcccccgcaggaacccagcauggagccugcaagccgggcggcuguucuccacccagacggcggaagacaaagaggaaccccuccacaguauuaucagcuccacugagaguguccagggcagcaccuccaagcaugaauuucaggccgagaccaaaaagcuguuggauauuguggcacgcagccuguacuccgagaaagaaguauucaucagggagcucauuaguaaugccagcgacgcccuggaaaagcugcggcacaaguugguguccgauggucaagcacucccagagauggagauccaucugcagacuaacgccgaaaaagggaccaucacgauucaggacacuggcaucggcaugacccaggaggaacuggucagcaaucucgggacuauugcgcgcagugguuccaaggccuuucuggaugcauugcaaaaccaggccgaggcaagcuccaaaaucauuggccaguucggggugggcuuuuauagugccuucaugguggccgacagggucgaaguguacagccgguccgcggcaccggguagccugggguaucaguggcucagugauggcuccggcguauuugagaucgccgaggccagcggggugcgcaccgguaccaagauuaucauccaccugaaaagugacuguaaggaguucuccagcgaggcaaggguccgggauguggugacgaaauacagcaauuuugucuccuucccccuguauuugaacggccgcaggaugaauacucuccaagccauuuggaugauggacccaaaggaugugcgggaauggcagcaugaggaauuuuacagguauguagcgcaggcccacgacaagccccgcuacacccugcacuacaaaacugaugcaccacugaacauccggaguauuuucuaugugcccgacaugaagccgagcauguucgacgucuccagggagcucgggagcaguguggcccuguacucccgcaaaguguugauccaaaccaaggcaaccgauauucugcccaaauggcuccgguuuaucaggggcgucguggacagcgaggauaucccacugaaucugucccgcgaauugcuccaggagagugcccugauucggaagcugagggacguacuccagcagcggcugaucaaguucuuuauugaucaaagcaaaaaggacgccgaaaaauaugcaaaguucuuugaggauuacgguuuguucaugcgcgaaggcaucgugacugccacggagcaggaggucaaagaagacauugcgaagcugcucagguaugaguccagcgcccugcccagugggcagcugaccuccuugagcgaauacgcaucccggaugcgcgccggcacuaggaacaucuauuaccugugcgccccaaaucggcaucucgcagagcacagucccuacuaugaggcgaugaagaaaaaggauaccgaagugcuguuuuguuucgagcaguuugacgaacucacccuguugcaucugcgcgaguucgauaaaaagaaacucaucagcgucgaaacugacauugugguggaccacuacaaggaggagaaguuugaagauagguccccagccgcagagugccugagcgaaaaagagacggaagaacugauggccuggaugcggaacguauuggggaguagggugaccaaugucaaggugacucugcgccucgacacccacccggccauggucaccgugcuggagaugggugcagcccggcauuuccucaggaugcaacagcuggcgaaaacucaggaggaacgcgcccaguugcugcaacccacgcuggaaaucaacccacggcacgcacucauuaagaaacugaaucaguugagggccuccgagcccggccuggcccagcuccugguggaucagaucuaugaaaacgcaaugauugccgcggggcucguagacgauccacgcgccauggugggccggcugaacgaguugcuggucaaggcacuggagaggcauuga

SEQ ID NO: 864 - RNA, 462 nt, Artificial Sequence
  derived and/or modified CDS sequence (opt7) from Homo sapiens__NP_000609.1__HsIGF1
augggcaagaucagcucccugcccacccaacucuucaaaugcuguuuuugcgacuuccugaaggugaaaaugcacacuaugaguagcucccauuuguuuuaccuggcccucugucuguugaccuucacgaguagcgcaacugccgggccagagacccugugcggugcggaacucgucgaugcccugcaguuuguguguggcgacaggggguucuauuuuaacaagccgaccggcuacgguuccagcucccggcgcgcaccccagacugggauuguagaugagugcuguuucaggaguugcgaccugcggcgccucgaaauguauugugccccacugaaacccgcaaagagcgccagguccgugcgggcgcagcgccacaccgauaugccaaagacgcagaaagagguccauuugaagaaugccagcaggggcagugcaggcaacaaaaauuaccggauguga

SEQ ID NO: 865 - RNA, 543 nt, Artificial Sequence
  derived and/or modified CDS sequence (opt7) from Homo sapiens__NP_000603.1__HsIGF2
augggcauccccauggguaagagcaugcuggugcuccugaccuucuuggccuuugcauccugcuguauugccgcguacaggccaagugagacucugugcgggggcgaacucgucgacacccugcaguucguguguggggaucggggcuuuuauuucagccgcccggccuccaggguaagucggcgcagcagggguaucguggaggaaugcuguuuucgguccugcgacuuggcacugcucgagacguacugugccacucccgcaaaaagcgaacgcgaugucuccaccccacccaccgugcugccagacaacuuccccagguauccaguggggaaguuuuuccaauacgauacuuggaaacagaguacccagcggcugcgcaggggccucccggcccuguugcgggcgcgcaggggccacguccuggccaaggagcucgaggcauuucgggaagccaaacgccauaggccccugauugcccugccaacgcaggaccccgcacacgggggugccccacccgagauggcgagcaaucggaaguga

SEQ ID NO: 866 - RNA, 639 nt, Artificial Sequence
  derived and/or modified CDS sequence (opt7) from Homo sapiens__NP_000591.1__HsIL6
augaacagcuucuccaccagugccuuuggccccguggcauucagccuggggcuccuguugguccugccagccgcguuuccggcccccgugccacccggugaggacuccaaggauguagcagccccacacaggcagccccucaccaguagcgaacggaucgacaaacaaauucgcuacauccuggauggcauuuccgcauugaggaaggagacuugcaauaaaagcaacaugugugaauccaguaaggaggcccuggcggaaaauaaccucaaucugccaaaaauggccgagaaggacgggugcuuccagagcggcuuuaacgaggaaacgugucuggugaagaucauuacuggucuccuggaguucgaagucuauuuggaguaccugcagaaucgguuugaguccagcgaagaacaggcacgcgccgugcaaaugaguaccaaagugcucauccaguuccugcagaagaaagccaagaaccuggaugcaaucaccacuccggaccccaccacgaaugccuccuugcucacuaaacugcaggcgcaaaaccaguggcugcaggauaugaccacucaucucauucugaggagcuuuaaggaguucuugcaguccagucugcgggcccuccgccaaauguga

SEQ ID NO: 867 - RNA, 1281 nt, Artificial Sequence
  derived and/or modified CDS sequence (opt7) from Homo sapiens__NP_002183.1__HsINHBA
augccccugcucuggcugaggggcuucuugcuggccagcugcuggaucauugugcgguccaguccaaccccggggagcgagggucacuccgcagcccccgacuguccaaguugcgcgcucgccgcacugcccaaggaugucccaaacagccagcccgaaaugguggaggccgugaaaaagcauaucuugaauaugcugcaccucaaaaagcgcccagacguaacucaaccgguccccaaagcagcccugcugaacgcgauuaggaagcuccaugugggcaaggugggggaaaauggcuacgucgagaucgaagaugacauuggucggcgcgccgagaugaacgagcugauggaacagaccuccgagaucaucacguuugcagaaagcgggacugccaggaaaaccuugcacuucgagauuuccaaggagggcagugaucugagcgugguagaacgggccgagguguggcucuuucugaaagucccaaaggcaaaucgcaccaggacuaaagugaccauccggcuguuccagcagcaaaagcauccccagggcuccuuggacacgggggaagaggccgaagaggugggucucaaaggcgagcgcagcgaacugcugcucagugagaaggucguggaugcgaggaaguccacuuggcacguauuuccagugagcuccaguauucagcggcuguuggaccaggggaaaagcucccuggauguccgcaucgccugugaacaaugccaggagagcggcgcaagucucgugcugcuggguaagaaaaagaaaaaggaagaggagggggaaggcaagaaaaagggcgggggugagggcggggccggcgcagacgaagagaaagaacagucccacaggcccuucuugaugcuccaggcccggcaaagcgaggaucauccgcaccgcaggcggcgcaggggucuggagugugacggcaaggugaacauuugcuguaaaaagcaguuuuucgucaguuuuaaggauaucggguggaaugacuggauuaucgcccccuccggcuaucaugcgaacuacugcgaaggggaguguccaagccacaucgcagguaccagcggcuccagucugagcuuccacuccacugugauuaaucauuaucggaugagggggcacagccccuuugccaaccucaaaaguugcugcguaccaaccaagcugcgccccauguccauguuguacuaugacgauggccagaauaucauuaaaaaggacauccaaaacaugauuguggaagagugugguugcagcuga

SEQ ID NO: 868 - RNA, 1224 nt, Artificial Sequence
  derived and/or modified CDS sequence (opt7) from Homo sapiens__NP_002184.2__HsINHBB
auggacggccugcccgggagggcccucggugcagccugccuguugcugcucgcggccggcuggcuggggccagaggcauggggcagcccgacucccccacccaccccagccgcacccccaccgcccccacccccagguucccccgggggcagucaggauaccuguacgagcugcggcggguuccggcgcccggaagaguuggguaggguggacggcgauuuucuggaagccgucaagcggcacauccucucccgccugcaaaugagggggcggcccaacauuacucaugcggugccaaaagccgcaaugguaaccgcccugcgcaagcuccacgccggcaaagugagggaggacggucgggucgaaaucccccaucuggaugggcacgcaaguccaggcgccgacggccaggagcgcgugagcgagauuaucuccuucgcggaaaccgauggguuggccagcuccagggugcggcuguacuuuuucauuaguaaugaggguaaccagaaucucuuugucgugcaggcaagccuguggcuguauuugaagcuccugcccuacguacuggaaaaaggcucccgcaggaaggugcgggucaagguguauuuccaagagcaggggcauggcgaccgcuggaacaugguggagaaaagggucgaucucaagcggagcgguuggcacacuuuuccacugaccgaagccauccaggcauuguucgagcgcggcgaaaggcggcugaaucucgacgugcagugugauaguugccaagagcuggccguagugccggucuuuguggaccccggggaagagucccacaggccauucguggucgugcaggcccgccugggcgauagccggcauaggauccgcaaacggggguuggagugugacgguaggacgaaccucugcugucgccagcaguuuuucauugacuuccggcugaucggcuggaaugauuggauuaucgcgcccacuggguacuauggcaacuacugcgaagguuccuguccagcauaucuggccggcguacccgggagugccagcuccuuucacaccgcaguggucaaucaauacaggaugcggggccucaacccggggacugugaauagcugcugcauuccaaccaagcugaguaccauguccauguuguacuucgacgaugaguauaacaucgucaaacgcgacgugcccaauaugauuguggaagaguguggcugcgccuga

SEQ ID NO: 869 - RNA, 3459 nt, Artificial Sequence
  derived and/or modified CDS sequence (opt7) from Homo sapiens__NP_000623.2__HsITGAM
auggcccugagggugcuccuguugaccgcacugacucucugccacggcuucaaccuggacaccgagaaugccaugacguuucaggaaaacgcgcggggguucggucaaagcgucgugcaguugcagggcucccgcguaguggucggggcgccccaggagaucguggcagccaaucaaaggggcagucuguaccagugugauuauagcacugguuccugcgaaccaauucggcuccaggugccggucgaggcagugaacaugagucuggggcugagccucgccgcgaccaccuccccaccccagcuguuggccuguggccccacuguacaucaaaccugcagcgaaaauacguacgugaagggccuguguuuucucuucggguccaaccugcgccagcagccacagaaauuucccgaggcacugagggguugcccacaagaggacagugauaucgccuucuugauugacggcagcggguccaucauuccgcacgauuuucggcgcaugaaggaguucgucagcacugugauggaacagcucaaaaagaguaaaacccuguuuucccugaugcaguauagcgaagaguucaggauccauuuuacuuucaaggaguuccaaaauaaccccaauccacggucccucgugaagcccaucacccagcuguugggccgcacccacacggccacugguauuaggaaagucgugcgggaacuguuuaacaucaccaauggggcacgcaagaacgccuucaaaauucucguagugaucacugacggcgagaaguuuggcgauccacugggguacgaagacgucauucccgaggcggauagggaaggugugauccgguaugugauuggcgucggggacgccuuccgcagugagaaaagcaggcaggagcugaauaccaucgcauccaagccgccccgggaucauguguuucagguaaacaauuucgaagccuugaaaaccauccaaaaccagcuccgcgagaagauuuuugcaaucgaaggcacucagacggguagcaguuccagcuucgagcacgaaaugagucaggagggcuuuuccgccgccauuaccagcaacgggccacugcugagcacugugggcuccuacgacugggccgggggugucuuccucuauaccaguaaggagaaaagcaccuuuaucaauaugacuaggguggauuccgacaugaacgacgcauaccugggcuacgccgccgcaauuaucuugcggaauaggguccaaagccuggugcucggggcgccccgcuaucagcacaucggccugguggccauguuccggcagaacacggguaugugggaaaguaaugccaacguaaagggcacccagauuggggcauacuuuggcgccucccuguguagcguggaugucgacuccaaugggaguacugauuuggugcucaucggcgcaccacauuauuacgagcaaaccaggggugggcaggucagcgugugcccccugccacgcggccgggccagguggcagugugacgccgugcuguauggugaacagggccaaccgugggggcgcuucggcgcagcccucaccguacugggggaugugaacggcgacaaauugacugaugucgcgauuggugcccccggggaggaagacaaucggggcgcaguguaccuguuccacggcacguccgggagcgguaucaguccaucccauagccagaggauugccggcuccaagcucaguccccggcugcaguauuuugggcaaagccuguccggcggucaggauuugaccauggacgggcuggucgaucucacugugggcgcccagggccacgugcugcuccugcgcagccagccaguauugagggucaaagcaaucauggaguucaacccccgggagguggcgcgcaauguguuugaaugcaacgaccaagucgugaaggggaaggaggccggugaagugaggguaugccugcacguccagaaaaguacccgggaccgccucagggagggccagauccaguccguggugacuuacgaucuggcacuggacagcgggcggccgcauuccagggccgucuucaaugagaccaagaacagcacgcgccggcaaacccagguguugggccugacucagaccugugaaacucucaaacugcagcucccaaauugcauugaggaucccguaagucccaucgugcugagguugaacuuuagccuggucgguaccccacuguccgccuucgggaaccuccgccccgugcuggcagaagacgcccaacgguuguuuacggcgcuguucccauuugagaagaauuguggcaacgauaauauuugccaggacgaucucaguaucaccuucagcuuuaugucccuggacugucucguggucggcgggccgagggaguucaacgugacuguaaccgugcgcaaugauggugaagacagcuaccggacucaggucaccuucuuuuucccccuggauuuguccuauaggaaagugaguacgcugcaaaaccagcgcagccagcgguccuggaggcuggccugcgagagugcaagcuccaccgaagugagcggcgcccucaagaguacuuccuguagcauuaaucacccaaucuuucccgagaacuccgaagucaccuucaauauuacuuuugacguggauagcaaggccagucuggggaacaaauugcugcucaaggcaaauguaaccuccgagaacaauaugccacgcacgaacaaaaccgaguuccagcuggaacugcccgugaaguacgccgucuauaugguggugacuagccauggcgucaguaccaaauaccucaauuuuacugcguccgagaacaccagccgggugaugcaacaccaguaucagguauccaaccugggucagaggagcuugccgaucagucugguguuccucgucccagugcgccugaaucaaacugugaucugggaccggccccaggucaccuuuagcgaaaacuuguccaguacgugccauaccaaggagaggcugccaagccacuccgacuuccucgccgaacugcgcaaggcacccgugguaaauuguagcauugccgugugccagaggauccagugcgauauuccguuuuucgggauccaagaggaauuuaacgcaacucugaaaggcaaucucuccuucgacugguacauuaagaccagucacaaccaucuguugaucgucagcacugccgagauccuguucaaugauuccguguuuacccuccugcccggccagggggcguucgugcggagccagacggagaccaaagucgaaccauuugaggugcccaacccauugccccugauuguagguaguuccgugggcgggcuccugcugcucgcccugaucacugcagccuuguauaagcugggcuucuuuaaaaggcaguacaaggacaugaugagcgaagguggcccaccgggggccgagccccaauga

SEQ ID NO: 870 - RNA, 1404 nt, Artificial Sequence
  derived and/or modified CDS sequence (opt7) from Homo sapiens__NP_002415.1__HsMMP8
auguucagccugaagacccuccccuuucuguugcugcuccacgugcagaucuccaaagccuucccagucaguagcaaggagaaaaacacuaagaccgugcaagacuaccuggaaaaauuuuaucaguugccguccaaucaguaccagaguacgaggaagaacggcacuaauguaauuguggagaagcugaaagaaaugcaacgguucuuugggcucaacgucaccgguaagcccaaugaggaaacccuggauaugaugaaaaagccacgcugcggcgugcccgacagcgggggcuucaugcugacuccagguaaccccaaaugggagaggaccaaucucacguaucggauccgcaacuacacuccacagcuguccgaggcagaaguggagagggccauuaaggaugcguuugaauuguggagcgucgccuccccgcugaucuucacccggauuagucagggggaggcagacaucaauaucgccuuuuaucagcgcgaucauggcgacaacagccccuucgauggcccaaaugggauucucgcacacgccuuucaacccggucagggcaucgggggcgacgcgcauuucgaugccgaggaaacuuggaccaacaccuccgcaaauuacaaccuguuccugguggccgcccacgaguuuggucauagcuuggggcucgcacacaguuccgacccaggcgcccugauguaucccaauuacgcguucagggaaacgagcaacuacucccugccgcaggaugacauugauggcauccaggccauuuaugggcucaguagcaaccccauccaaccaacuggucccuccaccccaaaacccugugacccaagccugacuuuugacgcaauuaccaccuugcggggcgagauccuguucuuuaaggaucgcuacuucuggaggcggcacccgcagcuccagcgcguagaaaugaauuuuaucagucuguucuggcccucccugccaacugggauucaagccgcauaugaggacuuugauagggacuugaucuuccucuuuaagggcaaccaguacugggcccugagcgguuaugauauucugcagggcuaccccaaagacaucaguaauuauggguucccauccagcgugcaggccauugaugcggcagucuuuuaccggagcaagacguacuucuucgugaacgaccaauuuuggcgcuaugauaaucagaggcaguucauggagcccggcuacccgaaauccaucaguggggccuuuccagguaucgaaagcaagguggacgccgucuuccagcaagagcacuuuuuccauguguuuuccggcccccgguauuacgcauucgaucucauugcccagcgcguaaccaggguggcgcgggggaacaaauggcugaauugcagguauggcuga

SEQ ID NO: 871 - RNA, 2124 nt, Artificial Sequence
  derived and/or modified CDS sequence (opt7) from Homo sapiens__NP_004985.2__HsMMP9
augagccuguggcagccccucgugcuggucuugcuggugcucggcugcuguuucgccgcaccaaggcaacggcaguccacccugguauuguuuccgggggaccugcgcacuaaccucaccgauaggcagcuggccgaggaauaccuguaucgguacgguuauacgcgcguggcggagaugaggggcgaaaguaagagccucgggcccgcccuguugcugcuccagaaacaacugucccugccagagacuggcgaauuggacagugcaacccucaaggccaugcggacccccaggugcggugucccagaucuggggagguuccagacuuuugagggcgaccugaaauggcaccaucacaauaucaccuacuggauucagaacuauagcgaggaucucccccgggcagugaucgacgaugccuucgcgcgcgccuuugcacugugguccgccgugacgccauugacuuucaccagggucuacagccgggacgccgauauugugauccaguuuggcguagcagaacauggggacgguuauccguucgauggcaaggacgggcugcucgcccacgcguuucccccaggccccgguauucaaggggaugcccauuucgacgacgaugagcuguggucccugggcaaaggcguggucgugccaacucgcuuugggaaugcagacggugccgcaugucacuuccccuucaucuuugaaggcaggaguuacagcgccugcaccaccgaugggcgguccgacggcuugccgugguguagcacgacugccaacuacgauaccgacgaucgcuucgguuuuugccccagugagaggcucuauacucaggacggcaaugcggaugggaagccaugucaguuccccuuuaucuuccagggccaauccuacagcgcaugcaccaccgacgggcgguccgaugguuaucgcuggugugccacuacggccaacuacgacagggacaagcuguuuggcuucugcccaacccgggcagauaguacugugaugggcgggaauagcgccggugagcugugcgucuuucccuucaccuuucucggcaaagaauauuccaccuguacuagcgaggggaggggcgacgggcgccuguggugcgcgacgaccaguaacuucgauuccgacaagaaauggggcuuuuguccagaucaggguuacagcuuguuccugguggccgcacacgaguucgggcaugcccucggccuggaccacaguuccguaccggaagcacugauguaucccauguaccgguuuacugaagguccacccuugcauaaggaugacgugaauggcauuaggcaccucuacgggccacgccccgagccggagccacggccacccaccaccacuacgccccagcccaccgccccaccgacugucugccccaccggcccacccacugugcacccaagcgaaaggcccaccgccgggccgacgggcccacccagcgcagguccaaccgggcccccgacugccggccccuccaccgcgacuaccgugccacugagucccgucgaugacgccuguaacgugaauaucuucgaugcaauugccgagaucggcaaccaacuguaucucuuuaaagacgggaaguacuggcgcuucagcgaaggucggggcuccaggccacaggggcccuuucugauugccgauaaauggccagcauugccgcggaagcuggacagcguauucgaggaacgccucaguaagaaacuguuuuucuuuuccggccgccaggugugggucuauacgggugcgagcgugcuggggccccggcgcuuggacaagcugggccucggcgccgaugucgcacaggugaccggggcccugagguccggucggggcaaaaugcuccuguucagugggcgcagguuguggcgguuugacgugaaggcccaaaugguagauccaaggagcgcauccgagguggaccgcauguuccccggcgucccacuggauacucaugacguguuccaguaccgggagaaagccuauuuuugccaggauagguucuacuggcgcgucagcagucgguccgaacucaaucagguggaccaaguggguuauguaaccuacgauauccugcagugucccgaggacuga

SEQ ID NO: 872 - RNA, 1416 nt, Artificial Sequence
  derived and/or modified CDS sequence (opt7) from Homo sapiens__NP_002418.1__HsMMP13
augcaccccggcgugcuggccgcauuccucuuucugagcuggacccauugcagggccuugccacugccguccgggggugacgaggaugaccucagugaagaggaucugcaguucgcggaacgguacuugcgcagcuauuaccaccccacuaaccuggccggcauccucaaggagaaugcagccuccaguaugaccgaaaggcugcgggagaugcagagcuuuuucgggcuggaggucacgggcaaacucgacgauaacacucuggacgugaugaagaaaccacgcugugguguacccgaugugggggaauauaaugucuuuccaaggaccuugaagugguccaaaaugaaccugaccuaccggauugugaauuauacucccgacaugacccauagcgagguggaaaaggcauucaagaaagccuuuaaggucugguccgaugugacgccacucaacuucacucgccugcacgacggcaucgcggauauuaugaucaguuuuggcauuaaagagcauggggacuucuacccguuugauggucccagcggccuguuggcccacgcauucccacccgggccaaauuauggcggugacgcccacuucgacgaugacgagaccuggacuuccagcaguaagggguacaaccucuuucugguagccgcacaugaguucggccacucccugggccucgaucauagcaaagaccccggggcccugauguuuccgaucuacaccuauaccgguaagucccacuucauguugcccgaugacgaugugcaaggcauccagagucuguacgggccaggcgacgaggaucccaauccaaaacaccccaagacgccagacaagugcgauccgagccucucccuggacgcgauuacuagccugaggggugaaaccaugaucuuuaaagaccgguucuuuuggcgcuugcauccccagcaagucgaugccgaacucuuccugacuaagaguuuuuggccagaacugcccaacaggauugacgcagccuaugagcacccaucccaugaucucaucuucauuuuucggggccgcaaauucugggcacugaauggguacgacaucuuggagggcuaucccaagaaaauuagcgaacuggggcucccgaaggaggugaagaaaaucagugccgccgugcacuuugaagauaccgguaagacccugcuguucuccggcaaccaggucuggagguacgacgauacuaaucauaucauggacaaagauuauccacgguugauugaggaagacuuccccgggaucggcgauaagguggacgcgguauacgagaaaaacgguuacauuuacuuuuucaauggccccauccaguuugaguauagcauuuggagcaaccgcaucgugagggucaugccagcaaacuccauccucugguguuga

SEQ ID NO: 873 - RNA, 1068 nt, Artificial Sequence
  derived and/or modified CDS sequence (opt7) from Homo sapiens__NP_001286.1__HsCCR1
auggagacccccaacacuaccgaagacuacgauacgacuaccgaguucgacuauggcgaugccaccccaugccagaaggugaaugaaagggcauuuggggcccaacugcucccgccccuguacagcuuggucuucgugaucggucugguaggcaacauucucgugguccugguguuggugcaguauaaacggcugaagaauaugacuuccaucuaccuccugaaccuggcgauuagugaccuccuguuuuuguucacccugccauuuuggaucgauuauaaacucaaggacgauugggucuucggggacgccauguguaaaauucugagcggcuuuuacuauacgggucuguacuccgagaucuucuuuaucauuuugcucacuaucgaucgcuaccuggcaauugugcacgccguauucgcacugagggcccggaccgugacuuuuggggucaucaccaguauuaucauuugggcgcucgccauccuggcaagcaugcccggcuuguauuucuccaagacccagugggaauuuacgcaucacacuugcagccugcauuuuccacacgagucccuccgcgaguggaagcuguuccaggcccugaaauugaaucucuuuggccuggugcugccccuccuggugaugaucauuuguuacaccgggaucauuaagaucuugcugaggcggccaaacgagaaaaagaguaaagccguccgccucauuuucgugaucaugaucauuuucuuccuguuuuggacuccguauaaucugaccaucuugauuagcguauuccaagacuuucucuucacccaugaaugcgaacaguccaggcaccuggaucuggcagugcaggucacugaggugaucgccuacacgcacuguugcgugaaccccgucauuuaugcguuugugggugagcgguuccgcaaguaccucaggcagcuguuucaucggcgcguagccgugcacuuggucaaauggcugccauuccucagcguggacaggcuggaacgggucaguuccaccagccccuccacuggcgagcaugaacugagugcaggguucuga

SEQ ID NO: 874 - RNA, 636 nt, Artificial Sequence
  derived and/or modified CDS sequence (opt7) from Homo sapiens__NP_002598.4__HsPDGFA
augaggacccuggccugccuccuguugcugggcuguggguaccucgcacacgugcuggccgaggaagcggagaucccccgggaagucauugagcgcuuggccaggagccagauccauuccauucgggaccugcaacgccuccuggaaaucgauaguguggguagcgaggacucccuggauaccagucucagggcacacggcguacaugccacuaagcacgugccagagaaacggccgcugcccauucgcaggaagcggagcaucgaagaggcagucccagccgugugcaaaacgcgcacugugaucuaugaaauucccaggucccaggucgacccaaccagcgcgaacuucuugaucuggcccccauguguggagguaaagcggugcaccggguguugcaauacuuccagugugaaaugucagccgagccgcguccaucacagguccgugaagguggccaaggucgaguacgugcggaaaaagcccaaacugaaggaaguacaggugcgccucgaggaacaccuggagugcgcaugugccaccacgagccugaacccagauuauagggaagaggacacuggccggccccgcgagagugguaaaaagaggaaacggaagagguugaagccaaccuga

SEQ ID NO: 875 - RNA, 726 nt, Artificial Sequence
  derived and/or modified CDS sequence (opt7) from Homo sapiens__NP_002599.1__HsPDGFB
augaacaggugcugggcccuguuccucagccuguguugcuacuugcggcugguguccgcagagggcgaccccaucccagaggaacucuaugaaaugcugagugaucacagcauucgcuccuuugacgauuugcagaggcugcuccauggggacccgggugaggaagauggcgccgagcuggaccugaauaugacccggagucacagcgggggcgagcucgaaucccuggcgcgcgguaggcggagcuuggggucccugacuaucgccgagcccgcaaugauugccgaauguaagacccgcacggaggucuucgagaucaguaggcggcucauugaucgcacuaacgcaaauuuucugguguggccacccugcguagaagugcaaagguguagcggcugcuguaacaaucggaacguccagugccgcccaacccaggugcagcugaggcccgugcaaguccggaaaaucgagaucgugcgcaagaaaccaauuuucaagaaagccaccguaacuuuggaagaccaucucgcguguaagugcgagaccguggccgcagccaggccggucacgcggucccccggcgggagccaggaacagcgcgccaagacuccacagaccagggugacuauccggaccgugaggguccgccggcccccaaaagguaagcacaggaaauuuaagcauacccacgauaaaacggcacugaaggagacucugggcgccuga

SEQ ID NO: 876 - RNA, 1038 nt, Artificial Sequence
  derived and/or modified CDS sequence (opt7) from Homo sapiens__NP_057289.1__HsPDGFC
augagccuguucggccuccuguugcugaccuccgcccucgcagggcagaggcaagguacucaggccgagaguaaccugagcuccaaguuucaguucaguagcaauaaagaacagaacggcgugcaagacccccagcacgagcggaucauuaccgucuccacgaaugggagcauccauuccccacgcuuuccgcacacuuaccccaggaacaccguguugguauggcggcugguggcggucgaagagaauguguggauucagcucaccuucgaugaacgcuuuggccuggaggacccagaggaugacaucugcaaguaugauuucguggaagucgaggaacccagugacgguacuauucuggggaggugguguggcagcggcaccgugccagggaaacagaucuccaaggguaaccaaauccggauucgcuuuguaagcgaugaguacuuccccagugagccaggcuuuugcauccauuauaauauugugaugccgcaguucacggaagccgucucccccagcgugcucccacccuccgcacugccauuggaccugcucaacaaugccaucacugcauuuaguacccuggaggaucugauuagguacuuggaacccgagcgguggcagcucgaccuggaagaucuguaucgcccgacuuggcagcuccuggggaaagccuucguguucggcaggaaaagccgggucguggacuugaaccugcucaccgaggagguacgccuguacuccuguacccccaggaauuuuagcgugaguauccgggaggaacugaagcgcacggauacuauuuucuggccagguugcuugcucgucaagaggugugggggcaacugcgcguguugccugcacaauuguaacgaaugccaaugcgugcccuccaaggugaccaaaaaguaucaugagguccugcagcuccggccaaaaacuggcgugcgcgggcugcacaagagcuugaccgacguagcccuggaacaccaugaggagugugacugcguguguagggguaguaccggcggguga

SEQ ID NO: 877 - RNA, 1095 nt, Artificial Sequence
  derived and/or modified CDS sequence (opt7) from Homo sapiens__NP_149126.1__HsPDGFD
augcacaggcugaucuucguguacacccucauuugcgccaacuuuuguagcugccgggacacuuccgcaacgccccagagugccagcaucaaggcgcugcgcaaugccaacuugaggcgggaugaccuguaucgcagggaugagaccauucaagucaaaggcaauggguacgugcaguccccacgguucccgaacaguuauccccgcaaucuccuguugacuuggaggcugcauagccaggaaaacacccggauccagcucguauuugacaaucaauucggucuggaggaagcagagaacgauauuugucgcuacgacuuuguggaagucgaggauaucuccgagaccagcacuaucauuaggggccgguggugcgggcacaaggaagugccaccccgcaucaaauccaggaccaaucagauuaagaucacguucaaaagugacgauuauuuuguggccaagccaggcuucaagauuuacuauagccugcucgaggacuuucagcccgcagccgcguccgaaacuaacugggagagcgucaccaguuccaucagcgguguguccuacaauaguccaagcguaacugauccgacccugauugccgacgcauuggauaaaaagaucgccgaguucgacaccguggaagaccugcucaaauacuuuaaccccgaguccuggcaggaagaucuggagaauauguaucuggacacgccacgguaccgcgggaggagcuaucaugaucggaagaguaaagucgacuuggaucgccucaacgacgaugccaagagguacuccuguacuccccggaauuauagcgugaacaucagggaggaacugaaacuggcaaacguggucuucuucccacgcugccuccuggugcaacgguguggcggcaauugcgggugugguaccguaaacuggaggaguugcacuugcaauuccggcaagaccgugaagaaauaccacgaggucuugcaguuugaacccgggcauauuaagcgccggggcagggccaaaaccauggcgcugguggacauccagcucgaucaccacgagcgcugugacugcauuuguagcagccggccgcccagguga

SEQ ID NO: 878 - RNA, 678 nt, Artificial Sequence
  derived and/or modified CDS sequence (opt7) from Homo sapiens__NP_003946.3__HsSOCS3
auggugacccacagcaaguuccccgccgcaggcauguccaggccacuggacaccagucuccggcugaaaacuuuuagcuccaagagugaguaccaguuggucgugaacgccguacgcaaacugcaagaaagcggguucuauugguccgcggugacggguggcgaggccaaucuccuguugagcgcagaaccggccgggacuuuucugaucagggauuccagugaccagcggcauuucuuuacccucagcgucaagacccaguccggcacuaaaaaccugcgcauucagugcgagggugggagcuucagucugcaauccgaucccaggagcacccagccagugccccgguuugacugugugcucaagcugguccaccauuacaugccacccccaggcgcaccguccuuccccaguccacccacggaaccaagcuccgaggugcccgagcagccgagcgcccagcccuugccaggcagucccccacgcagggcguauuacaucuauuccgggggugaaaagauuccccugguacucagccggccacugaguuccaauguggccacucugcaacacuugugccgcaaaaccgucaacggccaucucgauagcuacgagaaggugacucagcugccggggcccaucagggaauuucuggaccaguaugaugcaccacucuga

SEQ ID NO: 879 - RNA, 483 nt, Artificial Sequence
  derived and/or modified CDS sequence (opt7) from Homo sapiens__NP_003227.1__HsTGFA
auggugcccagcgccggccagcuggcacucuucgcccuggggaucgucuuggcggccugccaagcacuggagaacuccaccaguccacucagcgccgacccgcccguggcagccgcgguagugucccacuuuaaugauuguccagacagucauacucaguucugcuuucacgguaccuguagguuccugguccaggaagauaagcccgccugcgugugucauagcggcuacgugggggcacggugcgagcacgccgacuugcuggccgucguggcagccucccagaaaaagcaagcgauuacggcccucguaguggucagcaucguggcacuggccgugcugauuaucacuuguguccucauucauugcugucaggugcgcaaacacugcgaauggugcagggcacugaucugucggcacgagaagccauccgccuugcugaaaggccgcaccgccugcugucauagugaaaccguaguguga

SEQ ID NO: 880 - RNA, 1173 nt, Artificial Sequence
  derived and/or modified CDS sequence (opt7) from Homo sapiens__NP_000651.3__HsTGFB1
augcccccaagcggccugaggcuccugccguugcugcucccccuguuguggcugcucgugcugaccccagggcggcccgccgcaggucuguccacuugcaagaccaucgacauggagcucgucaaacgcaagaggauugaagccauccggggccagauucugaguaaauugcgccuggcgagcccacccucccaaggggaggugccaccgggcccccucccagaagccguacuggcacuguacaacaguacgagggaucggguggccggugagagcgcagaacccgagccagagcccgaagccgacuauuacgcgaaggaggucacucgcguguugaugguggaaacccacaaugagaucuaugauaaauucaagcaguccacccauagcauuuacauguuuuucaacacuuccgagcucagggaagccgucccggagcccgugcugcugagucgggcagaacuccgccuguugaggcugaagcucaaaguagagcagcacguggaacuguaucagaaguacagcaauaacuccuggcgguaucugagcaaucgcuugcucgccccaagugacucccccgaguggcugagcuuugaugucaccgggguggugaggcaauggcugucccggggcggcgagaucgaaggguuccgccucagugcccauuguagcugcgacuccagggauaacacgcugcaggucgacaucaaugguuuuacuaccggccggcgcggggauuuggcaacuauucacggcaugaacaggccauuccugcuccugauggccacgccccuggagcgggcgcagcauuugcagagcaguaggcaccgccgggcccucgacaccaauuacuguuuuuccagcaccgagaaaaacugcugugugaggcaacuguacaucgauuuccgcaaggaccuggguuggaaauggauucacgaaccaaagggguaucaugcaaauuuuugccucggcccgugucccuacaucuggagucuggauacucaguauuccaaaguauuggcccuguacaaccagcacaauccaggcgcaagcgccgcccccugcugugugccacaggcgcucgaaccccugccgauugucuauuacguggggcggaagccaaagguggagcaacugagcaacaugaucgucagguccugcaaaugcaguuga

SEQ ID NO: 881 - RNA, 1245 nt, Artificial Sequence
  derived and/or modified CDS sequence (opt7) from Homo sapiens__NP_003229.1__HsTGFB2
augcacuacugcgugcugagcgccuuccucauccugcauuuggucaccguggcacugucccucaguacuuguagcacccuggacauggaucaguuuaugaggaagcggauugaggccauccgcggccaaauuuuguccaaacugaagcucacgagucccccagaagacuauccggagcccgaagagguaccacccgaagugaucagcauuuacaacuccacuagggaucugcugcaggagaaagcgagccggcgcgccgcagccugcgagagggaacgguccgacgaggaauauuacgcaaaggaggucuauaaaaucgauaugccacccuucuuuccaagugagaaugccaucccgcccaccuucuaccgcccauauuuuaggauugugcgguucgacgugagcgcgauggaaaagaacgccuccaaucucgucaaggcagaguuucgcguguucaggcugcagaaccccaaagcccggguaccagaacagcgcaucgaguuguaccaaauucucaagagcaaagaucugaccagucccacucagagguacaucgacuccaagguggucaaaacccgggccgaaggggaguggcugagcuuugaugugacggacgcagugcacgaguggcugcaucacaaggaucgcaauuuggguuucaaaauuucccuccauuguccgugcuguacuuuuguccccaguaacaauuauaucauuccaaacaagagcgaggaacuggaagccagguucgcgggcaucgacgggaccuccacuuacaccagcggcgaucagaagaccaucaaaaguacgcggaagaaaaauuccgguaagacuccccaucugcuccugauguugcugccaagcuaucgccucgagagucagcaaaccaacaggcggaaaaagagggcccuggacgcagccuacugcuuccgcaaugugcaggacaacuguugccugcggcccuuguauauugauuuuaagagggaccucggguggaaauggauccacgaaccaaagggcuacaaugcaaacuucugugccggcgccugcccguaucugugguccagcgauacucagcacagccgcguacugucccucuacaauaccauuaaccccgaggcgagugcaagcccaugcugugugucccaggaccuggagcccuugaccauccuguacuauauugggaaaacuccaaagaucgaacaacucagcaacaugaucgucaaaaguugcaaguguuccuga

SEQ ID NO: 882 - RNA, 1239 nt, Artificial Sequence
  derived and/or modified CDS sequence (opt7) from Homo sapiens__NP_003230.1__HsTGFB3
augaagaugcaucugcagagggcccucgugguccuggcauugcugaacuucgccaccgugagccucucccugaguacuugcaccacguuggacuuuggccacaucaaaaagaaacggguagaggcgauucgcgggcaaauccugagcaagcucaggcugacuuccccacccgaaccgaccgugaugacccacguccccuaccaggugcuggcccucuauaauaguacucgggagcuguuggaagagaugcauggugaacgcgaggagggcuguacccaggaaaacacggagagcgaauacuaugcaaaagagauucacaaguucgauaugauccaggggcuggccgagcauaaugaacucgcagugugcccaaagggcauuacuuccaaagucuuuagguucaacgugagcuccguagagaagaaucggaccaaccuguuucgcgccgaguucagggugcugcggguccccaauccaaguagcaaacgcaacgaacaaaggaucgaauuguuucagauccuccggcccgacgagcacauugcgaagcagcgcuacaucggugggaaaaaucugccaacuaggggcaccgccgaguggcuguccuucgaugugaccgacacggugcgggaauggcuccugcgcagggagagcaacuugggccuggaaauuaguauccacuguccgugccauacuuuucagcccaauggggauauucucgagaacauccacgaagucauggagauuaaguucaaagguguggacaaugaggaugaccauggccgcggggaucugggccggcugaagaagcaaaaagaccaccacaacccacauuugauccucaugaugauucccccacacaggcuggauaaucccggucaagggggccagcggaagaaaagggcacuggacaccaacuauuguuuucgcaaccucgaagagaauugcuguguacggccgcuguacaucgauuucaggcaggacuugggcuggaagugggugcaugaacccaaaggguauuacgccaacuucugcuccgguccaugucccuaccugcgcagcgccgacacuacccacuccaccguccucggccuguauaauacucugaacccagaggcaagugccagccccugcugcgugccacaggauuuggaaccgcucacgauccuguacuauguggggcggacccccaaggucgagcagcuguccaauauggugguaaagagcuguaaaugcaguuga

SEQ ID NO: 883 - RNA, 1386 nt, Artificial Sequence
  derived and/or modified CDS sequence (opt7) from Homo sapiens__NP_001057.1__HsTNFRSF1B
auggcccccguggcagucugggccgcgcuggccgugggccucgagcugugggcagccgcacacgccuugccagcgcagguagccuucaccccguacgcacccgaaccagggagcacuugcaggcugcgggaguauuacgaccaaaccgcccagauguguugcuccaaguguagucccggucagcaugccaaaguguuuugcacgaagacuagcgauaccgucugugacuccugcgaagauaguaccuauacucagcucuggaacugggugccagagugucugagcugcggcucccgcuguagcuccgaccaaguggaaacccaggcaugcacgagggagcagaaucggaucugcacuugucgccccgggugguacugcgccuugaguaaacaggagggcuguaggcugugcgcgccacuccggaagugucgcccggguuucggggucgccaggcccggcaccgaaacuagcgaugugguaugcaaaccaugugcacccggcaccuuuuccaacaccacgagcaguacugacauuugccggccacaccaaaucuguaauguggucgccauucccgggaacgcauccauggaugccgugugcaccagcacuuccccgacccgcaguauggcccccggugcggugcaucugccacagcccgucagcaccaggucccagcacacucagccaacgcccgagccaagcaccgcaccgaguacuuccuuccugcuccccaugggcccaagucccccagccgaagggagcaccggcgacuuugcccugcccguggguuugaucguaggggugaccgcacugggccuccugauuaucggcgucgugaauugcgugaucaugacucaagucaagaagaaaccgcuguguuugcagcgggaggccaaggugccacaucuccccgcggauaaagcccgcgggacgcagggucccgagcaacagcaucugcugauuaccgcaccauccagcagcuccaguagccucgaauccagcgccagugcacuggacaggcgggcccccacucgcaaccagccacaggccccgggcguagaggcauccggggccggcgaagcgagggccagcaccgguuccagugauagcucccccggcgggcacggcacccaagugaaugucacuugcaucgugaacgucuguagcaguuccgaccacagcucccagugcaguagccaggcauccagcacgaugggggauaccgacaguuccccaagcgagucccccaaggacgaacaggugccauucagcaaagaggagugugccuuucggagucaauuggaaacucccgagacccugcucgguagcacugaagagaagccgcugccacugggcgugcccgaugccgggaugaaaccauccuga

SEQ ID NO: 884 - RNA, 513 nt, Artificial Sequence
  derived and/or modified CDS sequence (opt7) from Homo sapiens__NP_002623.2__HsPGF
augcccgugaugaggcuguucccaugcuuucuccagcuguuggccggccuggcacucccggccgugcccccacaacagugggcgcugagcgccgggaacgguuccagugaggucgaaguagugcccuuccaggaggucuggggccggagcuacugucgcgcauuggaaaggcugguggacguggucuccgaguauccaagugaaguggagcacauguuuagccccuccugcguaagccuccugcgguguaccgggugcuguggcgaugagaaucugcauugcgugccagucgaaacugccaacgugaccaugcagcuccugaagauccgcuccggugacaggccgaguuacguggaguugacguucagccaacacguccggugugaaugccgcccccugagggagaaaaugaagccagagcggcgcaggcccaaagggcggggcaagcgcaggcgggaaaaacagcgcccaacugauugucaucucugcggcgacgcagugcccaggcgguga

SEQ ID NO: 885 - RNA, 1239 nt, Artificial Sequence
  derived and/or modified CDS sequence (opt7) from Homo sapiens__NP_001020537.2__HsVEGFA
augaccgacaggcagacugauaccgcccccagcccauccuaccaucugcucccgggccggcgcaggacgguggacgcagccgcgagucgggggcaaggucccgagccagcccccggcgggggcgucgaaggugugggggcacgcggcguagcccugaaguuguucgugcagcugcucggcugcagcagguuugggggugcagucgugcgggccggcgaggcggaaccauccggggccgcacgcagugccagcuccggcagggaggaaccccagccagaggagggugaagaggaagaggagaaagaagaggaacgggggccgcaguggcgccugggcgccaggaagcccggcagcuggacuggggaggcagccgugugugcggauuccgccccagcagcccgggcaccccaagccuuggcccgcgcgagugguaggggcgggcgggucgcacgcaggggcgccgaagagagcgguccaccccacuccccgagccggcgcggcagugccuccagggcagggcccggccgggccagcgagaccaugaacuuccugcucuccugggugcacuggagucuggcgcugcuccuguauuugcaucacgccaaauggagccaggcagccccaauggcagaaggggguggccagaaucaucacgagguagugaaguuuauggacgucuaccagagguccuauugccaccccaucgaaacccugguggauauuuuccaagaguacccagacgaaaucgaguauauuuuuaaacccagcugugugccacucaugcgcugcgggggcuguugcaacgaugagggucuggaaugugucccgacugaggaaaguaauaucaccaugcagauuaugcggaucaagccccaucagggccagcacaucggggagauguccuuccugcaacauaacaagugcgaauguaggcccaaaaaggaccgcgcccggcaggagaaaaagagcgugaggggcaaagggaagggccagaaacgcaagcggaagaaaaguagguacaaguccuggagcguauaugugggugcccggugcugcuugaugccauggagccucccagggccccacccguguggcccaugcuccgagcgcaggaaacaccuguuuguccaagauccccagacguguaagugcaguuguaaaaauacugacagccggugcaaggcacgccagcuggaacucaacgagaggaccugucggugcgauaagcccaggcgcuga

SEQ ID NO: 886 - RNA, 699 nt, Artificial Sequence
  derived and/or modified CDS sequence (opt7) from Homo sapiens__NP_001165094.1__HsVEGFA
augaacuuccugcucagcugggugcacuggucccuggccuugcugcucuaccugcaucacgcaaaguggagucaggccgcgcccauggccgagggcgggggucaaaaucaucacgaagucgugaaauuuauggacguauaucagaggagcuacugccauccaaucgagaccuugguggauauuuuccaggaauauccggacgagaucgaauacauuuuuaagcccuccugugucccacugaugcggugcggcggguguugcaacgaugagggccucgagugugugcccacugaagagaguaauaucaccaugcagauuaugcgcaucaaaccacaccaaggucagcacaucggggaaaugagcuuccugcagcauaacaagugcgaguguaggcccaaaaaggaccgggcacgccaggagaagaaauccgugaggggcaagggcaaagggcaaaagcggaaacgcaagaaaagcagguauaaguccuggagugucuacgugggugcccggugcugucugaugccauggagccucccgggcccccacccaugcgggcccugcuccgaacgcaggaagcaucuguuuguacaggauccacagacguguaaaugcagcuguaagaauacugacagucggugcaaagcacgccaguuggagcugaacgaaaggaccugucggugcgauaagcccaggcgcuga

SEQ ID NO: 887 - RNA, 624 nt, Artificial Sequence
  derived and/or modified CDS sequence (opt7) from Homo sapiens__NP_003368.1__HsVEGFB
augagcccccugcucaggcggcuguugcuggccgcacuccugcaguuggccccagcgcaagccccggugucccagcccgacgcaccaggccaccagcgcaaggucgugaguuggaucgauguauacaccagggccacuugccagccccgggagguggucgugccacugaccguggaacucauggggacggucgcaaaacaacuggugcccagcuguguaacugugcagcgcugcgguggcuguugcccagacgaugggcuggagugugucccgaccggccagcaucaggugaggaugcaaauucucaugauccgguaucccuccagucagcugggugaaaugagcuuggaggaacacucccagugcgagugucgcccaaagaaaaaggacagcgccgugaaacccgauagggcggccaccccacaucaccggccccagccgcgcuccguccccgggugggacagugcaccaggcgcccccagcccagccgauauuacucaucccaccccagcaccgggccccuccgcccacgcggccccaagcacgaccagugcacugacucccgggccagccgcagccgccgcggacgcagccgccuccagcguggcaaaggguggcgccuga

SEQ ID NO: 888 - RNA, 1260 nt, Artificial Sequence
  derived and/or modified CDS sequence (opt7) from Homo sapiens__NP_005420.1__HsVEGFC
augcaucugcucggcuucuuuagcguggccugcucccuguuggcagccgcgcugcuccccgggccaagggaggccccggcagccgcagccgcguucgaaaguggucuggacuugagcgaugccgagcccgacgcaggcgaagccaccgccuacgcauccaaggaucuggaggaacagcuccggagugucagcuccguggacgagcugaugacuguacuguauccagaguacuggaaaauguauaagugucaacuccgcaaagggggcuggcagcacaacagggaacaggccaaucugaacagccggaccgaggaaacgaucaaguuugcggccgcacacuacaauacugagauuuugaaauccaucgauaacgaguggcgcaagacccagugcaugcccagggaaguguguauugacgucgguaaggaguucgggguggccaccaauacuuucuucaaaccacccugcgugagugucuaucgguguggcggcugcuguaacagcgaagggcugcaaugcaugaauaccuccacgagcuaccucaguaagacucuguuugagaucaccgugccacugucccaggguccgaaacccguaacuauuagcuucgcaaaccauaccuccugucgcugcaugaguaaguuggauguguauaggcagguccacagcaucauccggcgcucccucccagccacccugccccagugccaagccgcgaauaaaacguguccaacuaacuacauguggaauaaccauauuuguaggugccuggcacaggaagacuuuauguucagcagugaugccggcgacgauuccaccgacggguuucacgauaucugcggccccaauaaggagcucgacgaggaaacuugucagugcgugugucgggccggucugcgcccggcaagcugcgggccccacaaagaguuggacaggaacaguugucagugcgugugcaagaauaagcuguucccaucccaauguggcgccaaccgggaauuugaugagaauaccugccagugugucugcaaacgcaccugucccaggaaccagccacucaaccccggcaagugcgcgugugaaugcacugagagcccacaaaaaugucugcugaaggggaaaaaguuucaucaccagacgugcagcuguuaccggcgcccgugcaccaauaggcagaaggccugcgagcccgguuucuccuauagugaagaggugugucggugcguaccaagcuacuggaaaaggccccagauguccuga

SEQ ID NO: 889 - RNA, 1065 nt, Artificial Sequence
  derived and/or modified CDS sequence (opt7) from Homo sapiens__NP_004460.1__HsVEGFD
auguacagggaguggguggucgugaacguauucaugaugcuguaugugcagcucguccaaggcagcuccaaugaacacgggcccgugaagcggaguagccaguccacccuggagcgcagugaacagcagaucagggccgcaagcuccuuggaggaacugcuccggauuacucauagcgaggacuggaaacuguggcgcugcagguugcggcugaaguccuuuaccaguauggauagccgcuccgccagccacaggaguacgcgguucgcggccacuuuuuacgacaucgagacccucaaagugauugaugaagaguggcaacgcacccaguguuccccaagggaaacuugcgucgagguggcaagcgagcuggguaaguccaccaacacguucuuuaaaccgcccuguguaaauguguuccggugcggcggguguugcaacgaagagagucugaucuguaugaauacuagcaccuccuauauuagcaagcagcucuuugaaaucagugucccacugacuuccgugcccgaguuggugccagucaagguggccaaccauaccggcugcaaaugucugcccaccgcaccacgccacccguacagcaucauuaggcggaguauccagauucccgaagaggaccgcugcucccauagcaagaaacucugcccaaucgauaugcugugggacagcaauaaguguaaaugcguacugcaagaggaaaaccccuuggccgguacggaggaucacucccaccuccaggaaccagcgcugugugggccccauaugauguucgacgaggauaggugcgaaugugugugcaagacuccgugucccaaagaccugauucagcacccaaagaauugcaguuguuuugagugcaaggagagccucgaaaccugcugucagaaacauaagcuguuccaccccgauacuugcuccugugaggaccggugcccauuucacacccgccccugugccagcggcaaaaccgcaugcgccaagcauuguagguucccaaaagaaaagcgggccgcacaaggcccgcacaguaggaagaaccccuga

SEQ ID NO: 890 - RNA, 72 nt, Artificial Sequence
  derived and/or modified CDS sequence (opt8) from Homo sapiens__AAA59606.1__signal peptide-HLA-A2-SP
auggcggucauggccccgagaacgcuagugcuauugcucucgggcgcgcucgcgcucacgcaaacgugggcg

SEQ ID NO: 891 - RNA, 69 nt, Artificial Sequence
  derived and/or modified CDS sequence (opt8) from Homo sapiens__AAA61213.1__signal peptide-HsPLAT
auggacgcgaugaagcgcgggcucugcugcguacuacugcucugcggcgcgguauucgucucaccauca

SEQ ID NO: 892 - RNA, 81 nt, Artificial Sequence
  derived and/or modified CDS sequence (opt8) from Homo sapiens__NP_000790.2__signal peptide-HsEPO
augggcgugcacgagugcccggccuggcucuggcucuugcucucgcucuugagcuugcccuugggcuugcccgugcucggg

SEQ ID NO: 893 - RNA, 54 nt, Artificial Sequence
  derived and/or modified CDS sequence (opt8) from Homo sapiens__NP_000468.1__signal peptide-HsALB
augaaaugggucaccuucaucucccuccucuuccucuucuccucugccuacucc

SEQ ID NO: 894 - RNA, 18 nt, Artificial Sequence
  derived and/or modified CDS sequence (opt8) from Artificial____cleavage site-Furin
aggaggaggaggaagagg

SEQ ID NO: 895 - RNA, 630 nt, Artificial Sequence
  derived and/or modified CDS sequence (opt8) from Homo sapiens__NP_061986.1__HsFGF21
auggacuccgacgaaaccggcuucgaacacuccggccucugggucuccguccucgccggccuacuacuaggcgccugccaagcccaccccauccccgacucauccccacuucuacaauucggcggacaagucagacaacgauaccucuacaccgacgacgcccaacaaacagaagcccaucucgaaauaagagaagacggcaccgucggcggcgccgccgaccaaucccccgaaucccuacuccaacucaaagcacucaaacccggcgucauccaaauccucggcgucaaaaccucccgcuuccuaugccaacgccccgacggcgccuuauacggcucccuacacuucgaccccgaagccugcucuuuucgcgaacuccuacucgaagacggcuacaacguauaccaauccgaagcccacggccuaccccuacaccuccccggcaacaaaucaccccaccgcgacccagccccacguggccccgcacgcuuccucccacuaccaggccucccacccgcccuccccgaaccacccggcauccucgcaccccaaccacccgacguaggcuccucagacccccucuccauggucggccccucccaaggccgcucacccucauacgccucauaa

SEQ ID NO: 896 - RNA, 1410 nt, Artificial Sequence
  derived and/or modified CDS sequence (opt8) from Homo sapiens__NP_002412.1__HsMMP1
augcacuccuucccaccccuccuccuacuucucuucuggggcguaguaucccacuccuuccccgccacacuagaaacccaagaacaagacguagaccugguccaaaaauaccuagaaaaauacuacaaccucaagaacgauggacgacaagucgaaaaacgccgcaacuccggcccggucguagaaaagcuaaaacaaaugcaagaguucuucggccuaaaagucacuggcaaaccagacgccgaaacccucaaagucaugaaacaaccacgaugcggcgucccagacgucgcacaauucguccucacagaaggcaacccccgaugggaacaaacccaccucaccuaccgaauugaaaacuacacaccugaccugcccagagccgacguagaccacgccauagaaaaagccuuucaacucuggucaaacgucacaccccucaccuuuaccaaagucucggaaggccaagccgacauaaugauuagcuucguucgaggcgaccacagagacaacucccccuucgacggacccggcggcaaccucgcccacgccuuccaacccggcccggguauaggcggagaugcacauuucgacgaagacgaacgcuggacaaacaacuucagagaauacaaccuccaccguguagcagcccacgaacuaggccacucacucggacucucacacagcaccgacaucggagcccuaauguacccauccuacacuuucuccggagacguucaacucgcccaagacgacaucgacggcauccaagcaaucuacggccgcucccaaaacccaguacaacccaucggaccacagacucccaaagccugcgacuccaaacucaccuuugacgcaaucaccaccauccgaggcgaagucauguucuucaaagaccgcuucuacaugcgcacgaaccccuucuacccagaagucgaacucaacuucauaucagucuucuggccccaacuaccaaacggccuugaagcagcauacgaauuugccgacagagacgaaguccgcuucuucaaaggaaacaaauacugggccguccaaggccaaaacguccuucacggcuaccccaaggacauauacuccuccuucggcuucccccgaacagucaaacacaucgacgcggcacuguccgaagaaaauaccggcaagacauacuucuucgucgccaacaaauacuggcgguacgacgaauacaaacgauccauggaccccggcuaccccaaaaugauagcacacgacuucccgggaaucggccacaaagucgaugcaguauucaugaaagacggauucuucuacuucuuccacggcacacgccaauacaaauucgaccccaaaacaaaacgcauccucacccuccagaaagccaacagcugguucaauugccgcaaaaacuaa

SEQ ID NO: 897 - RNA, 1170 nt, Artificial Sequence
  derived and/or modified CDS sequence (opt8) from Homo sapiens__NP_002412.1__HsMMP1(1-19,100-469)
augcacuccuucccuccccuacuacuccuacuauucuggggagucguaucacacuccuucguccucaccgaaggcaacccucgaugggaacaaacccaccucacuuaccgaaucgagaacuacacccccgaccucccacgagccgacgucgaccacgccaucgaaaaagccuuucaacuaugguccaacgucacaccccucaccuucacuaaaguaagcgaaggccaagccgacaucaugaucagcuucguccgcggagaccaccgagacaauucccccuucgacggcccaggaggcaaccuagcccacgccuuucaaccaggacccggcauaggaggcgacgcccacuucgacgaagacgaacgauggacaaacaacuuccgcgaauacaaccuccacagaguagccgcccacgaauuaggccacucccuaggacucucacacucaaccgacauaggugcccucauguaccccuccuacaccuucagcggcgacguccaacuagcccaagacgacaucgacggcauacaggccaucuacggccgaucucaaaauccaguccaacccauaggaccacagacaccaaaagccugugacuccaaacucaccuucgacgccaucaccaccauacgcggagaagucauguucuuuaaagacagauucuacaugcguaccaaccccuucuacccagaaguagaacuaaacuucauaucugucuucuggccacaacuccccaacggccuagaagcagcauacgaauuugcugacagagacgaaguacgauucuucaaaggcaacaaauacugggccguccaaggccaaaacguacuacacggcuacccaaaagacaucuacuccuccuucggcuucccccgcacagucaaacacaucgaugccgcacucagcgaagaaaacaccggaaaaaccuacuucuucgucgccaacaaauacuggcgauacgaugaauacaaacgauccauggaccccggauaccccaaaaugaucgcccacgacuuccccggaauaggccacaaagucgacgcaguuuucaugaaagacggcuucuucuacuucuuccacggaaccagacaauacaaauucgaccccaaaaccaaacgcauccucacccuccaaaaagccaacuccugguucaacugccgcaaaaacuaa

SEQ ID NO: 898 - RNA, 3357 nt, Artificial Sequence
  derived and/or modified CDS sequence (opt8) from Clostridium histolyticum__BAA77453.1__ColG
augaagaaaaacauccucaaaauacucauggacucguauucuaaggaauccaaaauccaaaccgucagacgcgucacuagcgucucccuccucgcgguguaccuaacuaugaauacguccagccuaguccucgcaaagccuaucgagaacaccaacgacaccagcauuaaaaacguugagaagcuacgcaacgcgccaaacgaggaaaacucaaagaaagucgaagacagcaaaaaugacaaaguagagcacguuaaaaacauagaagaagccaagguggaacaaguagcaccggaagucaaaagcaaaaguacccuacgcagcgccagcauugccaacaccaacagcgaaaaguacgacuucgaguaucuuaacgggcucagcuacacagaacuaacaaaccugaucaaaaacauaaaauggaaccaaauaaacgguuuguucaacuacagcacagggucacaaaaauucuucggcgauaaaaaccgcguccaggccaucauaaacgcccuacaagaaagcggccgcacauacaccgcgaacgacaugaagggaauagaaaccuucacggagguauuaagggcgggguucuaccuaggcuacuacaaugacggacucucauaccuaaacgaccgcaacuuccaagacaagugcauccccgccaugauagccauacagaaaaacccaaauuuuaaacucggcacggccguccaagacgaaguuauaacauccuuagggaaacucaucggaaacgccucggccaacgccgaaguggugaacaacugcguccccguacuuaagcaauuccgcgaaaaccuaaaccaauacgcacccgacuacguuaaggggaccgcggucaacgaauugauaaaaggaaucgaguucgacuuuagcggagcagcauaugaaaaggacgugaagacaaugcccugguacggcaagauugauccguucauuaacgaacucaaggcccucggacuauacggaaacauaaccucagcaaccgagugggcuucagauguaggcaucuacuaccugagcaaguucggccuauacagcaccaaccgcaacgacauugugcaaaguuuagaaaaagcagucgacauguacaaguacggcaagauugcauuuguagcgauggaacgaauaacgugggacuacgacggcaucggcuccaacggaaagaaagucgaccacgacaaguuccuggaugacgccgagaagcacuaccuccccaagacauacaccuucgacaacggcaccuucaucauccgagccggcgacaaaguaucggaagaaaagaucaagagacuauacugggccuccagagaagucaaaucccaauuccaccgagucgucggaaacgacaaggcccuagaaguaggaaacgccgacgacguauuaacuaugaaaauuuuuaacagcccagaagaauacaaauucaacaccaauauuaacggcguaucaacagacaacggaggacuguacauagaaccccgagggacauucuacacauacgaacggaccccacaacaauccaucuuuagccuggaagaacucuucagacacgaauacacccacuaccuacaggccagauaccuagucgacgguuuauggggacaaggccccuucuacgagaaaaaccgacucacaugguuugacgagggcacagccgaguucuucgcaggaucaacaagaaccagcggcgugcucccgcgaaagucgauccuuggcuauuuagcgaaagacaaaguagaccacagauacagccuaaagaaaacacugaacucaggcuacgacgauagcgacuggauguucuacaacuauggcuucgcaguagcgcacuaccuuuacgaaaaagacaugccgacguucaucaagaugaacaaagcaauacuaaacaccgacguuaaaucguacgacgaaauaaucaaaaagcuguccgacgaugccaacaaaaacacagaauaccaaaaccauauccaggaacucgcggacaaguaccagggggcaggaaucccccuagucucggacgacuaccuaaaagaccacggcuacaagaaagcaagcgaaguauacagugagaucagcaaagccgccucccuaacgaacacaucagugacugcugagaaaagccaguacuucaacaccuucacacuccgaggaacuuacacgggagaaacaucaaaaggcgaguucaaagacugggacgaaaugagcaagaaauuagacggcacccuagaaucacuagcgaaaaacucuuggagcggauacaagacccuuaccgcauacuucacgaacuacagggucaccagugacaacaaagugcaguacgacgucguguuccacggaguucuaacagacaacgccgacaucuccaauaacaaagcaccaaucgccaaggugacggggccaagcacaggagccgucggacgaaacauagaguucucaggcaaagacagcaaggacgaagacgggaagauaguaaguuacgacugggacuucggugacggagcaacaucccgcgguaagaacagugugcacgcauauaagaaggccggaacauacaacguaacccuaaagguaacggacgacaaaggagcgacagcgaccgaaucguuuacuaucgaaauaaagaacgaagacacgaccacuccaauaacaaaagaaauggaaccaaacgaugacaucaaagaagccaacggcccuauagucgaagguguaaccguaaaaggcgaccucaacggcuccgacgacgcagacacguucuacuucgacgugaaagaagacggggacguaacaaucgaacuccccuacuccggcuccucaaacuucaccuggcuaguauacaaggaaggggacgaucaaaaccacaucgcaagcggaaucgauaaaaacaauaguaaaguagggaccuucaaaucgacaaagggaaggcacuacgucuucauuuacaagcacgacagcgccagcaacauaaguuacuccuuaaacaucaaaggacuaggcaacgaaaaacuuaaggaaaaagagaacaacgacucaagcgacaaagcgacuguaaucccaaacuucaauacgacaaugcaagguucccuccucggagacgacucacgggacuacuacagcuucgaagucaaggaagaaggcgaagugaacaucgaacuggacaaaaaggacgaguucggcguaaccuggacccugcaccccgaaagcaacaucaacgacaggaucaccuacggccaaguagacggcaacaaagucagcaacaaagucaaacuccgccccggcaaguacuaccuacuggucuacaaguacagcggcucaggaaacuacgaacuccgcgucaacaaguaa

SEQ ID NO: 899 - RNA, 3081 nt, Artificial Sequence
  derived and/or modified CDS sequence (opt8) from Clostridium histolyticum__BAA77453.1__HsALB(1-18)_ColG(111-1118)
augaaaugggucaccuucauaagccuccucuuucuguucagcagcgcauacucaauagccaacaccaacucagaaaaauacgacuucgaauaccuaaacggccuaagcuacaccgaacuaaccaaccucaucaaaaacauaaaauggaaccaaauaaacggccuauucaacuacagcaccggcagucaaaaguucuucggugacaagaaccgcguccaggcgauaaucaacgcccuacaagaauccggccgcaccuacacagccaacgacaugaaaggcauagaaacauucacggaaguacuacgugcuggauucuaucuaggcuauuauaacgacggacugagcuaccuaaacgacaggaacuuucaagacaaaugcauccccgccaugauagcaauccagaaaaaucccaacuuuaaacucggaacggcgguccaagacgaggugaucacgucacuuggaaaacucauaggaaacgcgagcgccaacgccgagguaguaaauaacugcguaccaguccugaagcaauuccgugaaaaucuuaaccaauacgccccagacuacguaaaaggaacugcggucaacgagcucauaaaaggaauagaguucgacuucagcggagccgcauaugaaaaagacguaaagaccaugcccugguacggcaaaauagacccguucaucaacgaacucaaggcacuaggccuauacggcaacaucacaagcgccaccgaaugggccucagacgucgggaucuacuaccuaucaaaauucggacucuacagcacaaaccgaaacgacaucguacaaucccuagaaaaagcagucgacauguacaaauacggaaagaucgcauucgucgccauggagcgcaucacgugggauuacgacggaauaggcucaaacggaaagaaagucgaccacgacaaauuccucgacgacgcagaaaaacacuaccugccgaaaacuuauacguuugacaacggcaccuucauuauccgcgcgggcgacaaaguaucugaggaaaagaucaaacgacuauacugggcuagccgagaaguaaaaagccaguuccaccgaguagucggaaacgauaaggcgcucgaaguaggaaacgccgacgacguccuuacuaugaagaucuucaacagccccgaagaauacaaauucaacacuaacaucaacggcguauccacagacaacggaggccuauacaucgaaccuaggggcaccuucuacaccuacgaacgcaccccacaacaaucaaucuucucucuugaagaacucuuccggcacgaguacacccacuaccuacaagcacgauaccucgucgacggccuauggggccaaggaccauucuacgagaaaaacagacucaccugguuugacgaagggaccgcugaguucuucgccggcagcacaagaacaucaggaguccucccccgaaagagcauccuaggauaccuggccaaggacaagguagaucaccgcuacagccuaaagaagacacuaaacagcggcuacgacgacuccgacuggauguucuauaauuacggcuucgcgguagcacacuaccuguaugaaaaagacaugccaaccuucaucaaaaugaacaaagcaauacuaaacaccgaugucaaaagcuacgaugaaauuaucaaaaagcugagcgacgacgcaaauaaaaacaccgaauaucaaaaccacauccaggaacucgccgacaaauaccaaggcgcagggaucccccuggugucagacgacuaccuaaaagaccacggcuacaagaaagccucggaagucuacuccgaaaucaguaaagcagccagccuaaccaauacaucaguuacagccgaaaagagccaguacuucaacacauucacacugaggggcaccuacacaggcgaaacuuccaaaggggaguucaaggacugggacgaaaugagcaagaagcucgacggcacccucgaaucacucgcuaaaaauucauggucgggauacaagacuuuaacggcauacuucacgaacuaccgagugacaagcgacaacaaaguccaauacgacgucgucuuucacggcguccugaccgacaacgcagacauauccaacaacaaagcaccgaucgcaaaagucaccggaccgagcaccggggcagucgggagaaacaucgaguucucaggcaaagacuccaaggacgaggacggcaaaaucgucagcuacgacugggacuucggagacggcgcaacaagccggggcaagaacucaguccacgccuacaagaaagcaggaaccuacaacguaacacuaaaaguaaccgacgacaaaggggcaacagccaccgaaucguucaccauagaaaucaaaaacgaagacaccaccacccccauuacgaaagagauggaaccgaaugacgacaucaaagaggcuaacggcccuaucgucgagggcguaaccguaaaaggcgaccuuaacggaucggaugacgcagacaccuucuacuucgacguaaaagaagauggcgacgucacuaucgagcucccauacuccggcuccagcaacuucaccuggcucguauacaaggaaggugacgaccagaaccacaucgcuucggggauagacaaaaauaacucuaaaguuggcacauucaagagcacaaaaggccggcauuacguuuucauauacaagcacgacuccgcuucaaacaucaguuacagccucaacaucaagggacugggaaaugagaagcucaaagagaaagagaacaacgacuccuccgacaaagccacgguaauacccaacuucaauacgaccaugcaagguucucuacucggcgacgacagcagggacuacuacucguuugaggucaaggaggaaggcgaaguaaacauagagcuugacaagaaagacgaguucggugugacguggacacuacacccagaguccaacauaaaugacagaauaacauacggccagguagacggcaacaaggugagcaacaaagucaaacuccgacccgguaaauacuaccuauuagucuacaaauacuccggaagcgggaacuacgagcuacgcgucaauaaguga

SEQ ID NO: 900 - RNA, 3429 nt, Artificial Sequence
  derived and/or modified CDS sequence (opt8) from Clostridium histolyticum__BAA77453.1__HsALB(1-18)_ColG(1-110)_CS-F_ColG(111-1 118)
augaaauggguaaccuucauaucccuccuguuccuauucucaucagcauacagcaugaagaaaaacauccucaaaauccuaauggauagcuacucaaaggaaaguaaaauccagacgguucgccgagugacguccgucucccuucuagcaguauaccucacuaugaacacaagcucccuaguccuggccaaacccauugaaaacaccaacgacaccucuauaaagaacguagaaaaacuccgaaacgccccaaacgaggaaaacucaaagaaaguagaggauucuaaaaacgacaaaguagaacacgucaaaaacauagaagaggccaaaguagaacaagucgccccggaagucaaauccaaaagcacgcugcggucggcgucucgccggcgacggaaacgcauagcaaacacaaacucggaaaaauacgacuucgaauaccucaacggacucagcuacaccgaacugacgaaccucaucaaaaacaucaaauggaaccaaaucaacggacuguucaacuacuccacaggaucccaaaaguucuucggcgacaaaaaccgaguacaggcgaucauaaaugcccugcaggaaagcggcagaacuuauaccgcaaaugacaugaagggcaucgaaacguucaccgagguccugagagcgggcuucuaccuaggauacuacaacgacggacucagcuaccucaacgaccgcaacuuucaggauaaaugcauaccggcaaugaucgcaauccagaaaaaccccaacuucaaacuuggaacagcgguacaagaugaggucaucacaucgcugggaaagcuaauaggaaacgccuccgcaaacgccgaaguagucaacaacugcgucccuguauuaaaacaauuccgugagaaccucaaccaauacgcccccgacuacgucaaaggcaccgccgucaacgaacugauaaagggcauagaguucgacuucaguggagcagcauacgaaaaagacgucaagaccaugcccugguacggcaaaaucgaucccuucaucaaugaacucaaagcgcuuggccucuacggaaacauaaccucugccacagaaugggcaagcgacgucggaauauauuaccuauccaaauucggccucuacagcacaaacagaaacgacauaguacagucacucgaaaaagcugucgacauguacaaauacggaaagauagcauucgucgcaauggaacgcauaacaugggacuacgacggcauaggguccaacggcaagaaaguagaccaugacaaguuccuagacgacgcagaaaaacacuaccugcccaagaccuacaccuucgacaacggaaccuucauaauccgagcaggcgacaaaguaagcgaagagaaaauaaaacgccuauacugggccagucgagaagucaaaucacaauuccaccgagucguaggcaacgacaaggcacuagaagugggaaacgccgacgauguccuaacuaugaaaaucuucaacagcccggaagaauacaaauucaacaccaacaucaacggggucucaaccgacaacggcgggcuguacauagagccgcgcggcacguucuacacguacgagcgcacaccccaacaaagcaucuuuucgcuagaagaacuuuuccgacacgaauauacccacuacuuacaggcucgauaccucguagauggccuauggggccaaggcccauucuacgaaaagaacagacucaccugguucgacgaaggaaccgcagaguucuucgcaggaucgaccaggacgagcggcguccucccaaggaaauccauacuuggauaccucgcaaaagauaagguagaccaccgguacucacuuaaaaagacucucaacucaggauacgacgacuccgacuggauguucuacaacuacggcuuugccguggcucacuaucuguacgaaaaggacaugcccaccuucaucaagaugaacaaagccauccucaacaccgacguaaaaagcuacgacgaaauaaucaagaaacucucagacgacgcgaauaaaaacacagaauaccaaaaucacauacaagagcucgccgacaaauaccagggcgcggggauaccgcucgucucugacgacuaccucaaagaccacggguacaagaaagccagcgaggucuacagugaaaucagcaaagccgccucgcuaaccaacaccagcguaacggcggagaaaagccaguacuucaacaccuucacacuaagaggaaccuauaccggugagaccagcaaaggcgaguucaaggacugggacgaaauguccaagaaauuagacgggacccuagaaucgcuggccaaaaacuccuggaguggguauaagacccuuaccgcguacuucacaaacuacagagugaccagcgacaauaaaguccaguacgaugucguguuccacggcgugcuaacagacaaugcagacaucucaaacaacaaagccccaaucgccaaagucacgggacccagcacaggcgccguaggccgcaacaucgaauuuucagguaaggauucaaaagacgaagacggcaagaucgucagcuacgacugggacuucggagacggcgccaccagcagagggaaaaacucaguacacgcguacaagaaggccgggaccuacaacgucacccuaaaaguuacggaugacaaaggcgccacagccacggaauccuucaccauagaaaucaagaacgaggacacaacuacccccauaaccaaagagauggagccaaacgaugacauaaaagaagcuaacggcccaaucguggaaggcguuacugucaaaggggaccuaaacggcucagacgacgccgacaccuucuacuuugacguaaaagaagacggggacgucacaauagaacucccauacuccggaaguagcaacuucaccuggcuaguguacaaggaaggggaugaucaaaaccacauagcauccggcauagacaagaacaacucaaaaguugggaccuucaaaucgaccaaaggccggcacuacguauucaucuacaaacacgacuccgcaaguaauauaucauacagccuaaacauaaaggggcugggaaaugaaaaacuuaaggaaaaagaaaacaacgacaguagcgacaaagcaacagugauccccaacuucaauacaaccaugcaaggcucacuccucggagaugacucaagggacuacuacucauucgaagugaaggaagaaggcgaagucaacaucgaacucgacaagaaggacgaguucggcgucaccuggacccuccacccugaaucaaacauaaacgacaggaucaccuacggccaaguagacggaaacaaagugucaaacaagguaaaacucagaccggggaaauauuaccuacugguguacaaauauucuggaagcggaaacuacgaacuacgagucaacaaauag

SEQ ID NO: 901 - RNA, 3105 nt, Artificial Sequence
  derived and/or modified CDS sequence (opt8) from Clostridium histolyticum__BAA34542.1__ColH
augaacuuccucaaaauaauccuaaaccgaggcaaaaccaugaagcgcaaaugccucagcaagagacucaugcucgcaaucaccauggcuacaaucuucacaguuaacucaacucuccccaucuacgccgcgguagacaaaaacaacgcaaccgccgccguccaaaaugaaucuaaacgauacacagucagcuaccuaaaaacccuuaacuacuacgaccucguagaccugcucgugaaaaccgaaaucgagaaccucccggaccuguuccaauauuccagcgaugccaaagaguucuacgggaacaaaacacgaaugucguucaucauggacgaaaucggacgccgagcgccccaauacaccgagauugaucauaagggaaucccgacgcucgucgaagucguccgagccggguucuaucucggcuuccacaacaaggaacucaacgagauaaacaaacgcucuuucaaggaacgcgucauaccguccauacuugccauacagaaaaaccccaauuucaagcucggaacagaaguacaagacaaaaucguauccgccaccggccugcuagccggaaacgaaaccgcaccaccagaagucgucaacaacuucacucccauccuucaagacugcaucaagaacaucgacagauaugcauuggacgaccuaaaaucaaaagcacuguucaacguucuagccgcgcccacauaugauauaaccgaauaccucagagcaacaaaggagaaacccgaaaacacucccugguacggcaaaaucgacggcuucaucaacgaacuaaagaaacucgcauuauacggcaaaaucaacgacaacaacaguuggaucauagacaacggcauauaccacaucgcgccacuaggaaaacuacacucuaacaacaaaaucggaaucgaaacacuaaccgaagucaugaagguauaccccuaccugagcaugcaacaccuucaaucugcagaucaaaucaaacgacacuacgacagcaaagacgccgagggaaacaagaucccauuagacaaauucaagaaagaaggaaaagagaaauacugcccaaagaccuacacguuugaugauggcaaaguaaucauaaaggccggcgcacgcgucgaggaagaaaaagucaaacgccuguacugggcgucaaaagaagucaacucccaauucuuccgagucuauggcaucgacaaaccccucgaggaaggcaaccccgacgacauacugacaauggucauuuacaacucgccugaggaauacaaacugaacucagugcuauacggcuacgacaccaacaacggcggcauguacaucgaacccgaaggcacuuucuucacuuacgagagagaggcccaagaauccacguacacacuagaagaacuuuuccgacacgaguacacccacuaccuccaaggccguuacgcagucccgggacaauggggacgaacgaaacucuacgacaacgacaggcugaccugguacgaagagggcggggcggaacuauucgcagggagcaccaggacaucggggauacuucccaggaaauccaucgucuccaacauccacaacacaacacgaaauaaucgguauaaacugagcgauaccguccacucaaaauacggcgcgucauucgaguucuacaacuacgccuguauguucauggacuacauguacaacaaagauaugggaauccucaacaaauuaaacgaccucgcuaagaacaacgacguagacggcuacgacaacuacauaagagaccuauccucaaacuacgcucugaacgacaaauaccaagaccacaugcaggaacgaaucgacaacuacgaaaaccucaccgucccguucgucgccgacgacuaccucgugagacacgccuacaaaaaccccaacgaaaucuacagcgagaucagcgaagucgccaaacucaaggacgcaaaauccgaggucaaaaagucucaauacuucagcaccuucacucuacgcggcucauacacgggcggcgccuccaaaggcaaauuagaagaccaaaaagccaugaacaaguuuaucgacgacagccucaagaaacuugacaccuacucguggaguggcuacaaaacucuaaccgccuacuuuacaaacuacaaagucgacucguccaaccgcgugacauacgacguagucuuccacggguaccuaccgaacgagggagacagcaaaaacagccuccccuacggaaaaauaaacggcacauacaagggaaccgaaaaagagaaaauaaaauucuccuccgaaggcucguucgaccccgaugguaagauaguauccuacgaaugggacuucggagacggcaauaaaagcaaugaggaaaacccagaacacucauacgacaaaguagggaccuacaccguuaaauuaaaagucacggacgacaaaggagagucgagcgucucaaccaccaccgccgagauaaaagaccuauccgaaaacaaacuacccguaaucuauaugcacgucccaaaaucaggcgcacucaaucaaaagguugucuucuauggaaaaggcaccuacgacccggacggcagcauagcgggcuaccaaugggacuuuggcgacgguucggacuucucgucagagcaaaacccuagccauguauacaccaagaaaggagaauacaccguaacccugcgagugauggauucaucuggccaaaugucugagaaaacaaugaaaauaaaaaucaccgacccaguauaccccaucgguaccgaaaaagaaccuaacaacaguaaagaaacugcaagcggacccaucguccccggcauuccugucucaggaaccaucgaaaacaccagcgaucaggacuacuucuacuuugauguaaucacccccggcgaagucaaaaucgacaucaacaaacuaggauacggcggagccacauggguggucuacgacgagaacaauaacgccgucucuuacgcaaccgacgauggacaaaaccucagcgguaaauuuaaagcagacaagcccggacgcuacuacauccaccuauacauguuuaacggcuccuacaugcccuaucgaauuaacauugagggcucaguaggccgcuga

SEQ ID NO: 902 - RNA, 3066 nt, Artificial Sequence
  derived and/or modified CDS sequence (opt8) from Clostridium histolyticum__BAA34542.1__ColH
augaaaagaaaaugccuauccaaacgccucaugcuugcaauaacaauggccacaauauuuaccgucaacuccacccuaccaaucuacgccgccguagauaaaaacaacgcaacagcagccguccaaaacgagagcaaacgauacaccguaucauaccucaagacccuaaacuauuacgaucuaguggaccuccucguaaagacggagaucgaaaacuuaccggaucuauuucaauacuccuccgacgcaaaagaguucuacgguaacaagacacgaauguccuucaucauggacgaaaucggacggcgcgcaccccaauacaccgaaaucgaccacaaaggcauacccacccuugucgaaguuguacgagccggcuucuacuuaggauuccacaacaaggaacucaacgaaaucaacaaacgcuccuucaaagaacgagucauccccuccauccucgcuauucagaagaacccaaacuucaagcucgggaccgagguacaagauaagauagucagcgccaccggccugcuggccggcaaugagaccgcgcccccagagguaguaaacaauuucaccccaauccuacaagauugcaucaagaauaucgaccgcuacgcccuggacgaccuaaaauccaaggcccucuucaacgugcuggccgcgcccaccuacgauaucaccgaauaccucagagcuaccaaagagaaacccgagaacacucccugguauggcaagauagacggcuuuauaaacgaacucaaaaagcuagcacuguacggcaagaucaaugauaacaauucauggaucaucgacaacgggauauaccacauugccccguuagguaaacugcacagcaacaauaaaauaggaaucgagacccuaacugaggucaugaaaguauaucccuaucuuagcaugcaacaccuacaauccgcggaccaaaucaagcgccacuacgacagcaaagacgcugaggggaacaaaaucccccuggacaaguucaagaaagagggcaaggagaaauacugcccaaaaaccuacaccuucgacgacggcaaagucauaaucaaagccggcgcgagaguagaggaagaaaaaguaaagcggcucuacugggccagcaaagaagucaacagucaauucuuccgcgucuacggcaucgauaaaccacuagaagagggaaaucccgacgacauacuaacaaugguaauauacaacagcccagaggaguacaaacugaacuccguccuuuacggauacgauacaaacaacgggggaauguauauagaaccggaaggcacauuuuucaccuacgaacgcgaggcccaggaaucaacauauacacucgaggaguuauuccgccacgaauacacccacuaccuacagggacgcuacgcaguaccagggcaguggggccgcacaaagcucuacgauaacgaccgccuaacgugguacgaagaagggggcgccgaacucuucgccggauccacccgcaccagcgggauccuaccgcgaaagaguauagugagcaacauccauaacaccacgcgcaacaaccgcuacaagcucucagacacaguccacagcaaguacggagcaucguucgaguucuacaacuacgcauguauguucauggacuacauguacaacaaagacaugggcauccucaacaaacucaacgaucucgcgaaaaauaacgacgucgacggauacgacaacuauauccgcgaccucucauccaacuacgcacucaacgacaaauaccaagaccacaugcaggaacgaauagacaacuacgaaaauuuaaccguaccauucguagccgacgacuaccuaguacgacacgccuacaaaaacccuaacgaaaucuacuccgagaucuccgaaguugccaaacucaaagaugccaaaucagaagucaagaaaucccaguacuucagcacauucacucugagaggcagcuacacgggcggcgcguccaaaggaaaacuagaagaucagaaagccaugaacaaauucaucgacgacucucuaaagaaacucgacacauacucguggagcgguuacaaaacacugacugccuacuuuaccaacuacaaagucgacaguucaaaucgagucaccuacgacgugguauuucacgguuaccuacccaacgaaggggacuccaaaaacucacuaccuuacggaaaaauaaaugggaccuacaaaggcacagaaaaagagaaaaucaaauucuccuccgaaggcagcuucgacccugacggaaagaucgugagcuaugaaugggacuucggcgacggcaacaaaucaaacgaagaaaaccccgagcauucauaugacaagguaggaaccuacacagucaagcugaaaguaaccgacgacaaaggggaaucaagcguaagcacuaccaccgccgagaucaaggacuuaagcgaaaacaaacugccaguaauuuauaugcacgucccaaaaucaggcgcccuaaaccagaaggugguauuuuacgguaaagggacguacgaucccgacggcagcaucgccggcuaucagugggacuucggugacggcagcgacuucucaagcgaacaaaaccccagccacguuuacacgaaaaagggcgaauacacagugacacuuagagucauggauagcucgggucaaaugagugagaaaacgaugaaaauaaagaucaccgaccccguguaccccaucggcaccgaaaaggaaccgaacaacucaaaagaaaccgccuccgggcccaucguacccgggaucccuguaucuggcacaauagaaaacacaagcgaccaagacuacuucuacuucgacgucauaacccccggcgaagucaaaaucgauaucaacaaacucggauacggcggagcgacauggguaguguacgacgaaaacaacaacgcaguauccuacgccacagacgacggccaaaaccucuccggcaaauucaaggccgacaagcccggacgauacuacauacaccucuacauguucaacggaucauacaugcccuaccggauaaacaucgaaggaucggugggacgguaa

SEQ ID NO: 903 - RNA, 3000 nt, Artificial Sequence
  derived and/or modified CDS sequence (opt8) from Clostridium histolyticum__BAA34542.1__HsALB(1-18)_ColH(41-1021)
augaaaugggucacauuuaucagccuccuuuuccuuuucagcucggccuacagcguccaaaacgaaaguaaaagauauaccguauccuaucucaaaacuuuaaacuauuacgaccuaguagaccuccugguaaagacugaaauagaaaaccugccagaccuauuccaauacagcuccgacgcuaaggaguucuacgggaacaaaacccgcauguccuucaucauggacgaaaucgggcgacgcgcaccacaguacaccgaaauagaccacaaagggauucccacucuagucgaggugguacgagccggauuuuaccuuggauuccacaacaaagaacucaacgaaauaaauaagcgaucauucaaagagcggguuaucccaagcauacuggcaauccaaaagaauccaaacuucaaacuuggcacagaaguccaggacaaaauagucuccgccaccgggcuccucgccgggaaugaaaccgcacccccagaagucgugaauaacuucacccccauucuccaggacuguauaaagaacaucgaccgcuacgcacucgacgaccuuaagucaaaagcgcucuuuaacguccucgcggcgccuacauacgacaucacagaauaccuucgcgcgaccaaggaaaagccagaaaacaccccaugguacggaaaaauagacggguucaucaacgaacuaaagaaacuagcgcuauacggcaaaaucaacgacaacaacagcuggaucauugacaacggcauauaucacauagcaccccugggaaaacuccacagcaauaacaagaucggcaucgaaacccuaaccgaaguaaugaaagucuacccguaccucuccaugcagcaucuccagagcgccgaccagauaaaacgacacuacgacucaaaagacgcagaagguaauaagaucccacuggacaaguucaaaaaggagggcaaagaaaaauacugcccuaaaacauacaccuucgacgacggaaagguaauaauuaaagccggagcacgaguagaagaagaaaaaguaaaacgccucuacugggccucaaaggaaguuaauucacaguucuuccgaguguacgguauagacaaaccacuggaggagggaaacccagaugacauacugacgaugguaauauacaacuccccggaagaauacaaacuaaauucaguacuguacggauacgacaccaacaaugggggaauguacaucgaaccagaaggcaccuucuucaccuacgagcgcgaagcccaggagucgacauauacccuagaagaacuguuucgccacgaguacacgcacuacuuacaagggcgcuacgccguccccgggcaguggggccgaaccaaacuguacgacaacgaccgccucaccugguacgaagaagggggagcagaacucuucgcaggaucgacccgcaccagcggaauacucccccgcaagaguauagucagcaacauccacaacaccaccaggaacaacagauacaaacuuucagacaccguucacagcaaguacggggccuccuucgaguuuuacaacuacgcaugcauguucauggauuauauguacaacaaagacaugggaauacuaaacaaacucaaugaccucgccaaaaacaacgacgucgacggcuacgacaacuacauccgagaccucagcagcaacuacgcccuaaacgacaaauaucaagaccacaugcaggagaggauagauaacuacgaaaaucucaccgugccauucguagccgacgacuaccucguacgucacgccuacaaaaaccccaacgaaaucuacagcgagaucucggaaguagcaaaacuaaaagaugcuaaaucagaggugaagaaaucccaauacuucucgaccuucacucuccgcggcuccuacacaggaggagccagcaaagguaaacuagaggaccaaaaagcaaugaacaaauucaucgacgacucccucaagaaacucgauaccuacagcuggagcggauacaaaacguuaaccgcauauuucaccaauuacaaaguggacaguuccaaccgaguaaccuacgauguaguguuccauggcuaccuacccaacgagggcgacagcaaaaacucacuccccuacggaaagaucaacgggacauacaagggcacggaaaaagagaaaaucaaauucagcucagaaggcuccuucgaccccgacggcaagauugucuccuacgagugggacuucggggacggcaacaaaucgaacgaggagaacccagaacacagcuacgacaaggucggcacguacaccgucaagcucaaaguaacagacgacaagggggaauccagcguaagcacgacaacagcagaaaucaaggaccuauccgaaaauaaacuaccggugauauacaugcaugucccuaaauccggcgcucugaaucagaaggugguauucuacgggaagggcacguacgaccccgacggauccauagcaggcuaccaaugggacuucggcgaugguucggacuuuucguccgagcagaacccaagccacguauacacaaagaaaggggaguauaccgucacacuucgagucauggacagcaguggccagaugagugagaaaacaaugaaaaucaaaaucacagaucccguuuacccgaucggcacagaaaaagaaccaaacaauuccaaagagacggcgucaggcccaaucgugcccggaauccccguuucgggaaccauagagaacacaagcgaccaagacuacuucuacuucgacgucaucaccccaggcgagguaaaaauagacauaaacaaacuaggauacggaggcgcaacaugggugguauacgacgaaaacaacaacgcggucagcuaugcaacggacgacggccaaaaccuaucaggaaaguucaaggccgacaagcccggaagguacuauauacauuuguacauguucaacggcagcuacaugcccuacagaaucaacaucgaaggcagcgucggccgcuga

SEQ ID NO: 904 - RNA, 3138 nt, Artificial Sequence
  derived and/or modified CDS sequence (opt8) from Clostridium histolyticum__BAA34542.1__HsALB(1-18)_ColH(1-40)_CS-F_ColH(41-102 1)
augaaaugggugaccuucauaucacuccuuuuccuauucucaucagcauacucgaugaaacgcaaaugccucagcaaacgacucaugcuagcuaucaccauggccacaauauucaccguaaacuccacccuacccaucuacgcggcaguggacaaaaacaacgccaccgccgcacgucgccgccggaaacgcguccaaaacgaaaguaagcgcuauacggugagcuaccucaaaacucucaacuacuaugaucuaguagaccuccuagucaaaacggaaauugaaaaccuccccgaccuauuccaguacucaucagacgcgaaagaguucuacggcaacaaaacccggauguccuucauaauggacgaaaucggaaggcgagcaccccaguauaccgagaucgaccacaagggcauccccacgcucguagaaguaguuagagcaggcuucuaccucggguuccacaacaaagaacuaaaugagaucaacaaacgcuccuucaaagaacgcgucauccccucaauacuagcaauccagaaaaaccccaauuucaaacuaggcaccgagguacaagauaaaaucguguccgcaacaggccuccuggcagguaaugaaaccgcgccgccagaaguagucaacaacuucacacccauccuucaggacugcaucaaaaacauagacagauacgcacucgacgaccucaaaagcaaagcacuauucaacguccucgcagcacccacauaugacauaacggaauaccuuagagcaaccaaagaaaaacccgaaaacacacccugguaugggaaaauagacggcuucaucaacgagcuuaaaaagcuggcacuuuacgggaaaauaaacgacaacaacagcuggaucauagacaacggcauuuaccacaucgcaccccuggggaaauugcacagcaacaacaaaaucggcauagaaacccucacggaggucaugaaaguuuacccauaccugucaaugcaacaccuccaauccgccgaccagaucaaacgacacuacgacagcaaagacgccgaaggcaacaagauaccacuagacaaguucaagaaagaaggcaaagaaaaauauugcccuaaaaccuacacauucgacgacggaaaaguaaucauuaaagccggcgcccguguagaagaagaaaaggucaaacgccuauacugggccagcaaagaaguaaauagccaauucuuccgcguauacgggauagacaaaccgcuagaagaaggaaaccccgacgacauacugaccaugguaauauauaacucaccggaagaauacaaacucaacagcguacuauacggcuaugacaccaauaacggaggaauguacaucgagccagaaggaacauucuucacguacgaacgugaagcacaagaauccacauacacccucgaggaacucuuccgucacgaguacacccacuaccuacaggggcgauacgccguacccggccaauggggccgcaccaaacuguaugacaacgaccggcucaccugguacgaagaagggggcgccgaacucuucgccgguucgaccaggacuucaggaauacugccccgcaagagcaucguaagcaacauccacaauacaacccgcaacaaccgcuacaaacuaucagacacaguccacuccaaauacggagcgucauuugaguucuacaacuacgcuugcauguuuauggauuauauguacaacaaagauauggggauccugaauaaacuaaacgaccuagcgaaaaacaacgacguugacggcuacgacaacuacauacgugaccucucaucaaacuacgcccuaaacgacaaauaccaggaccacaugcaagaacgcaucgacaauuacgaaaaccuaacagugccuuuugucgccgacgacuaccucguacggcacgcuuacaaaaaccccaacgaaaucuauucagaaaucucagaagucgccaaauuaaaagacgcuaaauccgaagucaagaagucccaauacuucuccacauuuacccucagaggcucauacaccggaggcgcauccaaaggcaaacuggaggaccaaaaagccaugaacaaauucaucgaugacagucuaaagaaacucgacaccuacuccugguccggauacaaaacgcuaacagccuacuucacaaacuacaaaguagacagcuccaaccgagucaccuacgacgucgucuuccaugguuaccuccccaacgaaggugacagcaaaaauucacuccccuacggcaaaauaaacggcaccuacaaaggcaccgaaaaggagaaaaucaaauucucaucggaaggcagcuucgacccagacgggaagauaguaucguaugaaugggacuucggggacggcaacaaauccaaugaagagaaccccgaacauuccuaugacaaaguggggaccuacacaguuaagcuaaaaguaaccgacgacaaaggcgaaucauccguaucaaccacaacggccgagauaaaagaucuaagcgaaaacaaacuccccguaauauacaugcacgucccuaaaucgggagcucucaaccaaaaagucguauucuacggaaaaggaacauacgacccugacggcuccauagccggcuaccaaugggacuuuggcgacggcagcgacuucuccagugagcaaaaccccucacacgucuacacgaaaaagggcgaauacaccgugacacuucgcguaauggacagcagcggccagauguccgagaaaaccaugaaaaucaagauuaccgacccagucuaccccauaggcaccgaaaaggaaccgaacaauagcaaggaaacagccagcggcccaauagucccggggauccccgucuccggcacgaucgaaaacacuuccgaccaggacuacuucuacuucgacguaauaacccccggcgaaguaaaaaucgacaucaacaaacuaggauacggaggcgccaccugggucgucuacgaugaaaacaacaacgccguauccuaugccacagacgauggccagaacuugucaggcaaguucaaagcugacaagcccggacgcuacuacauccaccuguacauguucaauggcuccuacaugccauaccgaauaaacaucgaaggaucggucggacgcuga

SEQ ID NO: 905 - RNA, 576 nt, Artificial Sequence
  derived and/or modified CDS sequence (opt8) from Homo sapiens__NP_001133.1__HsAMELX
augggcaccuggauccuauucgcaugccuccucggagccgccuucgccaugccccuccccccccaccccggccaccccggcuacaucaacuucucuuacgaaguccucaccccccuaaaaugguaccaaucaauucgcccccccuauccauccuacggcuacgaacccaugggcggcuggcuacaccaccaaauaauacccguccucucccaacaacacccccccacccacacccuccaaccccaccaccacauccccgucguccccgcacaacaacccgucaucccccaacaaccaaugaugccagucccaggccaacacucuaugacccccauccaacaccaccaacccaaccuccccccccccgcacaacaaccauaccaaccccaacccguccaaccacaaccccaccaacccaugcaaccccaaccccccguccaccccaugcaaccccucccaccccaaccaccccucccccccauguuccccaugcaaccccucccccccaugcuacccgaccuaacccucgaagccuggcccuccacagacaaaacaaaacgagaagaagucgacuaa

SEQ ID NO: 906 - RNA, 135 nt, Artificial Sequence
  derived and/or modified CDS sequence (opt8) from Homo sapiens__NP_001133.1__HsAMELX-TRAP
augccccucccaccccaccccggccaccccggauacauaaacuucuccuacgaaguccuaacaccccuaaaaugguaccaauccauacgcccacccuaccccuccuacggcuacgaacccaugggcggaugguaa

SEQ ID NO: 907 - RNA, 168 nt, Artificial Sequence
  derived and/or modified CDS sequence (opt8) from Homo sapiens__NP_001133.1__HsAMELX-LRAP
augccccucccaccccaccccggccaccccggcuacauaaacuucuccuacgaaguccucacaccacucaaaugguaccaauccauccgcccaccacccaugcuccccgaccucacccucgaagccuggcccuccaccgacaaaacaaaacgcgaagaagucgacuaa

SEQ ID NO: 908 - RNA, 207 nt, Artificial Sequence
  derived and/or modified CDS sequence (opt8) from Homo sapiens__NP_001133.1__HLA-A2-SP_HsAMELX(17-60)
auggccgucauggcaccccgaacccuaguccuacuccuauccggcgcccuagcccucacccaaaccugggccaugccacuaccaccccacccaggccaccccggcuacaucaacuucuccuacgaaguacucacaccacuaaaaugguaccaauccauccgaccacccuaccccuccuacggcuacgaacccaugggcggcugguaa

SEQ ID NO: 909 - RNA, 240 nt, Artificial Sequence
  derived and/or modified CDS sequence (opt8) from Homo sapiens__NP_001133.1__HLA-A2-SP_HsAMELX(17-47,168-191)
auggccguaauggcaccccgaacacucguacuccuccucuccggagcacuagcccucacccaaaccugggccaugccccuccccccacaccccggccaccccggcuacauaaauuucuccuacgaaguccucaccccccucaaaugguaccaauccauccgccccccccccaugcuccccgaccuaacacucgaagccuggcccucaaccgacaaaacaaaacgcgaagaagucgacuaa

SEQ ID NO: 910 - RNA, 579 nt, Artificial Sequence
  derived and/or modified CDS sequence (opt8) from Homo sapiens__NP_001134.1__HsAMELY
augggcaccuggauccuauucgcaugccuagucggcgccgccuucgccaugccccucccaccccaccccggccaccccggcuacaucaacuucuccuacgaaguacucaccccacucaaaugguaccaauccaugauacgcccacccuacuccuccuacggauacgaacccaugggcggcuggcuccaccaccaaauaauccccgucguuucccaacaacacccccucacccacacccuccaaucacaccaccacauccccguaguccccgcccaacaaccccgaguccgccagcaagcccucaugcccguaccaggccaacaaucaaugacccccacccaacaccaccaacccaaccucccccuccccgcccaacaacccuuccaaccccaacccguccaaccccaaccacaccaaccaaugcaaccccaaccacccguccaacccaugcaaccccuucucccccaaccuccccuaccacccauguucccccuccguccucucccacccauccuccccgaccuccaccucgaagccuggcccgccaccgacaaaaccaaacaagaagaaguagacuga

SEQ ID NO: 911 - RNA, 138 nt, Artificial Sequence
  derived and/or modified CDS sequence (opt8) from Homo sapiens__NP_001134.1__HsAMELY-TRAP
augccccuaccaccccaccccggccaccccggcuacauaaacuucuccuacgaaguccucaccccacucaaaugguaccaaucaaugauacgaccacccuacuccucauacggcuacgaacccaugggcggcugguaa

SEQ ID NO: 912 - RNA, 171 nt, Artificial Sequence
  derived and/or modified CDS sequence (opt8) from Homo sapiens__NP_001134.1__HsAMELY-LRAP
augccccuccccccacaccccggccaccccggcuacauaaacuucuccuacgaaguccuaacaccacucaaaugguaccaauccaugauccgccccccccccauacuccccgaccuccaccucgaagccuggcccgccacagacaaaaccaaacaagaagaagucgacuaa

SEQ ID NO: 913 - RNA, 210 nt, Artificial Sequence
  derived and/or modified CDS sequence (opt8) from Homo sapiens__NP_001134.1__HLA-A2-SP_HsAMELY(17-61)
auggccgucauggccccacgcacacucguccuccuacucucaggagcccucgcacucacacaaaccugggccaugccacucccaccacaccccggccaccccggcuacaucaacuucucauacgaaguccucaccccacucaaaugguaccaaucaaugauacgcccacccuacuccuccuacggcuacgaacccaugggcggaugguaa

SEQ ID NO: 914 - RNA, 243 nt, Artificial Sequence
  derived and/or modified CDS sequence (opt8) from Homo sapiens__NP_001134.1__HLA-A2-SP_HsAMELY(17-48,169-192)
auggcagucauggcaccccgcacccucguccuacuacucuccggcgcccucgcccucacccaaacaugggccaugccacucccaccccaccccggacaccccggcuacaucaacuucucauacgaaguccucaccccacucaaaugguaccaauccaugauccgacccccacccauccuacccgaccuccaccucgaagccuggcccgccaccgacaaaaccaaacaagaagaagucgacuaa

SEQ ID NO: 915 - RNA, 570 nt, Artificial Sequence
  derived and/or modified CDS sequence (opt8) from Sus scrofa__NP_999071.1__SsAMELX-001-1
augggcaccuggauccucuucgcaugccuccucggcgccgccuucuccaugccucuaccaccccaccccggccaccccggcuacauuaacuucuccuacgaaguccuaacuccccuaaaaugguaccaaaacaugauccgacaccccuacaccuccuacggauacgaacccaugggcggauggcuccaccaccaaaucauccccgucgucucccaacaaacaccccaaucccacgcccuacaaccccaccaccacauccccaugguacccgcccaacaacccgguauaccccaacaacccaugaugccccuccccggccaacacucaaugacccccacccaacaccaccaacccaaccuaccccuacccgcacaacaacccuuccaaccccaaccaguccaaccccaaccccaccaaccacuccaaccccaaucccccaugcaccccauccaaccccuccucccacaaccaccccucccacccauguucuccaugcaaucacuccuccccgaccucccccucgaagccuggcccgcaaccgacaaaaccaaacgcgaagaagucgacuaa

SEQ ID NO: 916 - RNA, 138 nt, Artificial Sequence
  derived and/or modified CDS sequence (opt8) from Sus scrofa__NP_999071.1__SsAMELX-TRAP
augccccuaccaccccacccaggccaccccggcuacaucaacuucuccuacgaaguccucacaccacucaaaugguaccaaaacaugaucagacacccauacaccucauacggcuacgaacccaugggcggcugguaa

SEQ ID NO: 917 - RNA, 171 nt, Artificial Sequence
  derived and/or modified CDS sequence (opt8) from Sus scrofa__NP_999071.1__SsAMELX-LRAP
augccacuacccccacaccccggccaccccggcuacauaaacuucucauacgaaguacucaccccacucaaaugguaccaaaacaugauccgacaccccucccuccuccccgaccucccccucgaagccuggcccgccaccgacaaaaccaaacgcgaagaagucgacuaa

SEQ ID NO: 918 - RNA, 210 nt, Artificial Sequence
  derived and/or modified CDS sequence (opt8) from Sus scrofa__NP_999071.1__HLA-A2-SP_SsAMEL(17-61)
auggcagucauggcaccccgcacacucguccuccuacuaucaggagcccucgcacucacacaaacaugggccaugccccuaccaccccaccccggacaccccggcuacauaaacuucuccuacgaaguccuaacaccccuaaaaugguaccaaaacaugauccgacaccccuacaccuccuacggcuacgaacccaugggcggcugguaa

SEQ ID NO: 919 - RNA, 243 nt, Artificial Sequence
  derived and/or modified CDS sequence (opt8) from Sus scrofa__NP_999071.1__HLA-A2-SP_SsAMEL(17-49,167-189)
auggccgucauggccccacgcacccuaguccuccuccuauccggcgcacucgcacucacacaaaccugggccaugccccucccaccacaccccggccaccccggcuacaucaacuucuccuacgaaguccucacaccccucaaaugguaccaaaacaugauccgccacccaucacuccucccagaccucccacucgaagccuggcccgccaccgacaaaaccaaacgcgaagaaguagacuaa

SEQ ID NO: 920 - RNA, 534 nt, Artificial Sequence
  derived and/or modified CDS sequence (opt8) from Sus scrofa__P45561-2__SsAMELX-001-2
augggcaccuggauacucuucgcaugccuccucggcgccgccuucuccaugccccucccaccccaccccggccaccccggcuacaucaacuucuccuacauccgccacccauacaccuccuacggcuacgaacccaugggcggcuggcuacaccaccaaaucauccccgucgucucccaacaaacaccccaaucccacgcccuacaaccccaccaccacaucccaaugguccccgcccaacaaccaggcaucccacaacaacccaugaugccccuacccggccaacacucaaugaccccaacucaacaccaccaacccaaccuaccccuacccgcccaacaacccuuccaaccccaacccguccaaccccaaccccaccaaccccuccaaccccaaucccccaugcaccccauccaaccccuccuaccccaaccaccccucccacccauguucucaaugcaaucccuacuccccgaccuaccccucgaagcauggcccgcuacagacaaaacaaaacgcgaagaagucgacuaa

SEQ ID NO: 921 - RNA, 570 nt, Artificial Sequence
  derived and/or modified CDS sequence (opt8) from Sus scrofa__NP_998965.1__SsAMELX-001-3
augggaaccuggaucuucuucgccugccuccucggcgccucccucgcaaugccccucccaccccaccccggccaccccggcuacaucaacuucuccuaugaaguacucacaccccucaaaugguaucaaaacaugauccgccaccccuacacauccuacggcuacgaacccaugggcggcuggcuacaccaccaaaucauacccgucgucucacaacaaacaccccaaucacacgcccuccaaccccaccaccacauccccaugguccccgcccaacaacccggcaucccccaacaacccaugaugccccuaccaggacaacacuccaugaccccaacccaacaucaccaaccuaaucucccccuccccgcccaacaacccuuccaaccccaacccguccaaccccaaccccaccaaccccuccaaccccaaucccccaugcacccuauccaaccccuccucccccaaccaccccucccacccauguucuccaugcaaucacuccuacccgaccucccccucgaagccuggccugccaccgacaaaacaaaacgcgaagaagucgacuaa

SEQ ID NO: 922 - RNA, 219 nt, Artificial Sequence
  derived and/or modified CDS sequence (opt8) from Sus scrofa__K7GPB2__SsAMELX-002
augggcaccuggauacucuucgccugccuccucggcgccgcauucucaaugccccucccaccacacccaggccaccccggauacaucaacuucuccuacgaaguacucaccccacucaaaugguaccaaaacaugauccgacaccccucacuccuccccgaccucccccuagaagccuggccagccaccgacaaaaccaaacgcgaagaagucgacuaa

SEQ ID NO: 923 - RNA, 612 nt, Artificial Sequence
  derived and/or modified CDS sequence (opt8) from Sus scrofa__K7GLD0__SsAMELX-003
augggcaccuggauccucuucgccugccuccuaggcgcugccuucuccaugccacucccaccccaccccggccaccccggcuacaucaacuucuccuacgaagaccuauaccucgaagccauacgcaucgaccgcaccgcauuuguccuaaccccacucaaaugguaccaaaacaugauccgacacccauacaccuccuacggcuaugaacccaugggaggcuggcuacaccaccaaaucaucccagucgucucacaacaaaccccucaaucucacgcccuccaaccacaccaccacauccccaugguccccgcccaacaacccggcaucccccaacaacccaugaugccccuccccggccaacacuccaugacccccacccaacaccaccaacccaaccucccccuccccgcacaacaacccuuccaaccccaaccaguccaaccccaaccacaccaaccccuucaaccccaaucccccaugcaccccauccaaccccuccuaccacaaccacccuuaccucccauguuuucuaugcaaucccuccuccccgaccucccccucgaagccuggcccgccaccgacaaaacaaaacgcgaagaaguagacuaa

SEQ ID NO: 924 - RNA, 498 nt, Artificial Sequence
  derived and/or modified CDS sequence (opt8) from Sus scrofa__K7GPE9__SsAMELX-004
augggaaccuggauccuauucgccugccuccuaggagccgccuucucaaugccccuaccaccccaccccggccaccccggcuacaucaacuuuuccuacgaaguccucaccccacucaaaugguaccaaaacaugauacgccaccccacaccccaaucccacgcccuacaaccccaccaccacauccccaugguccccgcccaacaacccggcaucccccaacaacccaugaugccccuccccggccaacacuccaugacccccacccaacaccaccaacccaaccucccccuccccgcccaacaacccuuucaaccccaacccguccaaccccaaccacaccaaccacuccaaccccaaucccccaugcacccaauccaaccccuccucccccaaccaccccucccacccauguucucaaugcaaucacuacuccccgaccucccccucgaagccuggcccgccaccgacaaaaccaaaagagaagaagucgacuaa

SEQ ID NO: 925 - RNA, 522 nt, Artificial Sequence
  derived and/or modified CDS sequence (opt8) from Sus scrofa__J9JIM4__SsAMELX-201
augccucucccaccccaccccggccaccccggcuacaucaacuucuccuacgaaguccucacaccccucaaaugguaccaaaacaugauccgccaccccuacaccucauacggcuacgaacccaugggcggcuggcuccaccaccaaaucauccccgucgucucccaacaaacaccccaaucacacgcacuccaaccccaccaccacauccccaugguccccgcccaacaacccggcaucccccaacaacccaugaugccacuccccggccaacacucaaugacccccacccaacaccaccaacccaaccucccacuccccgcacaacaacccuuccaaccacaacccguacaaccccaaccccaccaaccacuccaaccccaaucccccaugcaccccauccaaccccuacucccccaaccaccccuacccccaauguucucaaugcaaucccuccuccccgaccucccccucgaagcauggccagccacagacaaaaccaaacgcgaagaagucgacuaa

SEQ ID NO: 926 - RNA, 2961 nt, Artificial Sequence
  derived and/or modified CDS sequence (opt8) from Homo sapiens__NP_006120.1__HsBMP1
augccaggcguugcaagacuaccacuacucuuaggacuacuacuacuaccgcgaccaggacgaccccucgaccuagcagacuacaccuaugaccucgccgaagaagaugauagcgaaccgcuaaauuacaaagacccguguaaagcagcagcuuuucuaggcgacauagcccuggacgaggaagaccuucgggcguuccaaguacaacaggcaguagauuuacgccgacacacggcucgaaaaucaucaaucaaagcagccguuccaggaaacacgucaaccccaagcugucagucaacaaaugggcaaccccaacgcggagcgugcggacgauggcgaggccgcagcaggucccgcagagcagccaccucccgccccgaaagagucuggcccgauggaguaauaccguucguaauaggcggcaauuucaccggaucccagcgcgcggucuuccgccaagccaugagacacugggagaaacauaccugcgugacauuccucgaaagaacagacgaagacucauacauaguauucaccuaccgaccgugcggcugcugcagcuacguaggccgcagaggcggcgggccacaagcgaucagcaucggcaaaaacugcgacaaauucggaauagucguccacgaacucggccacguaguaggcuucuggcacgagcacacccgaccugaccgagaccgacacgucagcaucguaagagaaaacauacaaccagggcaagaauacaacuuccugaaaauggagccccaagaaguggaauccuuaggagaaaccuacgacuuugacucaaucaugcacuacgcaaggaacacauucucacgaggaauauuccucgacacaauaguucccaaguacgaagugaacgggguuaaaccuccgauuggccaaaggacaagacuaucaaagggcgacaucgcacaggcacgaaaacuguacaaaugccccgcaugcggggagacacuacaagacagcaccgggaacuucucaaguccggaauacccaaacggauacagugcucacaugcacugcguauggcggauaagcgucaccccgggcgagaaaauaauacuaaacuucacaagucuggaccuauaccggagccgccuuugcugguacgauuacguagaaguccgcgacggauucuggcgcaaagcgccacugaggggacgcuucugcggaucaaaacucccggaaccgauaguaucaaccgacucacgccucugggucgaguucagaagcagcucaaacugggucggaaaaggauucuuugcaguguacgaagcuaucugcggaggagacguaaagaaagacuaugggcacauacaaagccccaacuaccccgacgacuaccgcccuagcaaaguuugcaucuggcgcauacaagucagcgaaggcuuccacgucggccugacauuccagaguuucgaaauagaacgccaugacagcugcgccuacgauuaccucgaaguccgcgacggccacucggaaagcagcaccuuaaucggcagguacugcgguuacgaaaaaccagacgacauaaagagcaccucgagccgacucuggcuaaaauucguaagcgacggcagcauaaacaaagcgggcuuugcaguuaacuucuucaaagaaguggacgaaugcuccaggccaaaccgaggcgggugcgaacaaagaugucuaaauacacucggcagcuacaaaugcagcugcgacccgggauacgaacucgcccccgacaaaagaaggugcgaagccgccugcggaggguuccucacaaaacuaaacgggagcaucacuucaccgggauggccaaaagaauacccaccaaauaagaacugcaucuggcaacucgucgcacccacccaauaccgcaucagccuacaauucgacuucuucgaaaccgaaggcaacgacgucugcaaauacgacuucguugaaguccgcuccggacuaacagcagacagcaaacuacacgguaaauucugcggcuccgaaaagccagaagucauaacaagccaauacaacaauaugagagucgaguucaagagcgacaacaccgucagcaaaaagggauuuaaggcacacuucuucucagacaaagacgaaugcucaaaagacaacggcggcugccaacaagacugcguuaacacauucggcucauacgaaugccaaugcagaucagguuucgugcugcacgacaacaaacacgacugcaaagaagccggcugcgaccauaaaguuaccagcaccaguggaaccauaacaagccccaacuggccagacaaauacccaucgaagaaagaaugcacgugggcuaucuccagcacacccgggcaccgggucaaacucaccuucauggaaauggauaucgaaagccaaccggaaugcgcauacgaccaucuagaagucuuugacggccgagacgccaaagccccaguacucggcagauucugcggauccaagaaaccagaaccaguacucgcgaccgggagccgaauguuccuccgcuucuacagcgacaacuccgugcaacgcaaaggcuuccaagccucccaugcgacggaaugcggcggacaaguucgcgcggacgucaaaaccaaagacuuauacagccaugcacaguucggugacaacaauuaccccggaggcguagacugcgaaugggucauaguagccgaagaaggauacggcgucgagcucguauuccagacauucgaaguagaagaagaaaccgacugcggcuacgauuacauggaacuuuucgacggguacgacagcacagcgccacgccucggacgcuacugcggaucaggcccgccagaagaaguauacagcgcaggcgacuccguccuagucaaauuccauucugaugacaccaucacaaagaaaggcuuccacuugagauacacaaguacaaaauuccaagacaccuuacauucaagaaaauaa

SEQ ID NO: 927 - RNA, 1191 nt, Artificial Sequence
  derived and/or modified CDS sequence (opt8) from Homo sapiens__NP_001191.1__HsBMP2
auggucgccggaacucgcugccuccuagcccuccuacucccccaaguacuacucggcggcgccgccggccucguucccgaacucggacgacgaaaauucgccgccgcauccucuggaaggcccagcucccaacccuccgacgaaguucucuccgaguucgaacuccgccuccucucaauguucggccucaaacaacgccccacaccaucacgcgacgcagucgucccgcccuacaugcucgaccuauaccgucgucacucaggccaacccggaucccccgcccccgaccaccgucucgaacgcgcagccucgcgcgccaacacaguccgcuccuuccaccacgaagaaucccucgaagaacuacccgaaaccuccggcaaaacaacccgacgcuucuucuucaaccucagcuccauccccacagaagaguucauaaccuccgccgaacuacaaguauuccgcgaacagaugcaagacgcccucggaaacaacagcucauuccaccacagaaucaacauuuacgaaauaaucaaacccgccaccgcgaacagcaaauuucccgucacccgucuccucgacacccgccucgucaaccaaaacgccucccgcugggaaucuuuugacguaacacccgcagucaugcgcuggacagcacaaggccacgccaaccacggauucgucguagaaguagcccaccuagaagaaaagcaaggaguauccaaacgucacguacgaauaucacgcucccuacaccaagacgaacacuccuggucccaaauccgaccccuacucgucaccuucggccacgacggaaaaggacacccccuucacaaaagggaaaaacgccaagccaaacacaaacaacgcaaacgacucaaauccucaugcaaaagacacccccucuacguugauuucucagacgucggcuggaacgacuggaucguagccccacccggcuaccacgccuucuacugccacggcgaaugccccuucccccucgcagaccaccuuaauucaaccaaccacgcaaucguccaaacccucgucaacuccgucaacucaaaaauccccaaagccugcugcguccccaccgaacuaucagccaucuccauguuauaccuagacgaaaacgaaaaagugguccucaaaaacuaccaagacauggucgucgaagguugcggcugccgauaa

SEQ ID NO: 928 - RNA, 1227 nt, Artificial Sequence
  derived and/or modified CDS sequence (opt8) from Homo sapiens__NP_001193.2__HsBMP4
augauacccggcaaccgcaugcucauggucguccuccucugccaaguacuccucggaggagccucacacgccucacucauaccagaaacuggcaaaaaaaaagucgcugaaauccaagggcacgccggcggccgccgcuccggccaaucccacgaacuucuuagagacuucgaagccacccuacuccaaauguucggacuccgccgccgcccccaacccuccaaaucugcaguuauacccgacuacaugcgcgaccuauaccgucuacaaucaggcgaagaagaagaagaacaaauccauaguaccggccucgaauaccccgaacgccccgccucccgcgcaaauacaguccgcucauuccaucacgaagaacaccucgagaacauccccggaacguccgaaaacuccgccuuccgauuccucuucaaccuaucauccauccccgaaaacgaagucaucuccuccgccgaacuccgccuuuuccgcgaacaagucgaccaaggccccgacugggaacgcggcuuccaccgcauaaacaucuacgaaguaaugaaaccacccgccgaggucguccccggacaccuuaucacacgccuccucgacacccgacuaguccaccacaacgucacccgaugggaaaccuucgacguaucccccgcaguccuccgcuggacccgcgaaaaacaacccaacuacggacucgccauagaaguuacacaccuccaccaaacccgaacacaccaaggccaacacguccgaaucucccgcucccucccacaaggcuccggcaacugggcccaacuccgcccccuccucguaaccuucggacacgacggacgcggacacgcccucacccgacgccgccgagccaaacgcucccccaaacaccacucacaaagagccaggaaaaaaaauaaaaauugccgccgccacucacucuacguagacuucagcgacgucggcuggaacgacuggauagucgccccccccggcuaccaagcauucuacugccauggcgacugccccuucccacucgccgaucaccuaaacagcaccaaccacgccauaguccaaacccuaguaaacuccgucaacuccagcauacccaaggcaugcugcguacccacagaacugagcgcaaucuccauguuauaccucgacgaauacgacaaaguaguacucaaaaacuaccaagaaaugguaguagaaggaugcggcugccgcuaa

SEQ ID NO: 929 - RNA, 1542 nt, Artificial Sequence
  derived and/or modified CDS sequence (opt8) from Homo sapiens__NP_001709.1__HsBMP6
augcccggauuaggucgccgagcacaguggcucugcuggugguggggacuccucuguagcugcugcggaccccccccccuacgcccaccucuccccgccgcugccgccgccgccgccggcggccaacuacucggagacggcggaucacccggccgaacugaacaaccaccccccucaccccaauccucaagcggguuccucuaccgucgccugaaaacccaagaaaaacgcgaaaugcaaaaagaaauccuauccguccucggccucccccaccgcccccgcccccuacacggacugcaacaaccccagccaccagcccuacgucaacaagaagaacagcagcaacaacaacaauuaccaagaggagaaccacccccuggccgacugaaauccgccccacuauucaugcucgaccuauacaacgcacucagcgcagacaaugacgaagacggcgcaucagaaggagaaagacaacaaucauggccacacgaagcagccucaagcucccaacgaagacaaccaccacccggagcagcgcacccccuaaaccgcaaaucccuacuggcccccggauccggcagcggcggcgccuccccacuaaccagcgcccaagacucugcauuccuuaacgacgcagacauggucaugucauucguuaaccuggucgaauacgacaaagaauucucgccccgacaacgacaucacaaggaauucaaauucaaccucagccagauacccgaaggcgaaguagucaccgccgccgaguuccgcaucuauaaagacugcgucaugggaucauucaaaaaccaaacauuccuaaucuccaucuaccaaguacuccaagaacaccagcaccgcgacagcgaccucuuccuauuagacacccgcguagucugggccucagaagaaggcuggcucgaauucgacauaacugccaccucaaaucuuugggucgucacaccacaacacaacaugggccuccaacucuccguagucacccgugacggaguccacguacacccccgagcugccggccucgucggacgagacggccccuacgacaaacaacccuucauggucgcauucuucaaagucuccgaaguccacguccgaaccacccgcucagccuccucccgucgcaggcaacaaucccgaaaccgauccacacaaucccaagauguagccagaguauccuccgccuccgacuauaacuccuccgaacucaaaacagcaugccgcaaacacgaacucuauguauccuuccaagaccuuggauggcaagacuggaucaucgccccaaaaggauacgccgccaacuacugcgacggcgaauguucauucccucuaaacgcccacaugaacgcaaccaaccacgccaucguacaaacacuuguccaccucaugaaucccgaguacguccccaaacccugcugcgcacccaccaaacucaacgccauaucagucuuauacuucgacgacaacucaaacguaauccugaaaaaauaccgcaacauggucguucgcgcaugcggcugccacuaa

SEQ ID NO: 930 - RNA, 1296 nt, Artificial Sequence
  derived and/or modified CDS sequence (opt8) from Homo sapiens__NP_001710.1__HsBMP7
augcacguccguucccugagagccgccgccccccacucguuugucgcccuaugggcaccccuauuccuccuucgaucagcacuugcagacuucucccuugacaacgaaguccacucguccuucauccaccgccgccucagaucacaagaacgacgagaaaugcaacgcgaaauacuuagcauccuaggccucccccaccguccccgaccacaucuccaaggcaaacacaacucagccccaauguucaugcucgaccucuacaacgccauggccgucgaagagggcggcggacccggcggucaaggcuucuccuacccauacaaagccgucuucagcacucaaggaccaccccucgcuucccuucaagacucccacuuccuaaccgacgcagauauggucauguccuucgucaaccuagucgagcacgacaaagaauucuuccacccccgcuaccaccaccgagaauuccgcuucgaccucuccaaaauacccgaaggcgaggccgucacagcugccgaauuccgcaucuacaaagacuacauccgcgaacgcuucgacaacgaaaccuucaggaucucagucuaucaaguccuacaagaacaucucggccgcgaauccgacuuauuccuccuagacucacgcacccucugggccucagaagaaggauggcucguauucgacaucacagccacaucaaaccacugggucgucaacccccgccacaaccucggccugcagcuaucaguagaaacccucgacggacaauccaucaaccccaaacucgccggucucaucggccgacacggcccacaaaacaaacagcccuucauggucgccuucuucaaagccaccgaaguccacuuccgaagcauccgcuccaccggauccaaacaacgcucccagaaucguuccaaaaccccgaaaaaccaagaggcccuacgcauggccaacgucgcagaaaacuccucaucagaccaacgccaagccugcaaaaaacacgaacuauacgucuccuuccgcgaccucggauggcaagacuggaucaucgcaccagaaggcuacgccgccuacuacugugaaggagaaugcgccuuuccucucaacuccuacaugaacgccaccaaccacgcaauuguacaaacccuaguucacuucaucaacccagaaacagucccaaaacccugcugugcccccacacaacuaaacgcaauauccguccucuacuucgacgauuccucgaacguuauccucaaaaaauaccgcaacaugguaguccgagccugcggaugccacuga

SEQ ID NO: 931 - RNA, 300 nt, Artificial Sequence
  derived and/or modified CDS sequence (opt8) from Homo sapiens__NP_006264.2__HsCCL7
augaaagccucagccgcccuccucugccuccuccucacagcagccgccuucuccccccaaggccucgcccaaccagucggcaucaacaccuccacaaccugcugcuaccgcuucauaaacaaaaaaauacccaaacaacgccuagaauccuaccgcagaaccacauccucacacugcccccgcgaagccgucaucuucaaaaccaaacuagacaaagaaaucugcgccgaccccacccaaaaauggguccaagacuucaugaaacaccuagacaaaaaaacacaaacccccaaacucuaa

SEQ ID NO: 932 - RNA, 3624 nt, Artificial Sequence
  derived and/or modified CDS sequence (opt8) from Homo sapiens__NP_001954.2__HsEGF
augcuguuaacgcuaaucauccuacuaccagucguaagcaaguucucuuuugucucccugagcgcgccccagcauugguccugcccagaaggcacccucgcaggcaauggaaacagcacaugcguaggcccggcuccauuccuaaucuucagccauggcaacagcaucuuuagaaucgacaccgagggcaccaacuacgaacaacucgugguagaugccggagugagcguaauaauggacuuccacuacaacgaaaaacgcauauauugggucgaccuagaacggcagcuccuccaaaggguauuucucaacggaucccgacaggagcgggugugcaauaucgagaaaaacgucuccggaauggcaaucaacuggaucaacgaagaagucaucuggagcaaucagcaggaaggaaucauaacagucacugauaugaagggcaauaacucccacauacuacucucagcacuaaaauaccccgccaacguagcaguagauccuguggaacgcuucaucuucuggagcucagagguagccgguagccucuacagagcggaucuugacggagugggugugaaagcacuuuuagaaacaagcgagaaaauaaccgcaguaucccuugacgugcucgacaaacgacuauuuuggauucaguacaaucgggaaggcucgaacucccuaauaugcucgugcgauuacgacggcggaagcguacacauaagcaagcaccccacgcagcacaaccucuuugcaaugucccuguucggugaccgaaucuucuacuccaccuggaaaaugaagaccauauggaucgcgaacaaacauacagggaaagauauggucagaaucaaccuacacagcuccuucgucccccuaggagaacuaaaggucguacauccacucgcccaacccaaagcggaagacgacaccugggaaccggaacaaaaauugugcaaauuaagaaaggguaauugcuccagcacugucugcgggcaagaccuccaaucacaccucugcaugugcgcggaaggguaugcccugagccgggaccgcaaauauugcgaagacgucaaugaaugcgccuucuggaaccacggauguacgcuugguugcaaaaacacacccgggagcuacuacuguaccugccccguaggcuucguccuacugccggacggcaagcggugucaucagcuagucaguugcccacgcaacguuucagaaugcagccacgacugcguccuaacauccgagggaccacucuguuucugcccagaaggcucagugcuagaaagagacggaaaaacaugcagcgggugcucaagcccagauaauggcgggugcucgcaacuaugugugccacuauccccugucuccugggaaugcgacugcuuccccggauacgaucuccaacucgacgaaaagucaugcgccgccaguggcccccaacccuuucuucuauucgccaacagccaagacauucgccacaugcacuucgacggaacagacuacggaacccucuuaucucaacagaugggcaugguuuacgccuuagaucacgacccuguggaaaacaaaauauacuucgcccacacagcacuaaaauggaucgaaagagcaaauauggacggcucacaacgagaacgccucauagaagagggcguagacguacccgaaggccuagcgguugacuggauaggcagaagguucuacuggacugaccgaggcaagucucugauagggcgcucggaccugaacggcaaacgcuccaaaaucauaacaaaggagaacaucucccaacccagaggaaucgcaguucacccaauggccaaacgacuguucuggaccgacacuggaaucaacccgcggaucgaaucuuccagucuacaggggcuggggcgucucguuauugcaucgagcgaccugauauggcccagcggcauaacgauagacuuccugacagacaaacuguacuggugcgacgcaaaacaaagcgugaucgaaauggccaaucucgacggaucaaaaagacgcagacucacacagaacgacgugggccacccuuucgcuguagccguauucgaagacuacgucugguucucagacugggccaugcccagcguaaugcgaguuaacaaacgcaccgguaaagacagaguccgucuccaaggcucaaugcuaaagccuaguucccuuguaguaguacauccacuagcuaaacccggugcagacccgugccuauaccagaacgguggaugugaacacauuugcaaaaagcgauugggaaccgccuggugcagcuguagagaaggauucaugaaagcgagugacggaaaaacaugccucgcacucgacggccaccagcuccuagccggaggggaaguagaucucaaaaaccaagugacgcccuuagacauacuaagcaaaaccagaguaucggaggacaacaucacggagagccaacacaugcuuguagcugaaaucaugguaagcgaccaagacgauugcgcgccagucggaugcagcauguacgcacggugcaucuccgaaggugaagaugcuaccugccagugccuaaaaggauuugcgggagacggcaaacuauguagcgauaucgacgaaugcgaaaugggagucccugucuguccgccagcaagcuccaaaugcaucaacaccgagggagguuacguaugccgaugcuccgagggauaucaaggagacggcauacacugccucgacauagacgaaugccaacugggagagcacuccugcggcgaaaacgcaagcuguaccaacacagagggcggcuacacaugcaugugcgccggccgccuaucugaacccggacucaucugccccgacucgaccccuccuccgcaccuacgugaggacgaccaccauuacagcgugcgaaauuccgacucggagugcccccuaucccacgacggauacugccuucaugacggcgucugcauguauaucgaagcccuagacaaauacgcguguaauugcguugucggcuacaucggggaacgaugccaguaccgcgaccuaaaauggugggaacuaaggcacgccgggcauggccagcagcagaaagucauagucguggcagucugcguaguggugcucgucaugcuacuccuacuaucacucuggggagcgcacuacuaccgcacccaaaaacuucuaagcaaaaaucccaaaaacccauacgaggaaucaagccgggauguucgaucgaggcgaccagcggacacagaagauggcaugagcucgugcccgcagcccugguucguggugaucaaggagcaucaagaccugaaaaacgggggacaaccaguagccggugaagacggccaagcagccgacgguagcaugcagccaaccucauggagacaagaaccacaacucugcgguaugggcacagaacagggcugcuggauucccgucucauccgacaagggcagcugcccccaaguaauggagcgauccuuccacaugccaagcuacggaacgcagacccuagaaggcgggguagaaaagccgcauucccugcugucugccaacccccuguggcaacagcgcgcacucgacccaccucaccagauggaacucacacaauga

SEQ ID NO: 933 - RNA, 510 nt, Artificial Sequence
  derived and/or modified CDS sequence (opt8) from Homo sapiens__NP_001423.1__HsEREG
augaccgccggccgacgaauggaaaugcucugcgccggccguguccccgcacuucuccucugccucggauuccaccuacuccaagccguccucuccaccaccgucauccccucaugcauccccggagaauccuccgacaacugcaccgcccuaguacaaacagaagacaacccccgcgucgcacaaguuuccaucaccaaaugcuccucagacaugaauggcuacugccuccacggacaaugcauauaccuagucgacaugucccaaaacuacugccgcugugaagucggauacacaggcguccgcugcgaacacuucuuccucaccguccaccaaccccuauccaaagaauacgucgcccucaccgucauccucauaauccuauuccucaucacaguugucggcuccaccuacuacuucugccgcugguaccgcaauagaaaauccaaagaaccaaaaaaagaauacgaacgcguaaccucaggcgaccccgaacucccacaagucuaa

SEQ ID NO: 934 - RNA, 468 nt, Artificial Sequence
  derived and/or modified CDS sequence (opt8) from Homo sapiens__NP_000791.1__HsFGF1
auggcagaaggcgaaauaaccacauucaccgcccucaccgaaaaauucaaccuccccccaggcaacuacaaaaaaccaaaacuccuauacugcuccaacggcggacacuuccuccgcauccuccccgacggcacagucgacggaaccagagaccgcucagaccaacacauccaacuccaacucuccgccgaaucagucggagaaguauacaucaaaagcaccgaaaccggacaauaccuagccauggacaccgacggcuuacucuacggcucacaaacccccaacgaagaaugccucuuccucgaacgccucgaagaaaaccacuacaacacauacaucuccaaaaaacacgcagaaaaaaacugguucgucggccucaaaaaaaacggcuccugcaaacgcggcccccgcacccacuacggccaaaaagccauacucuuccucccccuccccgucucaucagacuaa

SEQ ID NO: 935 - RNA, 867 nt, Artificial Sequence
  derived and/or modified CDS sequence (opt8) from Homo sapiens__NP_001997.5__HsFGF2
augguggggguagggggaggggauguggaggauguaacgccgaggccagggggaugccaaauaaguggaagaggggccaggggauguaacgggaucccgggagcggcagcgugggaggcagcgcugccgagaaggagaccgagaaggcacccgagugugaacccgaggagcagggcggcagggagcccgagaacaagagggagaaggacagaggaaagaccaucggggagcagguugggggaucgagggcgaggaagggcgcugccgggagggagauugggagggagagggagggggagagcgccagagagggugggaggaagggggagaggaagagggacggcggcaccgagggcggcgccggcggcaaggggaagcagaccagggccggcgggaacgauggcggcggggagcauaacgacgcuaccagcauugcccgaagacggaggaucgggcgcauucccgccagggcauuuuaaagauccgaagaggcuguacuguaaaaauggaggguucuuucugagaauacauccggauggacggguagauggagugagagagaagagugacccgcacauaaaguugcaacugcaagcggaagagagaggaguagugagcauaaaagggguaugugccaacagauaucuagcaaugaaggaagauggaaggcuacuggcaagcaaguguguaacggacgagugcuuuuucuucgaaaggcuagagaguaacaacuauaacacguacagaagcaggaaauauacaaguugguauguggcgcuaaagaggacgggacaauacaagcuggggagcaagacagggccggggcaaaaggcaauacuguuuuuaccaaugagugcgaagaguuaa

SEQ ID NO: 936 - RNA, 585 nt, Artificial Sequence
  derived and/or modified CDS sequence (opt8) from Homo sapiens__NP_002000.1__HsFGF7
augcacaaauggauccuaaccuggauccuacccacccuucucuaccgauccugcuuccacaucaucugccuaguaggaaccaucucacucgcaugcaacgacaugacacccgaacaaauggccaccaacgucaacugcuccuccccagaacgccacacacgcagcuacgacuacauggaaggcggagacauccgcguccgccgccucuucugccgaacacaaugguaccuccgcaucgacaaacgcggcaaaguaaaaggcacacaagaaaugaaaaacaacuacaacaucauggaaauacgcacaguagccgucggaaucguagcaaucaaaggcgucgaauccgaauucuaccucgccaugaacaaagaaggcaaacuauacgccaaaaaagaaugcaacgaagacugcaacuucaaagaacucauccuagaaaaccacuacaacacauacgcaucagccaaauggacccacaacggaggcgaaauguucgucgcccucaaccaaaaaggcauccccgucagaggcaaaaaaaccaaaaaagaacaaaaaacagcacacuuccuccccauggccaucaccuga

SEQ ID NO: 937 - RNA, 627 nt, Artificial Sequence
  derived and/or modified CDS sequence (opt8) from Homo sapiens__NP_001936.1__HsHBEGF
augaaacuacuccccuccgucguccuuaaacucuuccucgccgccguacucuccgcacucgucacaggcgaaucacucgaacgacuccgccgaggccucgccgcaggcaccucaaaccccgaccccccaaccguguccacagaccaacuacuaccacucggcggaggacgcgaccgcaaaguccgcgaccuccaagaagcagaccuagaccuccuccgagucacccucuccuccaaaccccaagcccuagccacccccaacaaagaagaacacggcaagcgaaaaaaaaaaggcaaaggccuaggcaaaaaacgcgacccaugccuacgcaaauacaaagacuucugcauccacggcgaaugcaaauacguaaaagaacuccgagccccaucaugcaucugccaccccggcuaccacggagaacgcugccacggccuaucccuacccgucgaaaaccgccucuacaccuacgaccacacaacaauccucgccgucgucgcagucguccucucauccguaugccuccucgucaucgucggccuacucauguuccgcuaccaccgacgaggcggcuacgacgucgaaaacgaagaaaaagucaaacucggaaugacaaacucccacuaa

SEQ ID NO: 938 - RNA, 2187 nt, Artificial Sequence
  derived and/or modified CDS sequence (opt8) from Homo sapiens__NP_000592.3__HsHGF
augugggucaccaagcuacuccccgcucuccugcuacaacacguccugcuccaccuccuacuccuccccauagccauaccauacgccgaaggacaacgcaagcgccguaauacaauacaugaguucaagaaaagcgccaaaaccacccuuaucaaaaucgaccccgcccuaaaaaucaagaccaaaaaggugaacaccgccgaccaaugcgccaacagaugcaccagaaacaagggccuccccuucacaugcaaagccuucguauucgacaaggcccgcaaacaaugccuaugguucccauucaacuccauguccuccggcgucaagaaagaguucggccacgaauuugaccucuacgaaaauaaagacuacauccgaaacugcaucaucggcaaaggacgcucauacaaaggcaccguauccaucaccaaaucaggcauaaaaugccaacccuggagcucaaugaucccccacgaacacucauuucuaccauccuccuaccgaggcaaagaccuccaggaaaauuacugcaggaacccgcgcggggaagaaggcggacccuggugcuuuaccuccaaccccgaaguacgguacgaagucugcgacauaccccaaugcuccgaaguagaaugcaugacaugcaacggagaauccuaucggggccucauggaucacacagaaucagguaaaaucugccagcgcugggaccaccagaccccucaccgccauaaauuccucccagaacgcuacccagacaaaggguucgacgacaacuacugcagaaacccugacggccagccacgcccaugguguuacacacuagacccccacacccgaugggaauacugcgccaucaaaacaugugcagacaauacaaugaaugacaccgacgucccacucgaaaccaccgaaugcauccaagggcagggagaaggauaccgaggcacggucaacaccaucuggaacggcauacccugccaacggugggacagccaauauccgcacgaacacgacaugacuccagaaaacuucaaaugcaaagaccucagagagaacuacugcagaaaucccgacggauccgaaucacccuggugcuucaccacggaccccaacauccgcguaggcuacugcucacaaauaccaaacugcgauaugagccacggucaagacugcuaucgcggcaacggcaaaaacuacaugggaaaccucucacagacccgcucaggccuaacguguagcaugugggacaaaaacauggaggaccuucaucggcacaucuucugggaacccgacgcauccaaacuuaacgagaacuacugccgaaacccagacgacgacgcccacgggccauggugcuacacaggcaacccacucaucccgugggacuauugccccauaagccgcugcgagggcgacacaaccccaacaaucgugaaccuggaccacccugucaucucgugcgcaaaaacaaaacagcuucgggucgucaacggcaucccaacacgaacaaacauaggguggauggucucucuacgcuacagaaacaaacacaucugcggcggcucacucaucaaagaaagcuggguccucacagcucgccaaugcuucccaucaagagaccucaaagauuacgaagccuggcuaggcauacacgacguacauggaaggggagacgaaaaaugcaaacaaguacuuaacguaagccaacucgucuauggcccagaaggaagcgaccucguccucaugaaacuagcacgcccagccguccucgacgacuuuguaagcaccauagaccuccccaacuauggcugcaccaucccagagaaaacgaguugcucagucuacggcuggggauacacgggacugaucaauuacgacggacuacuccgggucgcacaccucuacaucaugggcaacgaaaaaugcucccaacaccaccgcggcaaaguaacucucaacgaaagcgaaaucugcgccggagccgagaaaaucggcucaggcccaugcgaaggcgacuacggcggaccccuuguuugcgaacaacacaaaaugaggaugguacucggcguaauaguucccggcagggggugcgccaucccaaaccgacccggaauauuugucagaguagcauacuacgcgaaauggauucacaaaaucauacuaaccuacaaagucccccagucguaa

SEQ ID NO: 939 - RNA, 1926 nt, Artificial Sequence
  derived and/or modified CDS sequence (opt8) from Homo sapiens__NP_005336.3 __HsHSPA1A
auggccaaagccgccgcaaucggcauagaccucgguacgacguacagcugcguaggcgucuuccaacacggcaagguggaaauaaucgcuaacgaccaaggcaacagaaccacaccgucguacgucgcauucaccgacaccgaacgacucaucggggacgcggccaaaaaccaagucgcacuaaacccccaaaacacaguguucgacgccaaacgacucaucgggagaaaauucggcgaccccguaguccaguccgacaugaaacacuggcccuuccaaguaaucaacgacggagauaaacccaaaguacaagucagcuacaaaggagagaccaaggccuucuacccagaggaaaucucaagcauggugcugacaaaaaugaaagaaaucgcagaagccuaccuaggauacccagucacgaacgccgucaucaccguccccgcauacuucaacgacagccaaagacaggccaccaaagacgccggagucaucgcaggacucaauguccuacgaauaauaaacgagccaaccgcagccgccauagcauacggacucgaccgaacaggcaaaggagaacgcaacguccuaaucuucgaccucgggggcgggaccuucgacgucuccauccuaacaauagaugacggcaucuucgaagugaaagccaccgccggcgacacacaccucgggggagaagacuucgacaaccgccucguaaaccacuucgucgaagaauuuaagcgaaaacacaagaaagacaucagccaaaauaagcgcgcggugcgacgccugagaaccgcaugcgagcgagccaaacgaacgcucucauccucaacccaagcgucacucgaaaucgacucacucuucgagggaaucgacuucuacaccucaaucacgcgagcccgcuucgaagaauuaugcucagaccucuuccgaucaacacuagaacccgucgaaaaagcccucagagaugcaaaacuggacaaagcacaaauccaugaccuuguccuaguaggaggcucaaccaggauccccaaaguacaaaaacugcuccaagacuucuucaaugggcgagaccucaacaaguccauaaaccccgacgaagcagucgcauacggggcagcaguccaagcagcaauauuaaugggcgacaagucggaaaacguccaagaccuccuacuacuagacgucgcgccacuaagucuagggcucgaaaccgcgggaggcgucaugacugcccuaaucaaacgcaacuccaccauccccacaaaacaaacccaaauauucaccacauacuccgacaaccaaccaggaguacugauacaaguauacgaaggcgaacgagccaugaccaaagacaacaaccuacuaggacgcuucgaacucagcggaaucccacccgcccccagaggaguaccccaaauagaagucacauucgacaucgacgcaaacggcauccuaaacguuacagcgaccgacaaauccaccggaaaagcaaacaagauaacgaucacaaacgacaaaggcagacucuccaaagaggagaucgagagaaugguccaagaagcagagaaauacaaagcagaagacgaaguccaacgugaacgcgucagcgccaagaacgcacucgagucguacgccuucaacaugaaaagcgccgucgaggacgaaggacucaaggggaaaaucucagaagccgacaaaaagaaaguacucgacaaaugccaagaaguaaucagcuggcuagaugccaacacacucgccgaaaaagacgaguucgaacacaaacgcaaagaauuagaacaagucuguaaccccaucaucuccggacucuaccaaggcgcaggcggaccaggccccggcggcuuuggcgcacaaggccccaaaggcggcagcgguuccggccccacaauagaagaaguagacuga

SEQ ID NO: 940 - RNA, 1926 nt, Artificial Sequence
  derived and/or modified CDS sequence (opt8) from Homo sapiens__NP_005337.2 __HsHSPA1B
auggcaaaagcggcagcaaucggaaucgacuuaggcaccaccuacucgugcgugggagucuuccaacacggcaagguggaaaucaucgcaaacgaccagggcaaccgcaccacccccagcuacguagccuucacagacaccgaacgccugauaggagacgcagcgaaaaaccaggucgcacucaacccacaaaacacagucuuugacgcaaaacggcucauaggaagaaaauucggcgacccggugguccagagcgacaugaaacacuggcccuuccaggugauuaacgacggagacaagccgaaaguccaagucucguacaaaggcgaaaccaaggcauucuacccggaagaaaucuccuccaugguccuaaccaaaaugaaagaaauagccgaagcauaccucggcuaccccgucaccaacgcgguaauaaccguccccgcauacuuuaacgacagucaacgucaggccaccaaagacgcaggggucauagcagggcucaacguccuccgaaucaucaacgaacccaccgcagcagccauagcauacggucucgaccgcacaggcaaaggcgaacgaaacguccuaaucuucgaccuaggugggggcaccuucgacgucucaauccuaacaauagacgacggcauauucgaaguaaaggcaaccgcaggcgacacccaccuaggcggcgaagacuucgauaaccggcucgugaaccacuucgucgaagaguucaaacgcaagcacaagaaagacauaucgcaaaacaaacgagcaguaaggcgacuccgaaccgcgugcgaacgagcaaaaagaacccuaagcucgagcacgcaggccagccucgaaauagacucccucuucgaagggaucgacuucuacacaucaauaacacgagcacgauucgaagaacucugcagcgaucuauuucgcucaacccucgagccggucgaaaaagcccuccgcgacgcgaaacuagacaaagcccagauacacgaccuaguccuaguagggggaucaaccaggauaccaaaaguacaaaaacuacuccaagacuucuucaacgggcgcgaccugaacaaaucuaucaacccagacgaagccgucgcguacggcgccgcuguccaagccgcaauucugaugggagacaaaagugaaaacguacaagaucuccugcuacuagacguagccccacuaucacugggauuagaaaccgcgggcggagucaugaccgcccuaauaaaaagaaacucaacaaucccaacgaaacaaacacaaaucuucaccaccuacagcgacaaccaacccggagugcucauccaaguguacgaaggcgaacgcgcaaugacaaaagacaacaaccuccuaggaagauucgaacuauccggcaucccaccagccccacgcggagucccacagauagaagucacauuugacauagacgcgaacggaauacuaaacguaacagcgaccgacaaaucgacgggcaaggcaaauaaaauaaccaucacgaaugacaaagggcgccuaagcaaggaagagaucgaaagaauggugcaggaagccgaaaaguacaaggccgaggacgaaguccaaagagaacgggucagcgccaaaaacgcacuagaaucguacgccuucaacaugaaauccgcggucgaagacgaaggacucaaaggaaaaauaagcgaagcugacaaaaagaaaguacucgacaaaugccaagaaguaaucuccuggcucgacgcaaacacauuagccgagaaggacgaguucgaacacaaacgaaaagaacuugaacaaguaugcaaccccauuauuucaggccuauaccaaggagcaggagggcccgggcccggaggcuucggcgcgcaaggcccaaaaggaggauccggaagcggaccgacaaucgaagaagucgacuga

SEQ ID NO: 941 - RNA, 1926 nt, Artificial Sequence
  derived and/or modified CDS sequence (opt8) from Homo sapiens__NP_005518.3 __HsHSPA1L
auggcaaccgccaagggcaucgccaucgggauagaccucggaacaaccuacucaugcgucggagucuuccaacacggcaaaguggagauaaucgccaacgaccaaggaaaccgaacgacacccucauacguggcguucacagauacagagcgguuaaucggcgacgcagccaaaaaccaagucgccaugaacccacaaaacacggucuuugacgccaaaaggcuaauuggcagaaaauucaacgaccccguaguccaggccgacaugaaacucuggcccuuccaagucauaaacgaaggcggcaaacccaaaguccuagucucauacaaaggcgaaaacaaagcauucuacccggaagaaaucucgagcauggucuuaacaaaauuaaaagaaacggccgaagcauuccuuggacaccccgucacgaacgcaguaaucacaguccccgcauacuucaacgacucccaacgccaggcgacaaaagacgccggggucauagccggccuaaacguucugaggauaaucaacgagccgaccgccgcagccauagcguacggacuugacaaaggaggacaaggcgaacgccacguacucaucuucgaccugggcggcggcaccuuugacgucuccaucuuaaccaucgacgacggcaucuucgaaguaaaagccacggccggagacacacaccuuggcggagaagacuucgacaaccggcucgucagucacuuugucgaagaguucaagcgcaaacacaagaaagauaucucgcaaaacaaaagagcaguccgaagacuccgcaccgccugcgaacgcgccaagagaacacucagcagcucaacacaggcaaaccuggaaaucgacucacucuacgaaggcauagacuucuacaccucaauaacacgagcgcgcuucgaagaacuaugcgccgaccucuucagagggacccuggaaccggucgaaaaagcccuccgagacgccaaaauggacaaagcaaaaauccacgacauaguccuaguaggugggucaacccgaauccccaaagugcaacgacuccuccaagacuacuucaacgggcgcgaccucaauaaaucaaucaaccccgacgaagcaguagcauacggcgcagcaguccaagcagcgauccuaaugggggacaagagcgaaaaaguccaggaucuccuccuccuugacgucgcaccucuaucucuaggacuagaaaccgcaggggguguaaugacagcacucaucaaaagaaacucaacaauacccaccaaacaaacacaaaucuucacaaccuacuccgacaaccaaccaggaguacuaauacaagucuacgaaggggaacgcgccaugaccaaagacaacaaccuccugggccguuucgaccuaaccgguaucccaccagcaccacgcggaguaccgcaaauagaagugacguucgacauagacgcaaacggaauccucaacgucaccgcgaccgacaaaucaaccggcaaagugaacaaaaucaccaucacaaacgacaaagggcgauuaagcaaagaagaaaucgaacgaaugguccucgacgcagaaaaauauaaggccgaagacgaaguccaacgagagaaaauagccgccaaaaacgcauuagaaucauacgccuucaauaugaaaagcguaguaucagacgaaggccuaaaaggcaaaaucagcgagagcgacaaaaacaagauacuagacaaaugcaacgaacuccuaagcuggcucgagguaaaccaacucgcagaaaaggacgaguucgaccacaaaagaaaagaacuagagcaaauguguaacccaaucauaacaaaauuauaccaaggaggcugcacggggcccgccugcggaacaggcuaugucccaggaagacccgccaccggccccacgauagaagaagucgacuaa

SEQ ID NO: 942 - RNA, 1920 nt, Artificial Sequence
  derived and/or modified CDS sequence (opt8) from Homo sapiens__NP_068814.2 __HsHSPA2
augagcgcccggggacccgcaaucggcaucgaccuaggaaccacauacagcugcguaggcguguuccaacacggaaaagucgagauaaucgccaacgaccaaggaaaccgaaccaccccaucauacguagcguucaccgacaccgaaagacucaucggggaugcagcgaagaaccagguggcuaugaaccccacaaacacaaucuucgacgccaaacgccuaauagggagaaaauucgaagacgcaacaguccaaucagacaugaaacacuggcccuucagggucgucucagaaggaggaaaacccaaaguacaagucgaauacaaaggcgaaacaaaaacguucuucccagaagagaucucauccaugguccucacaaagaugaaggaaauagccgaagccuaccuaggcggcaaaguccacagcgcagucauaaccguaccagcauacuucaacgacagccaacggcaagccacaaaagacgcaggaaccaucaccggguuaaacguacuacgaauaauaaacgaacccacagcagcagccaucgcguacggccucgacaagaaaggcugcgccggaggcgagaaaaacguacucaucuucgaccucggcggaggcacauucgacguaucgauacucacaauagaagacggcauauucgaagucaaaucaaccgccggagauacacaccuuggaggggaggacuucgacaacagaauggugagccaccuagcagaggaguucaaacgaaaacacaagaaagacauaggacccaacaaaagggccguacgcagacucagaacagcaugcgaaagagccaaacgaacacuaucauccuccacacaggccagcauagaaauagacucacuauacgaaggagucgacuucuacaccagcaucacacgcgccagauucgaagaacucaacgccgaccuauuccgaggcacccucgagccggucgagaaagcgcuccgagacgcaaaacucgacaaaggacaaauacaagaaauaguccucgucggaggcuccacccgaaucccuaaaauacaaaaacuacuccaagacuucuucaacggaaaagaacuaaacaaaucaaucaaccccgaugaagccguugcauacggcgccgcuguccaagcagcaauccuaauaggagauaaaagcgaaaacguacaagaccuccugcuacuagacgucaccccacucucacucggaaucgagaccgccggcgguguaaugaccccacucauaaaacgaaacaccaccauccccaccaaacaaacacagacguucaccaccuacuccgacaaccaaucauccgugcuagugcaagucuacgaaggcgaaagagccaugaccaaagacaacaaucuccucggcaaauucgaccugacgggcauacccccagccccacgaggcgucccccaaaucgaggucaccuucgacauagacgcgaacggcauccucaacgucacugcugcagacaaaucgacaggaaaggaaaacaaaaucaccaucacaaacgacaaggggcgccucagcaaagacgacaucgaccgaaugguacaagaagcagaacgcuacaagagcgaagacgaagccaacagagaccgcgucgccgccaaaaacgcccucgaauccuacacauacaacauaaaacaaaccgucgaagacgaaaaacuacgcggaaaaauaagcgagcaagacaaaaacaaaauauuagacaaaugccaagaaguaaucaacuggcucgaccgcaaccaaauggccgaaaaagacgaauacgaacacaaacaaaaagaacucgaacgaguaugcaacccgauaaucaguaagcuguaucaaggaggcccaggaggcggaagcggcggcggagguucgggcgcguccggaggcccaacaauagaagaagucgacuga

SEQ ID NO: 943 - RNA, 2523 nt, Artificial Sequence
  derived and/or modified CDS sequence (opt8) from Homo sapiens__NP_002145.3 __HsHSPA4
augagcgugguaggcauagaccugggcuuccagagcuguuaugucgcaguagcccgcgcaggcggcauagaaacaaucgcaaacgaguacagcgaccgcugcacaccggcaugcaucucguucggacccaaaaaccguagcaucggcgcggcagcgaaaagccaggucauaagcaaugcgaaaaacacaguccagggauucaaacgcuuccacggccgagcauucuccgacccauucgucgaagcagagaaaagcaaccuggcauacgacaucguccaguuaccgaccggccuaaccgggaucaaagucaccuacauggaagaggaacgcaacuucaccacagaacaagucaccgccaugcugcuaagcaaacugaaagagacugcagaguccguacucaagaaaccagugguggacugugucguaagcgugccgugcuucuacacggacgccgaacgacguagcgugauggacgcaacacaaauagcgggacugaacugucuccgccuaaugaaugaaacgacagcaguagcccucgcuuacggaauauacaaacaagaccuacccgcgcucgaagagaaaccccgcaacgucgucuucguggacaugggacacucggccuaccaagucuccgucugcgccuucaaccggggcaaacugaaaguccucgccaccgcauucgacaccacacuuggaggccgaaaauucgacgaaguucucgucaaccacuucugcgaagaguucgggaagaaauacaaacuugacauaaaauccaaaauccgagcacugcuccgacucagucaagaaugcgaaaaacuaaagaagcucauguccgcgaacgccagcgaccucccccuauccaucgaaugcuuuaugaacgacgucgacgucuccggaaccaugaaccgagggaaauuccuagaaaugugcaacgacuuacuagcgagaguagaaccaccccuacgaagcguacuagaacagaccaaauuaaagaaagaagauaucuacgcaguagaaauagugggcggagcaacccgcauacccgccguaaaagagaaaaucucaaaauucuuuggcaaagaacucucgacaacacuaaacgccgacgaagcagugacccgcgggugcgccuugcaaugcgcaauucucagccccgcuuucaaaguaagagaauuuucaauaacagacgucguaccauaccccauaucacuccgcuggaacuccccagcagaagaaggaagcuccgacugcgaagucuucuccaaaaaccacgcagcccccuucucuaaaguccucaccuucuaccggaaagaacccuucacccuagaagccuacuacucgucaccacaggaccuaccauaucccgaccccgcaaucgcgcaauucuccguccaaaaaguaacaccccagagcgacgggagcagcagcaaaguuaaaguaaaaguacguguaaacguacacggaaucuucucagucuccucagccucccucgucgaaguccacaaaagcgaagaaaacgaagaaccaauggaaaccgaccagaaugcaaaagaagaagagaaaaugcaagucgaccaagaagaaccccacgucgaggagcaacaacaacaaacuccagccgaaaacaaggccgaaucagaagaaauggagaccucacaagccgggucaaaagacaagaaaauggaucaaccgccccaagcgaagaaagcgaaagucaaaacauccacagucgaccuccccauagagaaccaacugcucuggcaaaucgaccgcgagaugcucaaccucuacaucgagaacgaaggaaaaaugaucaugcaggacaaacuagaaaaagaaaggaacgacgccaaaaacgccguggaagaguacgucuaugaaaugcgcgacaaauuaagcggagaguacgagaaauuugucuccgaagacgacagaaacuccuucacacuuaaacucgaagacaccgaaaacuggcuauacgaagacggcgaggaccagcccaaacaaguauacguggacaaacucgcagagcugaaaaaccuaggacaacccaucaaaauccgauuucaagaaagcgaagaacgccccaagcuguucgaggaacucggaaaacaaauccaacaauacaugaaaaucauaucauccuucaaaaacaaagaggaccaauacgaccaccucgacgccgcagauaugacgaaaguagaaaaguccaccaacgaagcgauggaauggaugaacaacaaacucaaccuacaaaacaaacaaucgcucacaauggaucccgugguaaagagcaaggagaucgaggcaaaaauuaaagaacucacauccacaugcagccccauaaucucaaaacccaaaccaaaggucgaaccgccaaaagaagaacagaagaacgccgagcaaaacggcccaguagacggccaaggcgacaacccaggcccccaagcagcggaacagggaaccgacacggccguccccucagauucggacaagaaacucccagaaauggacaucgacuaa

SEQ ID NO: 944 - RNA, 2520 nt, Artificial Sequence
  derived and/or modified CDS sequence (opt8) from Homo sapiens__NP_055093.2 __HsHSPA4L
augucaguggucggcaucgaccuaggcuuccucaacugcuacaucgccgucgcccgcuccggcgggauugaaacaaucgcaaacgaguacucggacaggugcacacccgcuugcauaucacugggaucgcggacgcgcgccauaggaaacgcagccaaaagccagaucguaacaaacgugcgcaacaccauccauggcuuuaaaaagcuccacggcaggagcuucgacgaccccaucguucaaaccgagcgcaucagacuaccauacgaauuacagaaaaugcccaacggcagcgccgggguaaaaguccgcuaccucgaagaagaacgaccuuucgcgaucgaacaaguuaccggaauguuacuagcaaaacugaaggaaaccucagagaacgcccucaagaaacccguggcagacugcguaauaucaaucccuagcuucuucacagacgcagaaagacguucaguaauggcggcagcccaaguagcagggcucaacugccuccgacuaaugaacgaaacaacagccguggcccucgccuacggcauauacaaacaagaccugccgccacuagacgaaaagccccgcaacgucguguucauagacaugggacacagcgccuaccaaguccucgucugcgccuuuaacaagggcaaacucaaaguccucgccacgacauucgaccccuaccugggcggacgcaauuucgacgaagcucucguagacuacuucugcgacgaguucaaaacaaaauacaaaaucaacgucaaggaaaacucaagagcccugcuccgacuauaucaagaaugcgagaaacuaaagaaacucauguccgcgaacgccagcgaccucccacuaaacaucgaauguuuuaugaacgaccuggacgucagcuccaaaaugaaccgcgcccaguucgaacaacucugcgccagccuacuagcacgcguggagccaccccucaaagccguaauggaacaagcgaaccuccagcgcgaggacauaucaagcaucgagauaguaggcggcgcgacgcgcauccccgccguaaaagagcaaaucacaaaauucuuccucaaagacauuucaacaacacuuaaugcagacgaagcaguagccaggggaugcgcucuacaaugcgccauccucagcccggcauucaaaguacgcgaguucuccaucacagaccuaguccccuacucaaucacacucagauggaaaaccucauucgaagacgggagcggagaaugcgaaguauucugcaaaaaccacccugccccauucagcaaagugauaacguuccacaagaaagaacccuucgaacuugaagcguucuacacaaaccuucacgaaguccccuacccugaugcgcgaaucgguucauucacaauacagaacguauucccccaaagcgacggcgacucgagcaaaguaaaagucaaaguccgcguaaacauccacggcaucuucucaguagcaagugccagcgugaucgaaaaacaaaaccucgaaggcgaccacagcgacgcccccauggagacagaaacaucguucaaaaacgaaaacaaagacaacauggacaaaaugcagguagaccaagaagaaggccaccagaagugccacgccgaacacacacccgaagaagaaaucgaccacaccggcgccaaaacaaaaucggcagucuccgacaaacaagaccggcuaaaccaaacccucaagaaaggcaaaguaaaaucaaucgaccuacccauacaguccucacucugccgccaacugggccaagaucuccuaaacucauacaucgaaaacgaaggaaaaaugauaaugcaagacaaacucgaaaaagaacggaacgacgccaaaaacgcgguagaggaguacgucuacgacuuucgggaccgacugggcacgguuuacgaaaaauucaucacacccgaagaccuaagcaagcuaucugcgguccuggaagauaccgagaacuggcucuacgaagacggcgaagaccaaccaaaacaaguguacguagacaagcugcaggaacugaagaaauaugggcaaccaauccaaaugaaauacauggaacacgaagaaaggcccaaagcacugaacgaccuaggcaagaaaauucaauuagucaugaaagugaucgaagcguacagaaacaaagacgaaagauacgaccaccucgacccuacagagauggagaaaguagagaagugcauaucagacgccauguccuggcuaaacagcaagaugaacgcccaaaacaaacucagccuuacgcaagaccccguggucaaagucucagaaauaguugcgaaaucaaaggagcuagauaacuucugcaaccccauaauauacaaaccgaagcccaaagccgaaguccccgaagacaagcccaaagccaacagugaacauaacgggccgauggacggacagucaggcacugagaccaaaagcgacucgacaaaagacagcagucaacacacaaagucguccggagagauggaagucgacuaa

SEQ ID NO: 945 - RNA, 1965 nt, Artificial Sequence
  derived and/or modified CDS sequence (opt8) from Homo sapiens__NP_005338.1__HsHSPA5
augaaacucagccuagucgcagccaugcugcugcuccucagcgcagcacgggcagaagaggaagacaagaaagaagacgugggaacaguaguaggcauagaccucggaacgacauacagcugcguagggguauucaaaaacggacgagucgagaucauagccaacgaccagggcaacagaauaaccccaaguuacguagcguucacacccgagggugaacgacugaucggagacgcagcgaaaaaccaacucacaagcaaccccgaaaacacaguauucgacgcaaagcgacuaauaggccgcaccuggaacgaccccucgguccagcaagacaucaaauuccugccauucaaagucgucgagaagaaaacaaaacccuacauacaaguagacauagggggcgggcagacgaaaacguucgcgccagaagaaauaagcgcaaugguacugacgaaaaugaaagagaccgcagaagcguaccugggcaagaaagucacccacgcagucguaacagugccagccuacuucaaugacgcgcaacgacaagcaacaaaggacgcaggaacaaucgcgggacugaacgugaugcgaaucauaaaugaacccaccgccgccgcaauagcguacggacuagacaaacgggaaggcgagaaaaacauccuagucuucgaccugggcggagguaccuucgacguaagucuccugacaaucgacaacggcguauucgaagucguagcaacaaacggggacacacaccugggaggagaagacuucgaccagcgaguaauggagcacuucauaaaacuauacaagaagaaaaccggaaaagacguaaggaaagacaacagagccguacaaaaacucaggcgggaggucgaaaaagccaaacgcgcccuauccagccaacaccaagcgcgcaucgaaauagaaucauucuacgagggggaagacuucagcgaaacccuaacacgcgcaaaauucgaagaacugaacauggaccuauuccgcagcacgaugaaaccaguacaaaaaguccuagaggacagcgaccuaaagaaaagcgacauagacgaaauaguauuagugggcggcucgaccaggauaccaaaaauacaacaacugguaaaagaguucuucaacggcaaagaaccaucgcgagggaucaacccagacgaagccgucgcauacggagccgcaguucaagcaggaguacugagcggcgaccaagacacaggagaccucguacuacuggacgugugcccacucacccuaggcauagaaacaguaggcgggguaaugacaaaacucauaccaagaaacacggucgugcccaccaagaaaagccagauauucagcacggcaagcgacaaccaacccaccguaacgaucaaagucuaugaaggagaacgaccccucacaaaagauaaccaccuacugggcaccuucgaucuaacaggcauaccaccagccccaagagggguaccacaaauagaagugacauuugaaaucgacguaaacgggauucuccgagugaccgcggaagacaaaggaaccggaaacaaaaacaaaauaacgauaaccaacgaccaaaacagacucacaccggaagaaaucgaaagaauggucaacgacgcagagaaauuugccgaagaggacaagaaauugaaagagcgaauagacaccagaaacgaacucgaaagcuacgccuacucacucaaaaaccagauaggugacaaagaaaaacuaggagggaaacuaagcagugaagacaaagaaaccauggaaaaagccgucgaagagaaaaucgaauggcuagaaucacaccaagacgcagacauagaagacuucaaagccaaaaagaaagaacuagaagaaauaguacaaccaaucauauccaaacuauacggaagcgcagggcccccacccacaggagaagaggacacagcggaaaaagacgaacuauaa

SEQ ID NO: 946 - RNA, 1932 nt, Artificial Sequence
  derived and/or modified CDS sequence (opt8) from Homo sapiens__NP_002146.2__HsHSPA6
augcaagcaccccgggagcucgcagucggcauugaucucggaacaacauacuccugcguaggaguguuccagcaagggcgcguggaaauacucgcaaacgaccaaggcaaccggaccaccccaagcuacguggccuucaccgacacagagcggcugguaggagacgcagcaaaaagccaagccgcgcugaauccccacaacacagucuucgacgcaaaaaggcuaauuggaagaaaauucgcagacacaacaguacaaagcgacaugaaacauuggcccuuccgagucgucucagaagggggcaaacccaaggucagagucugcuacagaggugaagacaaaacauucuaccccgaagagauaucaagcauggugcucagcaaaaugaaagagacggccgaggcauaccucgggcaaccggucaaacacgcgguaauaacagucccagcauacuucaacgauagccaacgccaagccacaaaagacgccggagcaaucgccgggcucaacguccuacgaauaaucaacgaaccaacagcggcagcaaucgcuuacgggcuagacagaagaggcgcaggcgaacggaacguccugauauucgaccuaggaggaggaacauucgacguaucagugcuaagcaucgacgcaggaguauucgaagucaaagccacggcaggagacacacaccugggcggggaagacuucgacaacaggcuaguaaaccacuucauggaagaguuccggcgcaaacacgggaaagaccuaucagggaacaaaagagcccugcgaaggcugagaacagccugcgaacgcgcaaaaaggacacuaagcagcuccacacaagcaacacuagaaauagacucccucuucgaaggagucgacuucuauaccucgaucacgcgcgcacgauucgaagaacuaugcagcgaccucuuccgaucgacccuggaaccgguagaaaaagcccuaagagacgcgaagcuagacaaggcccaaauacacgacguaguccucguaggaggaucgacacgcaucccaaaaguacaaaaacuccuacaagacuucuucaacgggaaagaacucaacaagucaauaaaccccgacgaagcaguggccuacggugccgcaguucaggccgcaguccugaugggcgacaagugcgaaaagguucaagaccuacuacuccuagacguggcaccccucucccucggacuagagacagcgggcggagucaugacuacacuaauccaaagaaacgcaaccaucccaacaaagcaaacacaaacauucacaaccuacucagacaaccaaccaggcguauucauccaagucuacgagggcgaacgcgcaaugaccaaagauaacaaccuacugggccgauucgagcucucaggcauacccccagcaccccgaggagucccacaaauagaaguuacauucgacaucgacgccaacgggauauugagcgugaccgcaacagaccgcucaaccggaaaggcaaacaaaauaacaauaacaaacgauaaaggacgacuaagcaaagaagaaguggagcgcaugguacacgaggcggaacaauacaaggccgaggacgaagcccaacgggacagaguagccgccaaaaacagccuggaagcgcacgucuuccacgucaaaggaucacuacaggaagaaucccuccgagacaaaauacccgaggaagacagacgaaaaaugcaagacaagugccgagaaguccuagccuggcucgaacacaaccaacuggccgaaaaagaagaauacgaacaccaaaagcgagaacuagagcaaauaugcagaccaauauucucgagacuauacggcgggccgggcguaccuggcggaucgagcugcggcacccaagcccgacaaggcgacccaucaaccgggccuauaaucgaggaaguggacuaa

SEQ ID NO: 947 - RNA, 1104 nt, Artificial Sequence
  derived and/or modified CDS sequence (opt8) from Homo sapiens__P48741__HsHSPA7
augcaagcaccacgcgaacucgcagucggaaucgaccuaggcaccacauacucaugcgucggcguauuccaacaaggaagagucgaaauccucgccaacgaccaaggaaaccgaaccacgccaagcuacgucgcauucacagacacagaacgccuggucggcgacgcagccaaaagccaagccgcacucaacccacacaacacaguauucgacgcaaaacggcucauaggccgcaaauucgccgacaccaccguccaaagcgacaugaaacauuggccauuccaagucguaagcgaaggcggcaaacccaaaguccgagucugcuacagaggcgaggacaaaacauucuacccagaagaaaucuccagcaugguacuaaguaaaaugaaagaaaccgcagaagcauaccuaggccaacccguaaaacacgcaguaauaaccguaccaaccuacuucucaaacagccaacgccaagcaacaaaagacgcaggagccaucgccggccucaaaguccucccaauaauaaacgaagcaaccgcagccgcaaucgccuacggacucgaccgacgaggcgccggcaaacgaaacguacucauauucgaccucggcggcggcaccuucgacguaagcguacuaagcaucgacgcaggagucuucgaagucaaagcaacggccggcgacacacaccuuggaggagaagacuucgacaacagguuagucaaccacuucauggaagaguuccgccgcaaacacggaaaagaccucucaggaaacaaacgcgcacugcgacggcuacgaacagcgugcgaacgcgcaaaacgcacccccuccagcagcacacaagccacucucgaaaucgacucacuguucgaaggcgucgacuucuacaaauccauaacacgcgcacgcuucgaagaacucugcagcgaccucuuccgcagcacccucgaacccguugaaaaagcccuacgcgacgccaaacuagacaaagcccaaauccacgacuucguccugggcggcggccuccacucacacccccaaggagccgaaguagcagcaggacuccugcaacgccaaggagcagaacaagaacaccaacccuag

SEQ ID NO: 948 - RNA, 1941 nt, Artificial Sequence
  derived and/or modified CDS sequence (opt8) from Homo sapiens__NP_006588.1 __HsHSPA8
augagcaaaggaccagcaguagggauagaccucggaaccacauacuccugcguagggguauuccagcacggcaaaguagaaauaauagcgaacgaccaaggcaaccggaccaccccuuccuacguagccuucaccgacacagagcgccucaucggagacgcggccaaaaaccaagucgcaaugaaccccaccaacacaguauucgacgcaaaaagacucauaggcaggcgguucgacgacgcagucguacaaagcgacaugaagcacuggcccuucauggucguaaacgacgcaggacgcccaaaaguccaaguagaauacaagggcgagacaaaauccuucuacccagaagaggucuccagcaugguacugaccaaaaugaaagagauagcagaagccuaccucggaaaaacuguaaccaacgcaguagucacagucccagccuacuucaaugacagccaacgccaggccaccaaagacgccggaaccaucgccggacuuaacguacuacgcaucaucaaugagccaacggcggccgcaaucgcguacgggcucgacaaaaagguaggagccgaaagaaacguccugaucuucgaccuaggaggaggaacauucgacgucucaauccucacaauagaagacggcauauucgaaguaaagagcacggccggcgacacacaccugggaggagaagacuuugacaacagaaugguaaaccacuucauagcagaguucaagcgcaagcacaagaaggacaucagcgaaaacaaaagagcaguacgccgccuccgcaccgccugugaaagagcaaaacgcacccucagcuccagcacccaagcaaguauagaaauugacucacuauacgaaggcaucgacuucuacaccagcaucacccgagcaagauucgaagaauuaaacgcagaccucuucagaggaacccuggacccagucgagaaagcacuacgagacgcaaaacuagacaaaagucaaauacacgacauaguccuagucggaggcagcacacgaaucccgaagauacagaaacuccuccaagacuucuucaacggaaaagaacuaaacaaaagcauaaauccagacgaagcagucgcauacggcgcagcgguccaagcggccauacuuucaggcgacaaaagcgagaacguacaagaccugcugcuccuggacgucacgccgcucucacuaggcaucgaaacagccggcggcguaaugaccgugcucauaaaacgcaacacaaccauaccaacaaaacagacccagaccuucacgacauacuccgacaaccagccaggcguacucauacaggucuacgaaggagaacgcgcaaugacaaaagacaacaaccuccuaggcaaauucgaacucacagggauacccccagcaccgcgcggagucccacaaauagaagucaccuucgacaucgacgcaaacggaauccuaaacguauccgccguagacaaaucaaccggaaaagaaaacaaaauaacgaucacaaacgacaaaggccgccuaagcaaggaggacaucgagagaaugguccaggaggccgaaaaauacaaagccgaagacgaaaaacaacgcgacaaaguaaguagcaagaacagccuggaaagcuacgcauucaacaugaaggcgacggucgaagacgaaaaacugcagggaaaaauaaacgacgaagacaaacagaaaauccuagacaaaugcaacgaaaucauaaacuggcuggacaaaaaucaaaccgccgaaaaagaagaauuugaacaccaacaaaaggagcucgaaaaagugugcaaucccauaaucaccaaacuauaccaaucagcgggaggaaugcccggagggaugccgggcggguucccaggagggggagcacccccaagcggaggcgcaagcucgggccccacgauagaggaggucgacuaa

SEQ ID NO: 949 - RNA, 2040 nt, Artificial Sequence
  derived and/or modified CDS sequence (opt8) from Homo sapiens__NP_004125.3 __HsHSPA9
augauaucagccagccgcgcggccgccgcaagacuggugggagcagccgcgagccgcggaccaacagcagcgcggcaccaagacagcuggaacggacugucacacgaagcauuccgacucgugaguagaagagacuacgcgagcgaagccauaaaaggggccguagucggaaucgaccucggaacaacaaauaguugcguagccgugauggagggaaaacaagccaaaguacuagagaacgcggagggagcgagaaccacaccaagcgucguagccuucaccgcagauggagaaaggcucguaggcaugcccgcaaaaagacaagcagugacgaacccaaacaacaccuucuacgcgacaaagcgccucaucggccgacgcuacgacgaccccgaggugcaaaaagacaucaaaaacguaccauucaaaauagugagagcaagcaacggcgacgccugggucgaagcccacggcaaacuauauagccccagccagauaggggccuucgucuugaugaaaaugaaagagaccgcagaaaacuaccuaggacacacagccaagaacgcaguaauaaccguaccugcauacuucaacgacagccagagacaagccacaaaggacgccggccagauaagcggacuuaauguacuacgcguaauaaacgaaccgacagccgccgcgcucgcauacggccuagacaaaagcgaggacaaaguaauagcaguauacgaccuaggagggggaacuuucgacaucucgauacuagaaauacaaaagggaguuuucgaggucaagucaacaaacggggacaccuucuuaggcggagaagacuucgaccaagcgcugcuacgccacaucgugaaagaguucaaaagagaaacaggggucgaccucacgaaagacaacauggcacuccaaagagucagagaagcggcagaaaaagcgaaaugcgaacuaagcagcagcguccaaacagacauaaaccuacccuaccuaacaauggauagcucaggcccaaaacaccugaacaugaagcucacgcgcgcgcaauucgaggggauagugacugaccucaucagaagaaccauagcaccaugccaaaaagcaaugcaagaugccgaaguaagcaaaagcgacauaggggaagucauccuagucggaggaaugacgaggaugccaaaaguacaacaaacaguacaagaccucuucgggagagccccguccaaggccguaaacccggacgaggcaguagccauaggagcggccauacaaggaggaguccuagccggggacguaacagacgugcugcugcucgacguaacaccccugucucugggcauugaaacccuaggaggcguuuucacaaaacucaucaacagaaacacgacgauaccgacuaagaaaucccaagucuucuccacagccgccgacggucaaacccaaguagaaaucaaagucugccaaggagagagggaaauggccggggacaacaaauuacucgggcaauucacccucaucggaaucccacccgcgccccgaggcgugccccagauagaggucacauucgacaucgacgccaacggaauaguacacguaagcgccaaagacaaaggaacaggccgggaacaacagauagucauacagucaagcggaggccucagcaaggacgacaucgaaaacauggucaaaaacgcagagaaguacgcagaagaggaccggagaaagaaagaacgcguggaagcaguaaacauggccgaagggauaauacacgacaccgagacaaaaauggaggaguucaaagaccagcugcccgcggaugaauguaauaaacuaaaagaagaaauaagcaaaaugagggaacuacucgcacgaaaggacucugaaacgggcgagaacauuagacaagcggcaagcagccuccaacaagcaucccugaagcucuuugaaauggcauacaagaaaauggcgucggaaagggaaggguccgggagcucaggcacgggagagcaaaaggaagaccaaaaggaggaaaaacaauaa

SEQ ID NO: 950 - RNA, 2028 nt, Artificial Sequence
  derived and/or modified CDS sequence (opt8) from Homo sapiens__NP_079291.2__HsHSPA12A
auggcggacaaagaagccggaggaagcgacggcccccgcgaaaccgccccaacauccgccuacagcucgcccgcccgcagccuaggagacaccggaaucacaccccucucucccucccacauugucaacgacaccgacuccaacguaucugaacaacaaucauuccucguaguagucgcaguagacuucggcaccaccucguccggauacgcauacucguucaccaaagaacccgaauguauccacguaaugagacgcugggaaggcggcgaccccggggucuccaaccagaaaaccccaaccaccauacuacucaccccagaaagaaaauuccacuccuucggauacgccgcccgcgacuucuaccacgaccucgaccccaacgaagccaagcaauggcucuacuuggaaaaauucaaaaugaaacuccauacaaccggagaccucaccauggacaccgaccucacagcugcaaacggcaagaaagucaaagcacucgagaucuuugccuacgcgcugcaauacuucaaagaacaagcccucaaagaacucuccgaccaagcagggucagaguucgaaaauagcgacguccgaugggucaucaccgucccagcaauuuggaaacaacccgcaaaacaauucaugcgccaagccgccuaccaagcuggccuagcuucaccagaaaacucagaacaacuaaucauagcacucgaaccggaagcagcaagcaucuacugcagaaaacuacgccuccaccaaaugaucgaacucagcucaaaagccgccgugaacggcuacuccggauccgacaccguaggcgcgggcuucacacaagccaaagaacacauccgucggaaccgccaaucacgaacauuccuagucgaaaacgucauaggcgaaaucuggagcgaacuagaagaaggcgacaaauacgucguagucgacucaggcggaggcacaguggaccucaccguacaucaaauccgccuaccagaaggccaccucaaagaacucuacaaagcuacaggcggaccauacggaucacugggcgucgacuacgaguucgaaaaacuacuauacaagaucuucggcgaagacuuuaucgaacaauucaaaaucaaaagacccgccgccuggguagaccucaugaucgccuucgaauccagaaagagggcagccgcgcccgaccgcacuaacccccugaacauaacacucccauucagcuucaucgacuauuacaagaaauuccgcggccacucaguugaacacgcccuccgcaaauccaacguagacuuuguaaaauggucaucccaaggcaugcuccggaugucccccgacgccaugaacgcccuauucaaaccaaccauagauuccauaaucgaacaccucagagaccucuuccaaaaacccgaagucucaaccguaaaauuccuuuuccuagucgggggauucgccgaagcgcccuuacuacaacaagcggugcaagcugcauucggcgaucaaugccgaauaauaaucccccaagacguaggccuaaccauacugaaaggggcaguacucuucggccucgaccccgcaguaaucaaaguccgacgcuccccacuaaccuacggcguaggcguacucaacagauacguagaaggaaaacauccaccagagaaacuccugguuaaagacggaaccagauggugcaccgacguauucgacaaauucaucagcgccgaccaaucaguugcacucggcgaauuaguuaagcgaagcuacacccccgcgaaaccaucccaacucgucaucgucauaaauaucuacagcucagaacacgacaacgucucguucaucaccgaccccggggucaaaaagugcggcacgcucagacucgaccucaccggcaccagcgggacggcaguaccagcgcgacgcgagauacaaacccucaugcaauucggcgacacagagaucaaagccaccgcgauugacauagcaacaucaaaaucugucaaagucggaaucgacuucuuaaacuacuaa

SEQ ID NO: 951 - RNA, 2061 nt, Artificial Sequence
  derived and/or modified CDS sequence (opt8) from Homo sapiens__NP_443202.3 __HsHSPA12B
augcucgccguccccgagaugggcuugcagggccuauacauaggcagcucacccgaaagaagcccagucccauccccaccuggaucccccagaacccaagaauccugcggaaucgcuccccucaccccaucacaauccccaaaaccggaaguccgcgcaccccaacaggccucauucucaguuguugucgccauagacuucggcacaaccucaagcggauacgccuucagcuucgccucagaccccgaagccauacauaugaugcgcaaaugggaggguggcgaccccggcgucgcccaccagaaaacgcccacuugccuacuccucaccccagaaggcgccuuccacuccuucggcuacacggccagagacuacuaccacgaccucgaccccgaagaagcaagggacugguuguacuucgaaaaauuuaaaaugaaaauucauagcgccacagaccuaacccuaaaaacgcaauuagaagcuguaaacggcaaaaccaugcccgcccucgaagucuucgcccacgcacuccgcuucuuccgagaacacgcacuccaagaacuaagagagcaaucacccagccuccccgagaaagacacaguacgcuggguacugaccguacccgccauauggaagcaaccagcgaaacaauucaugagagaggccgcauaccucgcagggcuaguaucccgggaaaacgcagaacaacuccucauagcauuagaaccagaagcagccucagucuauugcagaaaacuccgccugcaccaauugcucgaccucagcggccgcgccccaggaggcggucgacucggcgaacgacgaagcauagacucaucauuccgccaagccagagaacagcuccgccgauccagacacucacgaaccuuccuuguagaauccggcgucggagagcuuugggccgaaaugcaagccggggaccgauacgucguagccgacugcggcggcggaaccgucgaccuaacaguacaccaacuagaacaaccacaugguacccucaaagaacucuacaaagccuccggcggucccuacggagccguuggcguagaccucgcauucgaacaacuacucugcagaauauucggagaagacuuuauagcuaccuuuaaaagacaacgacccgcagccugggucgaccuaacuauagccuucgaagcacgcaaacgaacagccggcccacacagagccggcgcacucaacauaagccuaccauucucguucauagacuucuaccgcaagcaaagaggccacaacgucgaaaccgcccucagacgaucauccguaaacuucguaaaauggucaagucaaggaaugcugcgaaugucaugcgaagcaaugaacgagcuauuccaaccgacaguaagcggaaucauccaacacaucgaagcgcuccuagcgcgcccugaaguccaaggcguaaaacuucuauucuuaguuggaggauucgcagaaagcgccguacuucaacaugcaguccaagcagcacucggcgcacgcgggcuccgagucgucgucccccacgacguuggccuaaccauacucaaaggagccguccucuucggacaagccccaggggucguccgagugcgcagaucaccgcuaacauacggcguaggcgugcucaaucgcuucguaccaggcagacacccgcccgaaaaacuccuaguccgagacggacggcgcuggugcaccgacgucuucgaaagauucgucgcggcugaacaauccguagcccucggcgaagagguacgucgcagcuacugcccagcccgacccggacagagacgaguucucaucaaccucuacugcugugcagcagaagacgcccgguucauaacagaccccggcguaagaaaaugcggagcacucucccuugaacuagaaccggcagacugcggacaagacaccgccggcgccccacccggaagacgcgaaaucagagccgcaaugcaauucggagacacagaaaucaaagucacagcaguagacguaagcaccaacagaagcgucagagcaagcauagacuuccucucaaacuag

SEQ ID NO: 952 - RNA, 1416 nt, Artificial Sequence
  derived and/or modified CDS sequence (opt8) from Homo sapiens__NP_008879.3__HsHSPA13
auggcccgcgaaaugaccauacuaggcuccgccguauuaacccuccuccuugcaggcuaccuagcacaacaauaccucccacuaccaaccccaaaagucauuggcauugaccucggaaccacguacugcagcgucggcgucuucuucccuggaaccggcaaagucaaaguaauacccgacgaaaacggccacaucuccauaccauccaugguuuccuucaccgacaacgacguguacgucggauacgaauccgucgaacucgccgacagcaacccacagaacaccaucuaugacgcaaaacgauucaucggaaaaauauucacagccgaagaacucgaagccgaaaucggacgcuauccauucaaaguacuaaacaaaaacggcaugguagaguucuccgucacaagcaacgaaaccaucaccgucagccccgaguacguaggaucuagacugcuucuaaaacuaaaagaaauggccgaagccuaucugggcaugcccgucgccaacgcaguaaucucgguccccgcagaguucgaccuaaaacaacgaaacucaaccauagaagcggccaaccuagccggccucaaaauacuaagagucauaaacgaacccacugccgcggcuauggccuacggucuccacaaagccgacgucuuccacguccucgucaucgaccucggcggcggaaccuuagacgucagccuacucaacaaacaaggcggcauguuccucacccgcgcaaugagcggcaacaacaaacucggaggccaagacuucaaccaacgccuacuccaauaccucuacaaacagaucuaccaaaccuacggcuuuguaccaucccgcaaagaagaaauacaccgacuccgacaagccgucgaaauggucaaacucaaccugacccuacaccaaagcgcccagcuaucuguacuacuaaccgucgaagaacaagaccgcaaagaaccccacucaagcgacaccgaacuccccaaggacaaacucagcucugcggacgaccaccgcgucaacuccggcuucggccgaggcuuaucagacaagaaauccggagaaagccaaguccucuucgaaaccgagauaucccgcaaacuauucgacacacucaacgaagaccuauuccagaaaaucuuaguacccauacaacaaguccucaaagaaggccaccuggagaaaacagaaauagacgaagucguccuaguaggcggcagcacacgcaucccccgcauuagacaagucauccaagaguucuucggcaaagaccccaacaccuccgucgaccccgaccuagccgucgugaccgggguagcaauccaagccggcaucgacggaggcuccuggccacuacaggucucggcacuugaaaucccgaacaaacaccuccagaaaaccaacuucaauuaa

SEQ ID NO: 953 - RNA, 1530 nt, Artificial Sequence
  derived and/or modified CDS sequence (opt8) from Homo sapiens__NP_057383.2__HsHSPA14
auggcagcaaucggcguccaccucggaugcacaucagccugcgucgccgucuacaaagacgggcgcgccggcgucgucgcaaacgacgcgggcgaccgcgucacaccagccgucgucgcauacuccgaaaacgaagaaauaguaggccuagccgccaagcaaucccgcauacgcaacaucagcaacacagucaugaaaguaaaacaaauauuaggccgcuccuccuccgacccacaggcccaaaaauacaucgcagaaucaaaaugccucguaaucgagaaaaacggcaaacuacgcuacgagaucgacacuggcgaagaaaccaaguucguaaacccagaagacgucgcccgccuaaucuucucaaaaaugaaagaaacggcccacucaguccucggcuccgacgccaacgaugucgucauaaccguaccauucgacuucggcgaaaaacaaaagaacgcacuaggcgaagccgcccgcgcagcgggauucaacguccuacgccucauacacgaaccauccgcggcccucuuagcuuacggaaucggacaagacucccccaccggcaagucaaacauccuaguauucaaacuaggaggaaccucacuaucacucucagucauggagguaaacucaggcaucuaccgcguccucagcaccaacacagacgacaacaucggaggagcccacuucaccgaaacacucgcccaguaccucgccuccgaguuccagcgaucguucaaacaugacguacgaggaaacgcacgcgcaaugaugaagcucacgaacagcgcagaagucgcaaagcacucccuaagcacacuaggcagcgcaaacugcuuccuggacucauuauacgaaggacaggacuucgacugcaacguaagccgcgccagauucgaacuccucugcucaccccucuucaacaaaugcaucgaagccauacgcggacuacuagaccaaaacggguucaccgccgacgacaucaacaaagucguucucugcggcggauccagccgcauccccaaacugcaacaacucaucaaggaccuauuccccgccgucgagcugcuaaacuccauaccacccgacgaaguuauacccauuggagcagcaauagaggccggcauccucaucggcaaagagaaccuccucgucgaagacucccugaugaucgagugcuccgccagagacauacucgucaaaggcgucgacgaaucaggagcaucacgcuucacaguccuauuccccucuggaacaccccuuccagcacgacgacaacacacccuacaagcaccaggcagcauuuccuccgucugccuagaacucuacgaauccgauggcaaaaacucggccaaagaagaaaccaaguucgcacaagucguacuccaagaccucgacaagaaagaaaacggacuccgcgacauccuggccgugcucaccaugaagcgagauggaucacuacacgugaccugcaccgaccaggaaaccggcaaaugcgaagccaucagcaucgaaaucgcauccuaa

SEQ ID NO: 954 - RNA, 2577 nt, Artificial Sequence
  derived and/or modified CDS sequence (opt8) from Homo sapiens__NP_006635.2 __HsHSPH1
auguccgucgucggacuggacgugggaagccaaagcugcuacauagcagucgcccgggcagggggcaucgaaacaaucgccaaugaguucagcgacagaugcacuccaagcgucaucuccuucggauccaaaaacagaacaauaggagucgccgccaaaaaccaacagauaacccacgcaaacaacaccgucucaaacuucaaacgguuccacggcagagcauucaacgaccccuucauacaaaaagaaaaagaaaaccuaucauacgaccucgucccacucaaaaacggaggagucgguaucaaagucauguacaugggcgaagaacaccuuuucucaguagagcaaauaacagcaaugcuacuaaccaaacucaaagagacagcagaaaacucgcugaagaaaccagucacagauugcgucauaagcgucccgagcuucuucaccgacgccgaacgacgcucaguacuagacgcagcccaaaucgucggccugaacugucucagacuaaugaacgauaugacggcagucgcccuaaacuacggcauauacaaacaggaccucccaucacuggaugaaaaaccacguaucguggucuucgucgacaugggccacucagcauuccaagucuccgcaugcgccuucaacaaaggcaaacucaaaguacuaggcacagccuucgacccauuccuugggggcaaaaacuucgacgaaaaacuggucgagcacuuuugcgcagaguucaaaaccaaauacaaacucgacgccaaaagcaaaauccgagcacuucuacgauuauaccaagaaugcgaaaaacucaagaaacucaugagcagcaacucgacagaccuccccuugaacaucgaaugcuucaugaaugacaaggacgugucagggaagaugaaccggucacaguucgaagaacugugcgccgaacuccugcagaaaaucgaagucccacuguacucccuacucgaacaaacccaccugaaagucgaagacgucucagcaguagaaaucgugggaggggcaacccgaauaccugccgucaaagaacguaucgcgaaauucuucggaaaagacaucaguacaacgcucaacgccgacgaagcagucgccagagggugcgcacuccaaugcgcgauccuaucccccgcguucaaaguacgcgaguucuccgugacugacgccgucccauucccaaucucacuaaucuggaaccacgacucagaagacacggaaggaguccacgaagucuucagccgcaaccacgcugcccccuucucuaaaguauuaaccuuccuccgccgagguccauucgaacucgaagcguucuacucagacccacaagggguacccuacccggaggcgaaaaucggccgcuuuguaguacaaaacgucucagcccagaaagacggcgaaaaaucccgggucaaagucaaaguccgcgucaacacccacggcauauucaccaucucaacugccagcauggucgagaaaguaccaacagaggagaacgaaaugucaagcgaagccgacauggaaugccuaaaucaaagaccgccagaaaacccugacaccgacaaaaacguacaacaagacaauuccgaagcagggacccagccacaaguccagacagacgcacaacagaccagccaaucacccccauccccagagcucacgagcgaagaaaacaaaauaccagacgcagacaaggcaaacgaaaagaaagucgaccagccgccagaagcgaaaaagccgaaaaucaaaguagucaacgucgaacuccccauagaagcaaaccucguauggcagcucgggaaagaccuccuaaacauguacaucgagacagaaggcaaaaugauaaugcaagacaaacuagaaaaagaaagaaacgacgcuaaaaacgcaguagaagaguacgucuacgaguuccgcgacaaacucugugggcccuacgaaaaauucaucugcgaacaagaccaccaaaacuuccuaagacuccuaaccgaaacggaagacuggcucuacgaagaaggcgaggaccaagcaaaacaagccuacgucgauaaacucgaggagcuaaugaaaaucggcacgcccgucaaaguccgcuuccaagaagcagaagaacgaccgaagauguucgaagaacugggccagcgcuugcaacacuacgcgaaaauagcggccgacuuccgcaacaaagacgaaaaauauaaccacauagacgaaucagagaugaaaaagguagagaaaagcguaaacgaaguaauggaauggaugaacaacgucaugaacgcccaagccaagaaaucacuagaccaagaccccguugucagagcccaagaaauaaaaaccaaaauuaaagaacucaacaacacaugcgagccagucgucacccaaccgaaaccaaaaauagaaucuccaaaacucgaaagaaccccaaacggcccuaacaucgauaagaaagaagaggaucucgaagacaaaaacaacuucggggcagaacccccgcaccaaaacggcgaaugcuaccccaacgagaaaaacucugugaacauggaccuagauuaa

SEQ ID NO: 955 - RNA, 3000 nt, Artificial Sequence
  derived and/or modified CDS sequence (opt8) from Homo sapiens__NP_006380.1 __HsHYOU1
auggccgacaaaguccgacgacaacgaccgcgccgacgaguauguugggcgcucgucgccguacugcucgccgaccuacuggcccuaagugacacccucgcagugaugaguguagaccuaggcuccgaauccaugaaggucgcgauagucaaaccaggagugccgauggaaauaguccucaacaaggaauccaggcgaaaaaccccaguaauaguaacccucaaagaaaacgagcgguucuuuggagacucagcagcaagcauggcaaucaagaauccaaaagccacccuacgauacuuccaacaccuacuaggaaagcaggcagacaacccacacgucgcacuauaccaggccagguucccggaacacgagcugaccuucgacccccaaaggcaaacgguacacuuccaaaucagcagccaacuacaauucagcccagaagaaguccucggaaugguccuaaacuacagcagaagccucgcagaggauuucgccgaacagccaauaaaagacgccguaauaacagucccaguauucuucaaccaagccgagcgacgagccguccuacaggcagcacgcauggccgggcucaagguacuccagcuaauaaacgacaacacggcaacggcccuauccuacggagucuuucggagaaaagacauaaacacaaccgcacaaaacauaauguucuacgacaugggcucaggcucgacagucugcacaauagucacauaccagauggucaaaacaaaggaagccgggaugcaaccgcaacugcaaauacgaggagucggauucgaccgaacacugggaggacuagaaauggaacuacgacuccgagagaggcuggccggccuauucaacgaacaaagaaaaggccaacgcgcaaaagacguaagggaaaacccacgagcaauggcuaaacuacuccgagaagccaaccgacugaaaacaguacuaagcgcaaacgcagaccacauggcgcaaauugaagggcuaauggacgacguagacuucaaagcaaaagucacccgcguggaguucgaggaacucugcgcagaccuguuugaacgcguccccggccccguacaacaagcacugcaaagcgcagaaaugagccuagacgagauagaacaaguaauccuaguaggcggcgccacacgaguacccagaguucaagagguacuacugaaagcugucgggaaagaggaacuaggcaaaaacaucaacgccgacgaggccgcagcaaugggagccguauaucaagcagcagcauuaaguaaagcauucaagguaaagccguuuguaguacgggacgccgucguauacccaauuuuagucgaguucacgcgggaagucgaagaggaacccggaauacacucacugaaacacaacaaacgcguccuauucucacgaaugggucccuacccacaaagaaaaguaauaaccuucaaccgauacagccacgacuucaauuuccacaucaacuacggcgaccuuggauuccuagggcccgaagaccugagagucuucggaagccagaaccucaccacagucaaacugaaaggagugggggacagcuucaagaaauacccagacuaugaaucaaaaggaauaaaggcacacuucaaccucgaugaaagcggaguacugagccuggacaggguagaaagcguuuucgagacacugguggaagacagugccgaagaagagagcacacuaacaaaacugggcaacacaaucaguagccucuucgggggcggaacaacgccagacgcaaaagaaaacgggaccgacaccguacaagaagaagaagaaagcccagccgaaggaagcaaggacgagccaggagagcagguagagcucaaagaagaagcagaggcgcccguagaagacggcucucagccaccuccgcccgaacccaaaggagacgcaacaccagagggagagaaggcgaccgaaaaagaaaacggcgacaaaagcgaggcgcaaaaaccgucggagaaagccgaggcgggaccagaaggaguagccccagcacccgaaggcgaaaagaaacaaaaaccagcgagaaaaagaaggaugguggaggaaaucggcguggaacugguagugcuagauuuacccgaccucccagaagacaaacucgcgcagucgguacagaaauuacaagaccugacacuaagagaucuugaaaaacaagaacgagagaaggcggcaaacagucuggaagcguucaucuucgagacgcaggacaaacuauaccagccggaguaccaagagguaucaaccgaagaacaaagagaggaaaucuccggcaagcuaucggcggccucaacauggcucgaggaugaagggguaggcgccaccacagugaugcuaaaagaaaagcuagcugaacuaagaaaacuaugccaaggucuauuuuuccgagucgaggaaaggaagaaauggccagaaagacuaucggcccucgacaaccuacuaaaccacuccagcauguuucuaaaaggcgcgagacuaauaccagagauggaccaaaucuucacggaagucgaaaugaccacacuagaaaaagugauaaacgagacgugggcauggaaaaaugccacacucgcagaacaagccaaacuacccgcaacggaaaagcccguccuacucagcaaagacaucgaagcaaaaaugauggcguuagaccgcgaaguacaguaccuacuaaacaaagcgaaauucaccaaaccacgaccccgccccaaagacaaaaacggcacacgggcagagccaccacugaacgcaagcgccucagaccaaggggaaaaggucauacccccggccggacaaaccgaagacgcggaaccaauaagcgagcccgaaaagguggagacgggaagcgaacccggcgacacagagccacuggaacuaggaggcccgggcgcagaaccagagcaaaaggaacaaagcacagggcaaaagaggccacucaaaaacgaugaacuauaa

SEQ ID NO: 956 - RNA, 2199 nt, Artificial Sequence
  derived and/or modified CDS sequence (opt8) from Homo sapiens__NP_005339.3 __HsHSP90AA1
augccagaagaaacgcaaacgcaagaccaaccaauggaagaggaggaaguagaaacguucgccuuccaggcagagaucgcccaacuaaugagccugauaauaaacacauucuacucgaacaaagagauauuccucagagagcucauaagcaacagcucggacgcacuggacaaaauacgauacgaaucccuaaccgacccgagcaaacucgacuccggcaaagaacuccacaucaaccuaauaccaaauaaacaggaccggacacucaccaucgucgacacagggauaggaaugacaaaagcggaccugaucaacaaccuaggaacgauugcaaaaagcggaacaaaagcguucauggaagcccuccaagcaggcgccgauauauccaugauaggacaauucggcgugggguucuacucagcauacuuagucgcggaaaaagucacgguaauaacgaaacacaacgacgacgaacaguacgcgugggagagcuccgcaggcggcagcuucacaguuaggacagacaccggagagcccauggggcgagggaccaaggucauccuucaccucaaagaagaccaaacggaauaccucgaagaaaggcgcauaaaggaaaucgugaagaaacacucccaauucauaggauacccuaucacacuauucguagaaaaagaacgcgacaaagagguaagcgacgacgaagcggaagagaaggaagacaaggaagaggaaaaagagaaggaagagaaagaaagcgaagacaagcccgaaauagaagacguaggcucggacgaggaagaagaaaagaaagacggcgacaaaaagaagaaaaagaaaauaaaagaaaaauacauugaccaggaggaacucaacaaaacgaaaccgauauggaccaggaacccggacgacaucacaaacgaagaauacggggaguucuacaaaucgcucacaaacgacugggaagaccaccuagcggucaaacacuucaguguggagggacaacuagaguucagagcacuccuguucgucccaaggcgagccccauucgaccuauucgaaaaccgcaaaaagaaaaacaacauaaaacucuacgucagaagagucuuuauaauggacaacugcgaggaacuaauccccgaauaccuaaauuucauccgaggggucguggacucugaagaccucccacuaaacaucucaagagaaaugcugcagcaaaguaagauccuaaaagugauccgcaaaaaccuaguaaagaaaugccuggaacuguucacggaacuggcggaggauaaagaaaacuacaaaaaguucuacgaacaauucuccaagaacauuaaacuggggauccacgaagacucccaaaacagaaagaaacugagcgaacuccugcgauacuacaccagcgcguccggagacgagauggucagccuaaaggacuacugcaccagaaugaaagaaaaccaaaaacacaucuacuauauaacaggggaaaccaaggaccaagucgcaaacagcgccuuuguagagcgccugagaaaacacggacucgaagucauauacaugauagaaccaaucgacgaauacugcguacagcagcugaaggaguucgaaggaaaaacgcuaguaucgguaacgaaagagggacuagagcuacccgaagacgaggaagagaaaaagaaacaagaagaaaagaaaaccaaauucgagaaccucugcaaaauaaugaaagacauccuagaaaagaaaguagaaaaagucguagugucaaaccgccucgucacgagcccauguugcauagucacgucaaccuacggauggacagccaacauggagaggauaaugaaagcccaagcccuacgagacaacucaacaaugggauacauggccgccaagaaacaccuagaaauaaaccccgaccauucgauaauagagacucuccgacaaaaagccgaggccgacaagaacgacaagagcguaaaagaccugguaauccuccucuacgaaacggcccuccuaucaagcggguucagccuagaagacccacaaacccacgccaaccgcaucuacagaaugauaaaacuaggacucggaaucgacgaagacgacccgaccgcggacgacaccucagcagcgguaacagaggaaaugcccccacuagaaggggacgacgacacgagcagaauggaggaaguagacuaa

SEQ ID NO: 957 - RNA, 339 nt, Artificial Sequence
  derived and/or modified CDS sequence (opt8) from Homo sapiens__NG_005218__HsHSP90AA3P
auggacuccucaaaacuagacuccggcaaaggacuccacaucaaccucguccccaacaaacaaaaccaaacacucaccauaguagacacacgcaucggcaugaccaaaacagaccucaucaacaaccucggcaccgucaccaaauccggaacaaaagccuucauggaagcacuccaagccgacgcagacaucuccaugaucggacacuucggcgucggcuucuacucagcauaccucgucgccaaaaaagucaccguaaucucaaaacacaacaacgacgaacaauacaccugggaauccuccgcaggcggcuccuucaccguacgaacagacgaauaa

SEQ ID NO: 958 - RNA, 2175 nt, Artificial Sequence
  derived and/or modified CDS sequence (opt8) from Homo sapiens__NP_031381.2__HsHSP90AB1
augcccgaagagguacaccauggugaagaggaagucgagaccuucgccuuccaagccgaaauagcacaauuaaugagccugauaaucaacaccuucuacucgaacaaagaaaucuuccugcgcgaacucaucucgaacgcaagcgacgcccuagacaagauaagauacgaaucacugacagaccccagcaagcuagacucagggaaggagcucaaaaucgacaucauuccaaacccccaagaacggacacuaacccugguggacacagggaucgggaugaccaaggccgaccugauaaacaaccucgggacaaucgccaaaagcggcaccaaagcguuuauggaggcccuacaagccggagccgacaucagcaugaucgggcaauucggcgucggauucuacagcgccuaucuaguagcggaaaaaguaguagugaucacaaaacacaacgacgacgaacaauacgccugggaaagcagugcaggaggcagcuucacggugcgagccgaucacggagaacccauaggacggggcaccaaggugauacugcaccucaaagaagaccaaaccgaauaccuggaagaacgacgaguaaaggaggucguaaagaagcacagccaauucauaggcuacccaauaaccuuguaccuagagaaagaacgggaaaaagagauaagugacgacgaagcugaagaagaaaaaggcgaaaaagaagaagaagacaaagacgacgaagaaaagcccaaaaucgaggacguaggcagcgacgaagaagacgacagcggaaaagacaagaaaaagaaaacaaagaaaauaaaagagaaguacaucgaccaagaagaacucaacaaaacgaagcccauauggacaagaaauccagacgauaucacgcaagaagaauacggagaguucuauaagagucuaaccaacgacugggaagaccaccuagcggucaaacacuucagcgucgaaggacagcuagaguuccgagcccugcuauucaucccccgaagggcacccuucgaccuauuugaaaacaaaaagaagaaaaacaacauuaaacucuacguacgccgcgucuucauaauggacagcugcgacgaacuaauaccagaauaccugaacuucauccgcggagucgucgacagcgaagaccuaccacugaacauaucacgagaaaugcugcaacaaagcaaaauccucaaagucauacgcaaaaacaucguaaagaaaugccuugaacuauuuucggaacuggcagaagacaaagaaaauuacaagaaauucuacgaagccuucagcaaaaaccucaaacugggaauccacgaagacuccacaaaccgaagaagacuaagcgaacuccuaagauaccacaccagucaaagcggcgacgaaaugacaagccucucagaauacgugucccgaaugaaagaaacccagaaaagcaucuacuacaucacgggcgaaagcaaagaacaaguagcaaacagugcuuucguagaacgggugagaaagcgaggauucgaagucguguauaugaccgaaccaaucgacgaauacugcguacaacaacuaaaagaguucgauggcaagucccucguaucagucacgaaagaaggccuagaacugccggaagacgaagaagagaaaaagaaaauggaagaaagcaaagcaaaauucgaaaaccugugcaaacucaugaaagaaauacucgacaagaaagucgaaaaaguaacaauaagcaaccggcuagugagcagcccaugcugcaucgucacaagcacauacggcuggacggcgaacauggaaagaauaaugaaagcacaagcccuacgagacaacagcacgaugggauacaugauggcaaagaagcaccuagaaaucaacccagaccacccaaucguggaaacacuccgacaaaaagccgaagcagacaagaacgacaaggccguaaaagaucuagugguacuacuguucgaaaccgcgcuacucagcucaggauucagccucgaggacccacaaacccacucgaacaggaucuacagaaugaucaaacuaggccugggaauagacgaagacgaagucgccgccgaagaacccaacgcggcagucccagacgaaaucccaccauuggagggagacgaagacgcaagcaggauggaggaaguagacuaa

SEQ ID NO: 959 - RNA, 2412 nt, Artificial Sequence
  derived and/or modified CDS sequence (opt8) from Homo sapiens__NP_003290.1__HsHSP90B1
augagggcguuauggguccuagggcugugcugcguccuccugacguucggcagcgucagagcagacgacgaaguggacguagacggcaccguagaagaagaccugggaaaauccagagaggguagcagaaccgacgaugaagucgugcagcgagaggaagaagccauccaacucgacgggcugaacgcgucacagauacgggaacuacgagagaaaagcgaaaaauucgccuuccaagcagaagucaaccgaaugaugaaguuaaucauaaacucacuauacaaaaauaaagaaauauuccucagagaacugauaagcaacgcgagugacgcacuagacaaaaucagacucaucagccucaccgacgaaaacgcccuuagugggaacgaagaacuaacagucaaaaucaaaugcgacaaggaaaagaaccuacuacacguaacagacacggguguaggaaugacccgggaggaacucgucaaaaaccucggcaccauagcgaaaagcggaacaucagaguuccucaacaaaaugacagaggcccaggaagacggacaaagcaccagcgaacugaucgggcaauucggaguaggauucuacagcgcguuccucguggcagauaaggucaucgucaccucaaaacacaacaacgacacccagcacauaugggagagcgacagcaacgaguucuccguaaucgcggacccccgcgggaacacgcucggccgcggaaccacaaucacacucguacucaaagaagaagcaagcgacuaccuagagcucgauacaauaaagaaccuggugaaaaaguacagccaguucaucaacuucccaaucuacguauggagcagcaaaacugagacgguagaagaaccaauggaagaagaggaagcagccaaagaagaaaaagaagagucggacgacgaggcagcgguagaagaagaagaagaagagaagaaaccgaaaaccaagaaaguagagaaaacgguaugggauugggaacuaaugaacgacaucaaacccauauggcagcgccccagcaaagaagucgaagaagacgaauacaaggcauucuacaagagcuucagcaaagaaagugacgacccgauggccuacauacacuucaccgcagaaggggaaguaacauucaagagcauacuauucgucccaaccucagcgccgcgaggacucuucgacgaguacgggagcaagaaaagcgacuacaucaaacuguacguaagacgcguauucauaaccgacgacuuccacgacaugaugcccaaauaccuaaacuuugugaaagggguaguagacagcgacgaccuaccccuaaacguguccagagaaacccuccagcagcacaaacuccugaagguaauaaggaagaaacuggugcggaaaacacuagacaugauaaagaaaauagccgacgacaaguacaacgacaccuucuggaaggaguucggcaccaacauaaaacuaggggugaucgaagaccauagcaaccggacccgacucgcaaaacuccuaagauuccaaucaagccaccaccccaccgacauaacgagccucgaccaguacguggaaaggaugaaggaaaagcaagauaaaaucuacuuuauggcgggcuccucccgaaaagaagcagaaagcucacccuucguagagcgacuacucaagaaaggguacgaaguuauauaccugacagaaccuguggacgaauacugcauacaagcacugccggaguucgauggcaaacgcuuccaaaacguggcaaaagaaggcguaaaauucgacgaaagcgagaaaacgaaagaaucacgcgaagcaguagaaaaagaguucgaaccccuacucaauuggaugaaagacaaagcauuaaaagacaaaauagaaaaagcaguagugagccaacgcuugaccgaaagcccgugugcccucguagcaagccaguacggcuggagcgggaacauggagagaaucaugaaagcgcaggcguaccaaacaggaaaagacauauccaccaacuacuacgcuucacaaaagaaaaccuucgaaauaaacccaagacauccgcuaauccgcgacaugcugcgacgaauaaaggaggacgaagacgacaagacaguacucgaccucgcagucguccucuucgaaaccgcaacgcuacggucaggcuaccugcucccagacacgaaagcauacggagacaggauagagaggaugcucagacuaagccuaaacauagacccggacgccaagguagaagaagaaccagaggaagaaccggaagaaacggcagaagacaccacagaggacacagagcaagacgaggacgaggaaauggacguaggaacugaugaagaagaagaaacggccaaagaaucgacagcagaaaaggacgaacuauaa

SEQ ID NO: 960 - RNA, 2115 nt, Artificial Sequence
  derived and/or modified CDS sequence (opt8) from Homo sapiens__NP_057376.2__HsTRAP1
auggcacgagaacuaagggcccuccuccuuuggggccgacgccuccgcccgcuacuucgcgcgccagcacuggcagcugucccaggaggcaaacccauccuaugcccccgccgaacaaccgcacagcucggucccagacgcaacccagcuuggucccuucaagcaggccgccucuucuccacucaaacagcagaagacaaagaagaaccacuccacagcauaaucucaucaaccgaaucaguacaaggcucaacaucuaaacacgaguuccaagccgaaacuaagaaacugcucgacauaguggccagaucccuauacuccgaaaaagaagucuucauccgcgaauugaucucaaacgcauccgacgcacucgaaaaacuacgacacaaacucgucuccgacggccaagcccucccagaaauggaaauccaucugcaaacuaacgccgaaaaaggcaccauaacaauccaggacacaggcaucggcaugacccaagaggaacuugucuccaaccucggaacaaucgcccgcagcggauccaaagcauuccucgacgcccuacaaaaccaagcagaagcaagcuccaaaaucaucggacaauucggagucggcuucuacucagccuucauggucgccgaccgcgucgaaguguacucacgcucagcugcacccggaagucuaggcuaucaauggcuaucagacggaagcggggucuucgaaaucgcagaagccucuggcgugcgcacaggcaccaaaaucaucauccaccugaaauccgacugcaaagaguucucgagcgaagcacgagucagggacguuguaaccaaauacucaaacuucguauccuuuccacuauaccucaauggccgucgaaugaacacccuccaagcaaucuggaugauggacccuaaagacguaagagaauggcaacacgaagaguucuaccgcuacguugcccaagcucacgacaaaccacguuacacccugcacuacaaaaccgacgcaccccugaauauccgaagcauuuucuacguccccgacaugaaacccucuauguucgacguaucccgcgaacucggcuccucagucgcccuauacucccgcaaaguccuuauacaaaccaaagccaccgacauacucccaaaauggcuccgcuuuauacgaggagucgucgacucagaagacaucccgcucaaccugagccgagaacuacuccaagaauccgcccucauucgcaaacugcgugacguccuccaacaacgccucaucaaauucuucaucgaccaaucaaagaaagacgccgaaaaauacgcuaaauucuucgaagacuacggccuauucaugcgcgaaggaaucgugaccgccacagaacaagaggucaaagaagacauagccaaacuccuaagauacgaauccuccgcacugcccucgggacaauuaaccucacuauccgaauacgcaagccguaugcgcgccgggacccgcaacaucuacuaccucugcgcccccaaccgacaccuggcagagcacuccccauacuacgaggcaaugaaaaagaaagacaccgaaguccuuuucugcuucgaacaauucgacgaacuaacccucuuacaccuaagggaguucgacaaaaagaaacucaucucaguggaaacggacaucguagucgaccacuacaaagaagaaaaauucgaagaccgcucaccagccgcagaaugucuauccgaaaaagaaacagaagaacucauggccuggaugcgcaacguccuaggcagucgcgucacaaacgucaaaguaacccuuagacuugacacccaucccgccaugguaacaguccucgaaaugggagccgcacgccacuuccuaagaaugcagcaacuagccaaaacacaagaagaaagagcccaacuccuacaaccuacacuagaaaucaacccccgccacgcacucaucaagaaacuaaaccaacuacgcgcaagcgaaccaggccuagcgcaacuccuaguagaccaaaucuacgaaaacgccaugauagcagcaggccuaguagacgacccccgcgccauggucggccgccucaacgaacuccuaguaaaagcccucgaaagacacuaa

SEQ ID NO: 961 - RNA, 462 nt, Artificial Sequence
  derived and/or modified CDS sequence (opt8) from Homo sapiens__NP_000609.1__HsIGF1
augggcaaaaucuccucacuccccacacaacuauucaaaugcugcuucugcgacuuccucaaagucaaaaugcacacaauguccuccucacaccucuucuaccuagcccucugccuacucaccuucacaucaucagccacagccggcccugaaaccuuaugcggagccgaacucguagacgcccuccaauucgucugcggagaccgaggcuucuacuucaacaaacccaccgguuacggaucaucaucccgccgcgccccacaaacaggcaucgucgacgaaugcugcuuccgcucaugcgaccuccgaagacuagaaauguacugcgcaccccucaaacccgccaaauccgcccgcuccguccgagcccaacgccacacagacaugcccaaaacacaaaaagaaguccaccucaaaaacgccucccgaggauccgccggcaacaaaaacuaccgcauguaa

SEQ ID NO: 962 - RNA, 543 nt, Artificial Sequence
  derived and/or modified CDS sequence (opt8) from Homo sapiens__NP_000603.1__HsIGF2
augggcauaccaaugggcaaauccaugcuaguacuccuaaccuuccuugccuucgcauccugcugcauagccgccuaccgacccuccgaaacacucugcggcggcgaauuagucgacacccuacaauucgucugcggcgaccgcggcuucuacuucucccgaccagccucccgcgucuccagacgcucacgcggcaucguagaagaaugcugcuuccgaucaugcgaccucgcccuccucgaaaccuacugcgccacccccgcaaaaucagaacgagacgucucaaccccacccaccguccuccccgacaacuuccccagauaccccguaggcaaauucuuccaauacgacaccuggaaacaauccacccaaagacuuagacgcggccuccccgcccuacuccgagcccgccgcggacacguacucgccaaagaacucgaagccuuccgcgaagccaaacgccaccgcccacucaucgcccuacccacacaagaccccgcccacggcggcgcacccccagaaauggccucaaaccgaaaauaa

SEQ ID NO: 963 - RNA, 639 nt, Artificial Sequence
  derived and/or modified CDS sequence (opt8) from Homo sapiens__NP_000591.1__HsIL6
augaacuccuucuccacaucagccuucggccccgucgccuucucccucggacuccuccuuguccucccagccgccuuccccgccccagucccccccggcgaagacucaaaagacguagccgccccccaccgacaaccccuuaccuccuccgaacgcaucgacaaacaaauacgauacauccuagacggcaucucagcccuccgcaaagaaaccugcaacaaauccaacaugugcgaaucuuccaaagaagcccuagccgaaaacaaccucaaccuccccaaaauggccgaaaaagacggcugcuuccaaucaggauucaacgaagaaaccugccuugucaaaaucaucaccggccuccucgaauucgaagucuaccucgaauaccuccaaaaccgcuucgaaucauccgaagaacaagcccgcgccguccaaaugucaacaaaaguccucauacaauuccuccaaaaaaaagccaaaaaccucgacgccauaaccacccccgaccccaccaccaacgccucacuacuaaccaaacuccaagcccaaaaccaauggcuacaagacaugaccacccaccucauccuccgcuccuucaaagaauuccuacaaagcucccuccgcgcccuacgccaaauguaa

SEQ ID NO: 964 - RNA, 1281 nt, Artificial Sequence
  derived and/or modified CDS sequence (opt8) from Homo sapiens__NP_002183.1__HsINHBA
augccacuacuauggcuccgcggcuuccuacuggccucaugcuggaucaucguacgcagcagccccacaccaggaagcgagggacacagcgcagccccagacugcccaagcugcgcccuagcggcccugccaaaagacguacccaacagccaacccgaaaugguagaagccgucaaaaaacacauacuaaacaugcuacaccuaaaaaaaaggccagacguaacacaacccgucccaaaagcagcacuacucaacgcaauccgcaaacuccacgucgggaaagucggagaaaacggauacguagagauagaagacgacaucgggcgccgcgccgaaaugaacgaacucauggaacaaaccucagagauaaucacguucgccgaaagcggaacagcccgcaaaacacuacacuucgaaauaagcaaagaaggcagcgaccuaagcgucgucgagcgcgcagaagucuggcucuuccucaaaguacccaaagcaaaccgcacacgaacaaaagucacaauacgacuguuccagcaacaaaagcacccacaaggcucccucgacacaggcgaagaagcagaagaaguaggccuaaaaggagaacggagcgaacuacuccuaucagaaaaagucguagacgcacgcaaaagcacguggcacgucuucccaguaagcagcagcauacaacgacuacucgaccaaggcaaaagcagccucgacgucagaauagcaugcgaacaaugccaagaaucaggcgccucccucguccuacugggaaaaaaaaagaaaaaagaagaagaaggcgaaggaaagaaaaaaggcgguggagaaggaggcgcaggagcggacgaggaaaaagaacaaucccaccgcccauuucuaaugcugcaagcacggcaaucagaagaccacccccaccgccgccgacgacgaggacuagaaugcgacggaaaagucaacaucugcugcaaaaaacaauucuucgucagcuucaaagacauaggauggaacgacuggauaauagcgccaagcggauaccacgcaaacuacugcgaaggcgaaugccccagccacauagcaggcacaagcgggagcagccugucguuccacagcaccgugaucaaccacuacagaaugagaggacacuccccauucgcaaaccugaaaucgugcugcguccccaccaaacuacgaccgaugagcaugcucuacuacgacgacggacagaacaucauaaaaaaagacauacaaaauaugaucguggaagagugcggaugcagcuaa

SEQ ID NO: 965 - RNA, 1224 nt, Artificial Sequence
  derived and/or modified CDS sequence (opt8) from Homo sapiens__NP_002184.2__HsINHBB
auggacggccugccaggccgagcguuaggcgccgccugccuccuacuccuagcagcaggcuggcucggccccgaagccuggggaucaccaaccccaccaccaacccccgcagccccucccccacccccaccacccggcagucccggcggaucacaagauaccugcaccucaugcggcggauuccgcagaccagaagaacucggacgcguagacggagacuuccucgaagccguaaaaagacacauacuaucccgccuccaaaugcgcggccgacccaacaucacacacgccguccccaaagccgccauggucaccgcccuacgcaaacuacacgccggcaaaguucgcgaggacggccgagucgaaaucccacaccucgacggccacgccucccccggcgcagacggacaagaacgaguuagcgaaaucaucuccuuugccgaaacagacggccuagccucaucacgaguccgacucuacuuuuucaucuccaacgaaggaaaccaaaaccucuucgucguacaagcaucccuauggcuauaccuaaaacuccuacccuacgucuuagaaaaaggaucccgccgcaaaguccgcgucaaagucuacuuccaagaacagggccacggcgaccgcuggaacauggucgaaaaacgcguagaccucaaacgcuccggcuggcacaccuucccccuaaccgaagccauccaagcccucuucgaacgcggcgaacgacgccuaaaccucgacguacagugcgacucaugccaagaacucgccguaguacccguauucgucgacccaggggaagaaagccacagaccauucgucgucguccaagccagacucggcgacucccgacaccgcauacgcaaacgaggccucgaaugcgacggccgcacaaaccucuguugccgccaacaauucuucaucgacuuccgccuaaucgguuggaacgacuggauuauagccccaacaggauacuacggcaacuacugcgaagggucaugccccgccuaccuagccggaguccccggcucugccagcucauuccacacagcagucgugaaccaauaccgcaugcgaggccuaaaccccggcaccguaaacucuugcugcauccccacaaaauuaucaaccauguccaugcuuuacuucgacgacgaauacaacauagucaaacgcgacguccccaacaugauaguagaagaaugcggcugcgccuaa

SEQ ID NO: 966 - RNA, 3459 nt, Artificial Sequence
  derived and/or modified CDS sequence (opt8) from Homo sapiens__NP_000623.2__HsITGAM
auggcacuucgcguccuccuccuuaccgcccuaacccuaugucauggauucaaccucgacaccgaaaaugccaugaccuuucaagaaaacgcccgcggauucggccagucuguaguacagcuccaaggaucuagaguagucgucggugccccucaagaaaucguagcagcaaaccaacgcgguagucuauaccaaugugacuacucuacuggcucgugcgaaccuaucaggcuccaaguccccguggaagccgucaacauguccuuaggacuaucacuggccgccaccaccuccccaccgcaacuccuagccugcggacccaccguacaccaaacauguagcgaaaacacguacgucaaaggacucuguuuucucuucggcagcaaccuacgccaacaaccccaaaaauucccugaagcccucagaggcugcccacaagaagacuccgacauagccuuccucaucgacggauccggcuccauuauaccccacgacuuccggaggaugaaagaauuugucucgacgguaauggagcaacucaagaaaucaaaaacacuguucagccuaaugcaauacucggaggaguuccgaauccacuucaccuucaaagaguuccaaaacaaccccaacccccguagccuuguuaaacccauaacccaacuacugggccgaacacacaccgccaccggcauccgcaaagucguccgcgaacuauucaacauaaccaacggcgcacgcaaaaaugcuuucaagauacuuguaguaaucacagacggagaaaaauucggagacccauugggauacgaagacgucauuccugaagccgaccgagaaggcguaaucagauacgugauagguguaggcgacgcauucagaucagaaaaaucacgccaagaacuaaacacaauagccuccaagccaccccgagaccaugucuuccagguaaacaauuucgaggcacuuaaaacuauucagaaccagcuccgugagaaaaucuucgccaucgaaggaacucagacaggauccuccucgucuuucgaacaugagaugagccaagaaggcuucagcgcugccaucaccucuaacggacccuugcuaucuacagucggcuccuacgacugggccggcggcguguuccucuacaccuccaaagaaaaauccacguucauaaacaugacacgagucgacucggacaugaaugacgcguaccuugguuaugcugccgcaauuauacuuagaaaccgugugcaaucccuuguacucggcgcucccagauaucaacacaucggccucgucgcuauguuucgucaaaauaccgggaugugggaauccaacgccaaugucaaaggcacccaaaucggcgccuacuucggcgcgagccuaugcucagucgacgucgacucaaacggauccaccgaucuaguccugaucggagcaccacacuauuacgaacaaaccagaggcggccagguaucagucugcccacucccccgaggccgcgcccgcuggcaaugcgacgccguccuuuacggcgagcagggccagccuuggggacgauucggagccgcccucaccguacucggugacguuaacggagauaaacuaacagacgucgcaaucggcgcccccggagaagaagacaacagaggagcggucuaccucuuucacggaaccuccgggagcggaaucagcccgucccauucccagcgcauugcagguagcaaacucaguccccgccuccaguacuucggccaaucccuguccggcggccaagaccuuacaauggacggccuaguagaccucaccgucggugcucagggccauguccugcuucuacgcucucaaccagucuuacgaguaaaagcaauaauggaguucaacccacgcgaagucgcccgcaacgucuucgaaugcaacgaccaggucguaaaaggcaaagaagccggagaaguccguguaugccugcacguacaaaaguccacccgcgaccgccuacgggaaggccaaauacagucugucgucacuuaugaccucgcucucgacuccggaagaccgcacucucgggccgucuuuaacgaaaccaaaaacucaacacgacgacaaacacaggugcucggccugacgcagacaugcgagacgcucaaauugcagcuaccaaacugcaucgaagacccaguaagcccuauuguccuucgccuaaacuucagccucguggggacaccacuaagcgccuucggcaaccuacgcccgguacucgcggaagacgcccagcgccucuucaccgcccuuuuucccuucgagaaaaacugcggcaacgauaacaucugccaagacgaucugucgaucaccuucagcuucaugucccucgacugucucguagucggaggcccccgugaguucaacguaaccguaaccguccgcaacgacggagaagacagcuaccgcacucaggucaccuuuuucuucccccucgaccugucuuacagaaaaguaucaacacuccaaaaccaacgaucccaacguucauggcgacuagccugcgaauccgccagcuccacugaagucagcggcgcccucaaaagcacguccugcucgaucaaccaccccauauuccccgagaacucagaagucacauucaacaucacauucgacguagauucaaaggcuucacucggaaauaaacugcuucucaaagccaacgucaccucagaaaauaauaugccccguacuaacaaaaccgaguuucaacuagaacucccggucaaauacgccgucuacaugguaguaaccucucacggaguauccaccaaguaccucaacuucacugcauccgaaaacacuucucgcgucaugcagcaccaauaucaagucuccaaccucggucaacguucacugcccaucucccuaguauuccuggucccaguacgccuaaaccagaccgucauaugggacagaccccaagucaccuucucagaaaaccuuagcucuaccugccauacaaaggaaagauuacccucacacuccgacuuucucgcagagcucaggaaagcccccguagucaacugcucgauagcaguaugccaacgaauacaaugcgauaucccauucuuuggcauccaggaagaguucaacgccacccugaaggguaaccucucauucgacugguacauaaagacaucacauaaccaucuacuuauagucagcacagccgaaauccuguucaacgacucaguguucacccuccugcccggccaaggagccuucguacgcucacaaaccgaaacaaaaguugaaccuuucgaaguucccaacccccuuccgcucauagucggcuccucagucggaggccuccuccuacucgcccuaauaaccgcagccuuguacaaacucggauucuucaaacgccaguacaaagacaugaugucagaaggagguccucccggcgcagaaccacaauag

SEQ ID NO: 967 - RNA, 1404 nt, Artificial Sequence
  derived and/or modified CDS sequence (opt8) from Homo sapiens__NP_002415.1__HsMMP8
auguucucacuaaaaacccuacccuuucuccuacuccuucacguccagauaucaaaagccuuccccgucuccucuaaagagaaaaacaccaaaaccgugcaagacuaccucgaaaaauucuaccaacucccguccaaccaauaccaaucaacacgcaaaaacggcacuaacguaaucgucgaaaaauugaaagaaaugcaacgauucuucggccucaacgucaccggcaaacccaacgaagaaacccucgacaugaugaagaaaccccgaugcggaguacccgacucuggcggcuucaugcucacucccggcaaucccaaaugggaacgcacuaaccucaccuaccgcaucagaaauuacacaccccaacucucagaagccgaagucgaaagagcgauuaaagacgcauucgaacuaugguccgucgccagcccccuaaucuucacccgcaucucccaaggugaagccgacaucaacauagcauucuaccaacgcgaccacggugacaacuccccauucgacggcccaaacggcauacuugcccacgcauuccaacccggucaaggaaucggaggcgacgcccacuucgacgccgaagaaaccuggaccaacacauccgcaaacuacaaccuauuccucguugccgcccacgaguucggccacucccuaggcuuagcacacuccuccgauccaggugcccuaauguauccaaacuacgccuuccgcgaaaccuccaauuacucccuaccccaagaugacaucgacggaauccaagcaaucuacggacucucauccaaccccauccaacccaccgguccaucaaccccaaaacccugcgaccccucccucaccuucgacgcaaucaccacucucagaggugaaauccucuucuucaaagaccguuacuucuggcgaagacacccacaacuccaacgcgucgaaaugaacuuuauuucacucuucuggcccucgcuucccaccggcauccaggccgcauacgaagacuucgaccgcgaccuaaucuuccucuucaaagguaaccaauacugggcacuaucaggcuacgacauccuucaaggcuaccccaaagacauauccaacuacggcuucccauccuccguccaggcaaucgacgcugcagucuucuauagauccaaaaccuacuucuucgucaacgaccaauucuggcgauacgacaaccaacgacaauucauggaacccggcuaccccaaaucaaucuccggcgcuuuccccggcaucgaauccaaagucgacgccguuuuccaacaagaacacuucuuccacgucuucuccgggccacgauacuacgccuucgaccucaucgcccaacgcgucacccgaguagcacgcggcaacaaauggcuuaacugccguuacggcuga

SEQ ID NO: 968 - RNA, 2124 nt, Artificial Sequence
  derived and/or modified CDS sequence (opt8) from Homo sapiens__NP_004985.2__HsMMP9
augucccucuggcaaccccuaguucuaguccuccucguacuuggaugcugcuucgcagcaccccgacaacgccaauccacccuaguccucuucccuggcgaucuucgaacaaaccugaccgaccgccaacucgcggaagaauaucucuaccgcuacggcuacacacguguagccgaaaugcgcggagaauccaaaagccuagguccagcacuccuccuccuccaaaaacaacuuucacuccccgaaacgggcgaacucgacuccgccacccucaaagcaaugagaacaccacgcugcgggguacccgacuuagggagauuccaaacguucgaaggagaccuaaaguggcaccaccacaacauaacuuacuggauacaaaacuacagcgaggaccugccccgagcagucaucgacgacgccuucgcaagagccuucgcccuauggagcgccguaacaccccucaccuucacccguguauacucccgagacgccgacauugucauccaauucggcguagccgaacacggagacggcuacccauucgacggcaaagacggccuauuggcacacgcauuuccacccggcccaggaauacaaggcgacgcccacuuugacgaugacgaacucuggagccugggaaaaggagucguaguccccaccagauucggcaacgcagacggagcagcaugccacuuccccuuuauauucgaaggccgcucuuacagcgccugcacuaccgauggccgcuccgauggucuacccuggugcuccaccaccgccaacuacgacaccgaugaucgcuucgguuucuguccaucugaaagacucuacacccaggacggcaacgccgacggcaaacccugccaauuuccauucaucuuccaaggccaaucuuacuccgcaugcaccacagacggccgauccgauggauaucgcuggugcgccacaacugccaauuacgaccgagacaaacucuucggauucugcccaacccgagcagacucaaccguaaugggaggaaacucagccggcgaauuaugcguauuucccuucaccuuccucggaaaagaguacuccacgugcaccagcgaaggccgaggagacggacgacuauggugcgccaccacaucaaacuucgacuccgacaagaaauggggcuucugccccgaucaaggcuacucucuguucuuagucgccgcacacgaguucggacacgcccugggacuagaccacaguucaguccccgaagcgcucauguaccccauguaccgcuucacagaaggaccaccacuacacaaggacgacguaaacggcaucagacaccuauaugguccccgaccagaacccgaaccacgcccucccacuaccacuaccccacaaccaacugccccacccacaguauguccaacaggaccacccaccguacaccccuccgaacgccccaccgccggcccuaccggaccucccuccgcaggucccacaggaccacccacagccggccccuccaccgccaccacaguucccuuauccccugucgacgacgcaugcaacgucaacauauucgacgcuaucgccgaaaucggcaaucaacuauaccuguucaaggacggcaaauauuggcgcuucucagaaggccgaggcagccgcccucaagguccauuccucauugccgacaaauggcccgcccuccccagaaaacuugacuccgucuucgaagaacgucucuccaagaaauuauucuucuucucaggccgucaagucugggucuacaccggcgccagcguccucggccccagacgucuagacaaacuuggacucggagccgacgucgcucagguaaccggggcucugcgauccggacgcgggaagauguugcuauucagcggacgcagacuauggcgcuucgacgucaaagcccaaauggucgacccgagauccgccuccgaaguugaccguauguucccaggcgugccccucgacacccacgacguauuccaauaccgcgaaaaagcauacuucugccaggaccgcuuuuauuggcgagucucuucccgaucugaacuuaaccaagucgaccaaguaggauaugucaccuacgacauccuccagugccccgaggacuaa

SEQ ID NO: 969 - RNA, 1416 nt, Artificial Sequence
  derived and/or modified CDS sequence (opt8) from Homo sapiens__NP_002418.1__HsMMP13
augcacccaggcguccucgcagcuuuccucuuccucuccuggacacacugccgcgcauuaccccuccccucaggaggcgacgaagacgaccucuccgaagaggaccuccaauucgccgaacguuaccuccgcuccuacuaccacccgacaaaccucgcaggaauacucaaggaaaacgccgccuccuccaugaccgaacgccuuagagaaaugcagucauucuucggccuagaaguaaccggaaaacuagacgacaacacccuagacgucaugaaaaaaccccgaugcgguguccccgacgucggcgaauacaacgucuucccccgcacccuuaagugguccaaaaugaaccugaccuaucgcauagucaacuacacgccagacaugacccauuccgaagucgaaaaagcauucaaaaaagcguucaaaguaugguccgacgucaccccacuuaacuucacacgccuccacgacggaaucgcagacaucaugauaagcuucgguaucaaagaacacggcgacuucuaccccuucgacggcccaucaggccuacuagcccacgcauucccccccggcccgaauuacggcggcgacgcccacuuugacgaugacgaaaccuggacauccuccuccaaagguuacaaccuauuccuaguagccgcacacgaauucggccacucccucgggcuagaccacuccaaagaccccggagcccucauguuccccauauacacuuacaccggcaaaucccacuucaugcuacccgacgacgacguacaaggcauccaaucccuguacggcccaggcgacgaagacccaaaccccaaacaccccaaaacucccgacaaaugcgaccccucccucucccuagacgccaucaccucacuccgcggcgaaacaaugauauucaaagaccguuucuucuggcgccuccacccacaacaaguagaugcagaacucuuccuaacaaaauccuucuggcccgaacuaccaaaccgaaucgacgcugcauaugaacauccaucccacgaccucauuuucauauuucgaggccgaaaauucugggcacuaaacgguuacgacauccucgaaggcuaccccaaaaaaaucuccgaacuaggccuucccaaagaaguaaaaaaaaucucagccgccguccacuuugaagacaccggaaagacucuacuauucucaggcaaccaagucuggcgauacgacgacaccaaccacauaauggacaaagacuaccccaggcuaauagaagaagacuuuccaggcaucggagacaaaguagacgccguauacgagaaaaacggcuacaucuacuucuucaacggccccauacaauucgaguacuccaucugguccaaucgaaucguacgcgucaugcccgccaacucaauccucuggugcuaa

SEQ ID NO: 970 - RNA, 1068 nt, Artificial Sequence
  derived and/or modified CDS sequence (opt8) from Homo sapiens__NP_001286.1__HsCCR1
auggagacccccaacaccacagaagacuacgacaccaccaccgaauucgacuacggugacgccacccccugucaaaaagucaaugaacgcgccuucggcgcacaacuacuaccgccccucuacucgcucguuuucguaaucggccucgucggaaauauacucgucguccucguccuaguccaauacaaacgccucaaaaacaugacuucaaucuaccuccuuaaccuagccaucucugaccuccucuuccuauucacacucccauuuuggaucgauuacaaacucaaagacgacugggucuucggcgacgcaaugugcaaaauccuaucaggcuucuacuacaccggccuauauagcgaaaucuucuucauuauccuucucaccaucgaccgcuaccucgccauaguccacgcagucuucgccuugcgcgcacgcaccguaacuuuuggagucauaaccuccaucaucauuugggcucucgccauccucgccucaaugcccggccuauacuucuccaaaacacaaugggaauucacccaccauacuugcucccuccacuucccacacgagucccuaagagaauggaaacucuuucaagcacucaaauuaaaccucuuuggucucguucuuccccuccucgucaugauaauuugcuacaccggcaucaucaaaauccuccuccgccguccaaacgaaaaaaaauccaaagccguccgccuaaucuucguaauaaugaucaucuucuuccucuucuggacccccuacaaccucacaauccucaucuccgucuuccaagauuuccucuucacccacgaaugcgaacaaucucgucaccucgaccucgcuguccaagucacagaagucaucgcuuacacacacugcugcgucaaccccguaaucuacgcauucgucggugaacgauuccgcaaauaccuccgccaacucuuccaccgccgcguagccguccaccucgucaaauggcuucccuuccucuccgucgaccgacucgaacgcguaucuagcaccuccccuuccacaggagaacacgaacucuccgccggcuucuaa

SEQ ID NO: 971 - RNA, 636 nt, Artificial Sequence
  derived and/or modified CDS sequence (opt8) from Homo sapiens__NP_002598.4__HsPDGFA
augcgcacccucgccugccuccuccuccucggcugcggcuaccucgcccacguccucgccgaagaagccgagaucccacgcgaaguaaucgaacgccucgcccgcucccaaauacacuccauccgcgaccuccaacgccuccucgaaaucgacucaguaggcuccgaggacucacucgacaccucacuccgcgcccacggcguccacgccaccaaacacguccccgaaaaaagaccacucccaauccgacgaaaacgauccaucgaagaagccguccccgcagucugcaaaacccgcaccgucauauacgaaaucccacgaucccaagucgaccccaccuccgccaacuuccuaaucuggcccccaugcgucgaagucaaacgaugcaccggcugcugcaacacauccuccguaaaaugccaacccagccgcguccaccaccgcuccguaaaaguagcaaaagucgaauacguacgcaaaaaacccaaacuaaaagaaguccaaguccgccucgaagaacaccuagaaugcgcaugcgcaacaacaucccuaaaccccgacuaccgcgaagaagacaccggccgaccacgagaauccggcaaaaaacgcaaacgcaaacgccucaaaccaacauaa

SEQ ID NO: 972 - RNA, 726 nt, Artificial Sequence
  derived and/or modified CDS sequence (opt8) from Homo sapiens__NP_002599.1__HsPDGFB
augaaccgaugcugggcacucuuccuaucccucugcugcuaccuacgccuagucucagccgaaggcgaccccauccccgaagaacucuacgaaaugcucagcgaccacuccauccgaagcuucgacgaccuucaacgccuacuccacggcgaccccggcgaagaagacggagccgaacucgaccuaaacaugacccgcucccacuccggcggagaacucgaaucacucgcacgcggacgcagaucccucggcucccucaccaucgccgaaccagccaugauagcagaaugcaaaacccgaacagaagucuucgaaaucucacgccgccucauagaccgaaccaacgccaacuuccucgucuggcccccaugcgucgaaguccaaagaugcuccggcugcugcaacaaccgcaacguccaaugccgcccaacccaaguccaacuccgcccaguccaaguacgcaaaaucgaaaucguacgcaaaaaaccaaucuucaaaaaagccaccgucacccuagaagaccaccucgccugcaaaugcgaaaccguagccgcagcccgacccguaacacgcucucccggcggcagccaagaacaacgagcaaaaacaccccaaacacgcgucacaaucaggaccguccgcguccgcagacccccaaaaggcaaacaccgcaaauucaaacacacccacgacaaaaccgcacucaaagaaacccuaggcgcauaa

SEQ ID NO: 973 - RNA, 1038 nt, Artificial Sequence
  derived and/or modified CDS sequence (opt8) from Homo sapiens__NP_057289.1__HsPDGFC
augucccucuucggccuccuccuccucaccucagcccuagcaggccaacgccaaggcacccaagccgaauccaaccucuccuccaaauuccaauucucauccaacaaagaacaaaacggcguacaagacccgcaacaugaacgcauaaucaccguauccaccaacggcagcauccacuccccaagguucccccauaccuacccccgcaacaccguccuagucuggcgccuugucgccgucgaagaaaacgucuggauccaacugacauucgacgaacgcuucggccucgaagaccccgaagacgacaucugcaaauacgauuucgucgaaguagaagaaccuuccgauggcaccauccucggccgcuggugcggaagcggcaccguccccggcaaacaaaucucaaaaggcaaccaaauacgcauccgauucgucuccgacgaauacuucccaucagaacccggauucugcauacacuacaacaucgucaugccacaauucaccgaagccgucucacccuccguccuaccccccucagcccucccccucgaccuacucaacaacgccauaacagccuuuuccacccucgaagaccucauccgauaccucgaaccagaacgauggcagcucgaccuagaagaccucuaccgccccaccuggcaacucuuaggcaaagccuucgucuucggccgcaaaucgcgcguaguugaccuuaaccuccuaaccgaagaaguacgccucuacagcugcaccccacgcaacuucuccguaucaauccgcgaagaacucaaacguaccgacaccauauucuggcccggaugccuccuagucaaaagaugcggcggaaacugcgccugcugccuccauaacugcaacgaaugccaaugcguacccuccaaaguaaccaaaaaauaccacgaaguccuucaacuccgcccaaaaacaggcguacguggccuccauaaaucacuuaccgacgucgcccucgaacaccacgaagaaugugacugcgucugucgcggauccaccggaggauaa

SEQ ID NO: 974 - RNA, 1095 nt, Artificial Sequence
  derived and/or modified CDS sequence (opt8) from Homo sapiens__NP_149126.1__HsPDGFD
augcaccgccucaucuucgucuacacccuaaucugcgccaauuucugcucaugccgcgacaccucugccacaccgcaaagcgcuucaaucaaagcacuccggaacgccaaccugcgacgagacgaccucuaccgccgcgacgaaaccauccaagucaaaggaaacggcuacguacaaagcccccgauucccaaacuccuacccccgcaaccuccuacucaccuggagacuacacucccaagaaaacacccgaauacaacucguauucgacaaccaauucggacuagaagaagcugaaaacgacaucugccgauacgacuucguagaagucgaagacauaagcgaaacauccacaaucaucagaggccgcuggugcggccacaaagaaguaccaccccgcaucaaaucccgcacaaaccaaaucaagauaaccuucaaaucagacgacuacuucgucgccaaacccggauucaaaaucuacuacucccuccuagaagacuuccaacccgccgccgccuccgaaacaaacugggaaucagucaccucaagcaucucagguguaucauacaacucccccuccgucaccgaccccacacucauagcagacgcccucgacaagaaaauagcugaauuugacaccgucgaagaccuccucaaauacuucaaccccgaauccuggcaagaagaccucgaaaacauguaccuggauacaccacgcuacagaggccgaucauaccacgaccgaaaaaguaaagucgaccuugaccgccucaacgacgacgccaaacgcuauagcugcaccccucgaaacuacuccgucaacauccgagaagaacuaaaacucgcaaacgucguauucuucccacguugccuccuuguccagcgaugcggaggcaacugcggcugcggcaccgucaacuggcggagcugcacaugcaacuccggcaaaaccguaaagaaauaccacgaaguacuccaauucgaaccaggucacaucaaacgucgcggcagagcuaaaaccauggcauuagucgacauacaacuagaccaccacgaacgaugcgacugcaucugcagcucacgacccccacgcuaa

SEQ ID NO: 975 - RNA, 678 nt, Artificial Sequence
  derived and/or modified CDS sequence (opt8) from Homo sapiens__NP_003946.3__HsSOCS3
auggucacacacuccaaauuccccgccgccggcaugucccgacccuuagacaccuccuuacgccuaaaaaccuucuccuccaaauccgaauaccaacucguagucaacgcaguacgcaaacuccaagaauccggauucuacuggucagccguaaccggcggcgaagccaaccuccuccuauccgccgaaccagccggcaccuuccuaauucgcgacucauccgaccaacgccacuucuucacccucuccgucaaaacccaauccggcacaaaaaaccuccgcauccaaugcgaaggcggaucauucuccuuacaauccgacccccgcuccacccaaccagucccccgauucgacugcguacucaaacucguccaccacuacaugccaccccccggcgcccccuccuucccuucaccccccaccgaacccuccuccgaagucccugaacaacccucagcccaacccuuacccggcucccccccacgccgcgcauacuacaucuacucaggcggcgaaaaaaucccacucguccucucccgcccccucuccuccaauguagccacacuccaacaccucugccgcaaaaccgucaacggccaccuagacuccuacgaaaaaguaacccaacuccccggacccauacgcgaauuccuagaccaauacgacgccccacuauaa

SEQ ID NO: 976 - RNA, 483 nt, Artificial Sequence
  derived and/or modified CDS sequence (opt8) from Homo sapiens__NP_003227.1__HsTGFA
augguccccuccgccggccaacucgcccucuucgcccucggcauaguacucgcagccugccaagcccuagaaaacucuaccuccccccucuccgccgaccccccaguagcagccgccgucgucucacacuucaaugacugcccagacucccacacccaauucugcuuccacggcaccugccgcuuccucguacaagaagacaaacccgccugcguaugccauuccggauaugucggcgcccgcugcgaacacgccgaccuccuagcaguagucgcagcaucacaaaaaaaacaagcaaucacagcacuugucgucgucucaaucgucgcccucgccguacuaaucaucaccugcguccucauccacugcugccaaguccgaaaacacugcgaauggugccgagcacucaucugccgccacgaaaaacccucagcccuacucaaaggccgaaccgcaugcugccacuccgaaacagucgucuaa

SEQ ID NO: 977 - RNA, 1173 nt, Artificial Sequence
  derived and/or modified CDS sequence (opt8) from Homo sapiens__NP_000651.3__HsTGFB1
augccuccauccggccuacgacuacuccccuuacuccuaccccuccuauggcuccuaguccuaacacccggccgccccgcagccggccuaucgaccugcaaaaccaucgacauggaacucgucaaacgcaaacgcaucgaagccauucgaggacaaauccuauccaaacucagacucgccucaccucccucccagggcgaaguaccacccggcccccuucccgaagcaguccucgcccucuacaacucaacaagagaccgcgucgccggcgaauccgccgaacccgaacccgaacccgaagccgacuacuacgccaaagaaguuacccgagugcuaauggucgaaacccacaacgaaaucuacgacaaauucaagcagucaacacacucaauauacauguucuuuaauaccucagaacuccgcgaagcaguaccugaacccguccuccuaucccgcgccgaacuccgacuucucagacucaaacuuaaggucgaacaacacgucgaacucuaccaaaaauacuccaauaauucauggcgcuaccucuccaaucgacuccuugcccccuccgacucacccgaauggcucuccuucgacgucaccggagucguacgccaguggcucucccgcggcggcgaaaucgaaggcuuccgccucuccgcacacugcuccugugacucccgcgacaauacccuacaagucgacaucaacggcuucaccaccggccgacgcggcgaucucgccaccauccacggcaugaaccgcccauuccuccuccuaauggccacaccccucgaacgugcccaacaucugcaaucaucccgccaccgacgugcccucgacaccaacuacugcuucuccucaaccgagaaaaauugcugcguacgacaacuauacaucgacuuccgcaaagaccucggauggaaguggauccacgaacccaaaggauaccacgccaacuucugccucggccccugccccuacaucuggucccucgacacacaauacuccaaaguucucgcccucuacaaccaacacaaucccggcgcaucagcagcccccugcugcgucccccaagcccuagaaccccucccaaucgucuacuacgucggccgaaaaccaaaagucgaacaauuauccaacaugaucguccgcagcugcaaaugcuccuga

SEQ ID NO: 978 - RNA, 1245 nt, Artificial Sequence
  derived and/or modified CDS sequence (opt8) from Homo sapiens__NP_003229.1__HsTGFB2
augcacuacugcguacucuccgcauuccucauacuccaccucgucaccgucgccuuaucuuuauccacaugcucaacccucgacauggaccaauucaugcgcaaacgcaucgaagccauccgaggacaaaucuuaucaaaacucaaacuaaccuccccacccgaagacuaccccgaaccagaagaagucccacccgaagucauuuccauuuacaacuccacacgcgaccugcuacaagaaaaagccucccgccgcgccgccgcaugcgaacgcgaacgcucagacgaagaauacuacgccaaagaagucuacaaaaucgacaugccacccuucuuccccuccgaaaacgccaucccacccaccuucuacagacccuacuuccguaucguccgcuuugacgucagcgcaauggagaaaaacgccaguaaccuugucaaagccgaguuccgaguauuccgccuacaaaacccaaaagcccgcgucccagaacaacgcaucgaacucuaccaaauccuaaaauccaaagaccuaacuucucccacccaacgauacauagacucaaaaguugucaagacccgcgcagaaggugaauggcucagcuucgacguaacugacgccguccacgaauggcuacaccauaaagaccgaaaccuaggcuucaaaauaagccuccacugcccaugcugcacauucguccccucgaacaacuauaucaucccgaacaaaucagaggaacuggaagcccgcuucgccggaaucgacggaaccuccaccuacaccuccggcgaccagaaaaccauuaaaucaacccgcaaaaagaacagcggaaaaaccccacaccuccuacucaugcuacuaccauccuaccgacuagaaucacaacaaaccaaccgcagaaagaaacgcgcccucgaugccgccuacugcuucaggaacguccaagacaacugcugccuacgcccccuauacaucgacuucaaacgcgaccucggauggaaauggauccacgaaccuaaaggcuacaacgcaaacuucugcgccggagcaugccccuaccucuggagcuccgacacacaacacucucgcguccucucccuauacaacaccaucaaccccgaagccuccgccucacccugcugcgucucccaagaccucgaaccccucacaauacuauacuacaucggcaaaacccccaaaaucgaacaacuguccaacaugaucgucaaauccugcaaaugcagcuag

SEQ ID NO: 979 - RNA, 1239 nt, Artificial Sequence
  derived and/or modified CDS sequence (opt8) from Homo sapiens__NP_003230.1__HsTGFB3
augaagaugcaccuccaacgcgcccucguaguccucgcccuccucaacuucgccacagucagccucucccuaucaaccugcaccacccuagacuucggccacaucaaaaagaaaagagucgaagccauccgcggccaaauccucuccaaacuccgucucaccagcccacccgaacccaccgucaugacccacgucccauaccaaguccucgcccuauacaacuccacgcgcgaacuacuagaagaaaugcacggagaaagagaagaaggaugcacccaagaaaacacagaaucagaauacuacgcaaaagaaauccacaaauucgacaugauccaaggacucgccgaacacaacgaacucgccgugugccccaaaggcaucaccucuaaagucuuccgauucaacgucuccucaguagagaaaaaccgcaccaaccucuucagagccgaguuccgaguccucagaguccccaaccccucuucaaaacgcaacgaacaacgcauugaacuguuccaaauccuacgaccagacgaacacaucgcuaaacaacgauacauaggaggcaaaaaccugcccacccgaggaacagcagaauggcucuccuucgacgucaccgacaccguccgcgaauggcucuuacgccgagaauccaaccuuggacuagaaaucuccauacacugccccugccacaccuuccagcccaacggagacauacucgaaaacauccacgaagucauggaaaucaaauucaaaggaguagauaacgaagacgaccacggacgcggcgaccucggccgacucaagaaacaaaaagaccaccacaacccgcaccucauacugaugaugaucccaccccaucgccucgauaaccccggccagggcggccaacggaagaaacgagcacucgacaccaacuauugcuucagaaaccucgaagaaaacugcugcgucagaccccucuacaucgacuuccgccaagaccuaggcuggaaauggguacacgaaccaaaaggcuacuacgccaacuucugcagcggacccugcccauaccuccgaucggcagacaccacccacucaaccguccucggccucuacaacacccuuaaccccgaagcauccgcaucccccugcugcguaccgcaagaccuagaaccccucaccauacuauacuacgucggccgaaccccaaaagucgaacaauuauccaacauggucgucaaauccugcaaaugcagcuaa

SEQ ID NO: 980 - RNA, 1386 nt, Artificial Sequence
  derived and/or modified CDS sequence (opt8) from Homo sapiens__NP_001057.1__HsTNFRSF1B
auggcaccaguagccgucugggccgccuuggccguuggccuagaacucugggccgcagcccacgcccugccagcccaagucgcauucaccccuuacgcccccgaacccggcagcacaugccgacuccgcgaauacuacgaccaaacggcacagaugugcugcucuaaaugcagcccaggccaacacgcaaaagucuucuguacaaaaaccagcgacaccguaugcgacuccugcgaagacuccacuuauacccaacucuggaacuggguccccgaaugccucucuugcggcagccgcugcucauccgaucaagucgaaacccaagccuguacccgcgaacaaaacagaaucuguaccugcagacccggcugguacugcgcccucuccaaacaagaaggaugccgacuaugcgccccucuccgcaaaugccgcccaggauucggcguagcacgccccggcaccgaaaccucagacgucgucugcaaaccuugugcgcccggaacauucagcaacaccaccucauccaccgacaucugcagaccccaucaaauaugcaacgucgucgcuauccccggaaacgcaucaauggacgcugucugcaccucaaccucucccaccagauccauggcaccaggggccguccaccuaccccaacccgucuccacucgaucccaacacacccaacccacaccagaaccguccaccgccccauccaccuccuuccuccuccccaugggcccauccccgcccgccgaagguucuaccggagacuucgcccuucccgucggccuuaucgucggugucaccgcacucggacuccucaucauaggcgucgucaacugcgucaucaugacacaaguaaagaagaaaccacuuugccuacaacgagaagccaaaguaccccaccuccccgcagacaaagcccguggcacccaaggacccgagcaacaacaccuccuaauaaccgcccccucauccuccuccucaucacucgaaucauccgccucagcacucgaccgcagagcgcccacccgcaaccaaccacaagcccccgguguagaagccuccggcgcuggcgaagcccgcgccuccacaggaucuuccgacucuucacccggcggccacggcacccaagucaacguaaccugcauagucaacguaugcuccuccuccgaccacuccucacaaugcaguucccaagcaucaucaacaaugggagacacagacuccucccccuccgaauccccaaaagacgaacaagucccauuuucaaaagaagaaugugccuucagaucccaacucgaaacaccagaaacccuacuuggcuccacagaagaaaaaccccucccccuaggcguucccgacgcuggcaugaaaccauccuaa

SEQ ID NO: 981 - RNA, 513 nt, Artificial Sequence
  derived and/or modified CDS sequence (opt8) from Homo sapiens__NP_002623.2__HsPGF
augccggucaugagauuguucccgugcuuucuccagcuauuggccggguuagcacuaccggcagugcccccacaacagugggcgcucucggccgggaacgggagcucggaaguggaagugguaccauuccaggaagugugggggcgcucguacugucgagcgcucgagcgauugguagaugucgugagcgaguacccaagcgagguagagcacauguucucacccucaugcgugagcuugcucaggugcacgggcuguugcggggacgagaacuugcacugugucccgguagagaccgcgaacgugaccaugcaacugcucaagaucagaagcggggacaggcccucguacguggaauugaccuuuagccagcacgugcgcugugaaugucgcccgcucagagaaaagaugaagcccgagcgcagacgaccgaaagggcgcgggaaaaggcgcagggaaaagcaaaggcccacggacugucacuugugcggggacgcggucccgcgcagguaa

SEQ ID NO: 982 - RNA, 1239 nt, Artificial Sequence
  derived and/or modified CDS sequence (opt8) from Homo sapiens__NP_001020537.2__HsVEGFA
augaccgaccgccagaccgacaccgcgcccucgccaucauaccaucucuugcccggacgcaggagaacagucgaugccgcggcaucgcgagggcaaggaccagagcccgcaccaggaggaggggucgaggggguaggagcgcgcggaguagcgcucaaacuguucguacaacugcuaggcugcaguagguucgggggagcggucguacgcgcgggggaggccgaaccaagcggcgcggccagaagcgcaagcagcggcagggaagaaccacagcccgaggaaggagaagaggaagaggaaaaagaagaggaaaggggcccacaguggcgacugggagcgcgcaagcccgggagcuggaccggagaagcggcagugugcgcggacucggccccggcagcacgcgcgccacaggcccuggccagagccucaggcaggggcgggcgcguggccaggcgcggggcagaagaaucaggaccgccccacagcccaagcaggcgagggagcgcaaguagggccgggcccggccgcgcgagcgaaaccaugaacuuccuccugagcuggguccacuggucgcucgcgcuauugcucuaccuccaccacgcgaaauggagccaggccgcgcccauggcagaaggaggcgggcagaaccaccacgagguagugaaauucauggacguauaccaaaggagcuacugccaccccauagaaacgcuuguggacauauuccaagaauaccccgacgaaaucgaauacauauucaaaccgagcugcgucccacucaugcgcugcggagggugcugcaacgacgaagggcucgaaugcgugcccacggaagagagcaauaucacgaugcaaaucaugcgcauaaaaccgcaccaggggcaacacauaggggagaugucguuccuacaacacaacaaaugcgaaugccgacccaagaaagaucgagcacgccaggaaaagaaaucagucaggggcaaaggaaagggccagaaaagaaaaagaaagaaaagccgguacaaaagcuggagcguauacgugggcgcgcgaugcugccuaaugccguggagccuaccgggaccgcacccaugcggacccugcagcgagagaagaaaacaccuauucguacaggacccgcagacaugcaaaugcucgugcaagaacacagauucgcgaugcaaagcacgacagcucgagcucaaugaaaggacaugcagaugugacaaaccccgacgcuag

SEQ ID NO: 983 - RNA, 699 nt, Artificial Sequence
  derived and/or modified CDS sequence (opt8) from Homo sapiens__NP_001165094.1__HsVEGFA
augaacuuccuccucuccuggguccacuggucccuagcccuccuacuauaccuccaccacgccaaauggagccaagccgcccccauggccgagggcggcggacaaaaccaccacgaagucguaaaauucauggacguauaccaacgaagcuacugccaccccaucgaaacccucguagacauauuccaagaauaccccgacgaaaucgaauacaucuucaaaccaagcugcguaccccuaaugcgaugcggcggcugcugcaacgacgaaggccucgaaugcguacccaccgaagaaagcaacaucacaaugcaaaucaugagaaucaaaccccaccaaggccaacacauaggcgaaauguccuuccuccaacacaacaagugcgaaugccgccccaaaaaagaccgcgcccgccaagaaaagaaauccguccguggaaaaggcaaaggccaaaaacgaaaacgaaaaaaaagccgcuacaaauccuggagcgucuacguaggcgcccgaugcugccuaaugccauggucccuccccggcccccaccccugcggccccugcuccgaacgccgaaaacaccucuucguccaagacccacaaaccugcaaaugcuccugcaaaaacacagacucacgcugcaaagcaagacaacucgaacuaaacgaacgcaccugccgcugugacaaaccacgacgauaa

SEQ ID NO: 984 - RNA, 624 nt, Artificial Sequence
  derived and/or modified CDS sequence (opt8) from Homo sapiens__NP_003368.1__HsVEGFB
augucaccacuacuccgccgacuacuccucgccgcccuccuccaacucgcccccgcccaagcccccgucagccaacccgacgccccaggccaccaacgcaaagucgucuccuggaucgacguuuacacucgcgcaacaugccaaccccgcgaaguagucgucccacucaccgucgaacuaaugggcaccgucgccaaacaacucguccccucaugcgucaccguccaacgcugcggaggaugcugccccgacgacggccuagaaugcgucccaaccggccaacaccaaguacgcaugcaaauacucaugauccgauaccccucaucccaacuaggcgagaugucccucgaagaacacucccaaugcgaaugccgacccaaaaaaaaagacuccgccgucaaacccgaccgagccgccacaccccaccaccgcccacaaccccgcuccgucccaggcugggacucagcccccggcgcaccaucacccgccgacaucacccaccccacacccgcacccggccccuccgcccacgccgcccccucaaccaccuccgcacuaacccccggccccgccgccgccgccgccgacgccgccgcaucaucaguagcaaaaggcggagcauaa

SEQ ID NO: 985 - RNA, 1260 nt, Artificial Sequence
  derived and/or modified CDS sequence (opt8) from Homo sapiens__NP_005420.1__HsVEGFC
augcaccuccucggauucuucucaguagccugcucccuucuggccgcagcccuccuccccggcccgcgcgaagcccccgccgccgccgcagccuucgaauccggccuagaccugagcgacgccgagcccgacgcaggagaagccaccgccuaugccuccaaagaccucgaagaacaauugcgcucggucucgucagucgacgaacucaugaccguccucuacccagaauacuggaaaauguauaaaugccaacuccgcaaagguggcuggcaacacaaccgggaacaagccaaccucaacagccgaacagaagaaacaaucaaauucgccgcagcccacuacaacacagaaauccucaaauccauagacaacgaauggcgcaaaacccaaugcaugccccgcgaagugugcaucgacguaggcaaagaguucggcgucgccacaaacacauucuucaaaccaccgugcgucuccgucuaccgcuguggcggaugcugcaacucggaaggacuacaaugcaugaacacguccaccuccuaccucuccaaaacccucuucgaaauaaccguaccacuaucccaggguccaaaacccguaacaauauccuucgcaaaccauacuuccugccgaugcauguccaaacuugacgucuacagacagguacacagcauaauccggcguucccuacccgcuacccuaccacaaugccaagcagccaauaaaaccuguccaacaaacuacauguggaacaaccacaucugucgcugccucgcccaagaagacuucauguucuccucagacgccggcgacgacucaacagacggcuuccacgacaucuguggcccaaacaaagaacuugaugaagaaacaugccaaugcgucugccgagccggacuccgacccgcaagcugcggcccccauaaagaacuagaccggaacucaugccaaugcguauguaaaaauaaacuauuccccucccaaugcggcgccaaccgggaguucgacgaaaauaccugccaaugcguaugcaaacgcacuugcccacgcaaccaaccccuaaaccccggcaaaugcgccugcgaaugcaccgaaucgccccaaaaaugccuacucaaaggcaagaaauuccaccaccaaaccugcuccuguuaccgccgacccugcaccaaccgccaaaaagccugcgaacccgguuucucauacucagaagaggucugccgaugcguccccagcuauuggaaacgcccacaaauguccuaa

SEQ ID NO: 986 - RNA, 1065 nt, Artificial Sequence
  derived and/or modified CDS sequence (opt8) from Homo sapiens__NP_004460.1__HsVEGFD
auguaccgugaaugggucgucgucaacguauucaugaugcuauacguucaacucguccaaggauccucaaaugaacacggcccagucaaacgcagcucccaauccacacucgaacgcuccgaacaacaaauccgcgccgccuccucccucgaagaacuacuucgcaucacccauucagaagacuggaaacuauggcgaugccgccuccgccucaaaucauuuaccucaauggacagccgcucagccucccaccgcuccacacgcuucgcggccacuuuuuacgacauagaaaccuuaaaagucauagaugaagaauggcaacgcacacaaugcucccccagagaaaccugcgucgaagucgccuccgaacucggcaaaucaaccaacaccuucuucaaacccccaugcgucaacguauuccguugcggaggcugcugcaacgaggaaucauuaaucugcaugaacacaagcacauccuacaucuccaaacaacucuucgaaaucucuguaccccucaccuccguccccgaauuaguaccugucaaagucgcaaaccacacaggaugcaagugccucccuaccgcaccccgccaccccuacuccauaauccggcgauccauccaaauccccgaagaagaccgaugcucacacucaaagaaacucugccccaucgacaugcucugggacuccaacaaaugcaaaugcguccuccaagaagaaaacccccuagccggcaccgaggaccacucccaccuacaagaaccagcccucugcggcccccacaugauguucgacgaagaccgaugcgaaugcgucugcaaaacccccugccccaaagaccucauccaacaccccaaaaacugcuccugcuucgaaugcaaagaaucccuagaaaccugcugccaaaaacacaaacuauuccacccagauaccugcucaugcgaagaccgcugccccuuccacacacgccccugcgccuccggcaaaaccgccugcgccaaacacugccgauuccccaaagaaaaacgcgccgcccaaggaccccacucccgcaaaaaccccuaa

SEQ ID NO: 987 - RNA, 72 nt, Artificial Sequence
  derived and/or modified CDS sequence (opt9) from Homo sapiens__AAA59606.1__signal peptide-HLA-A2-SP
auggcggucauggccccgcgaacgcucgugcucuugcucucaggcgcgcucgcgcucacgcaaacgugggcg

SEQ ID NO: 988 - RNA, 69 nt, Artificial Sequence
  derived and/or modified CDS sequence (opt9) from Homo sapiens__AAA61213.1__signal peptide-HsPLAT
auggacgcgaugaagcgcgggcucuguugcgugcucuugcucuguggcgcggucuuugucucgccaucg

SEQ ID NO: 989 - RNA, 81 nt, Artificial Sequence; identical to SEQ ID NO: 892
  derived and/or modified CDS sequence (opt9) from Homo sapiens__NP_000790.2__signal peptide-HsEPO

SEQ ID NO: 990 - RNA, 54 nt, Artificial Sequence
  derived and/or modified CDS sequence (opt9) from Homo sapiens__NP_000468.1__signal peptide-HsALB
augaaaugggucaccuucaucucucuccucuuccucuucuccuccgccuacucc

SEQ ID NO: 991 - RNA, 18 nt, Artificial Sequence
  derived and/or modified CDS sequence (opt9) from Artificial____cleavage site-Furin
aggaggaggaggaagagg

SEQ ID NO: 992 - RNA, 630 nt, Artificial Sequence
  derived and/or modified CDS sequence (opt9) from Homo sapiens__NP_061986.1__HsFGF21
auggacuccgacgaaaccggcuucgaacacuccggccucugggucuccguccucgccggccuccuccuaggcgccugccaagcacaccccauacccgauucuuccccacuacuccaauucggcggccaaguccgccaacgcuaccucuacacagacgacgcccaacaaacagaagcccaccuagaaauccgagaagacggcacagucggaggcgccgccgaccaaucacccgaaucccuccuacaacuaaaagcccucaaacccggcgucauccaaauccucggcgucaaaaccagccgauuccucugccaacgccccgacggcgcccucuacggaucccuacacuucgacccagaagccugcuccuuccgcgaacuccuccuagaagacggcuacaacgucuaccaaucagaagcccacggccucccccuccaccuccccggcaacaaaucaccacaccgcgacccagccccacgcggccccgcccgcuuccuuccccuccccggccucccacccgcacuccccgaacccccaggcauccucgcaccccaacccccagacgucggcuccucagacccccucuccauggucggccccucucaaggcagauccccauccuacgccuccuaa

SEQ ID NO: 993 - RNA, 1410 nt, Artificial Sequence
  derived and/or modified CDS sequence (opt9) from Homo sapiens__NP_002412.1__HsMMP1
augcacuccuucccuccccuccuacuacuccucuucuggggcguugucucccacuccuuccccgcgacccuagaaacacaggaacaagacguugaccucguccaaaaauaccuagaaaaauacuacaaccucaaaaacgacggacgccaaguagaaaaacgacgcaacuccggccccgucgucgaaaaacucaaacagaugcaagaguucuucggccucaaggucaccggcaaacccgacgccgaaacacuaaaaguaaugaaacaaccccgcugcggcguacccgacgucgcccaauucguacucaccgaagguaacccacgcugggaacaaacccaccucacuuaccggaucgaaaacuacacccccgaccucccccgcgccgacgucgaccaugccaucgaaaaagccuuccaacucuggucaaacgucacaccccucaccuucaccaaagucucugaaggccaagcagacaucaugauaucauucguacgaggcgaccaccgagacaacucccccuucgacggcccgggaggcaaccuggcacacgccuuccaaccagguccaggaaucggcggcgacgcacacuuugacgaggacgagcgauggaccaacaacuuccgagaauacaaccuccaccgcgucgcagcccacgagcucggccacucacugggacucucacacuccaccgauaucggagcacucauguaucccucuuacacuuucuccggcgacguacaacuagcccaagacgacauagacggaauccaagcaaucuacggacgcucccagaaccccguccagcccaucggaccucaaacaccaaaagccugcgacuccaaacuaacauucgacgccaucacaaccauacgaggcgaagucauguucuucaaagacagauucuacaugcgcacaaacccuuucuaucccgaagucgagcucaacuucaucuccgucuucuggccccaacuccccaacggccuugaagcagccuacgaguucgccgaccgcgacgaaguccgauucuucaaaggaaacaaauacugggccguccaaggccaaaacguccuacauggcuaccccaaagacauauacuccuccuucggcuucccaagaaccgucaaacacaucgacgcagcacucuccgaggaaaacaccggaaaaaccuacuucuucgucgcaaacaaauacuggcgcuacgacgaauacaagcgcucaauggaccccggcuauccaaaaaugaucgcacacgacuuccccggcaucggucacaaagucgaugcuguuuucaugaaagacggcuucuucuacuucuuccacggaacccgccaauacaaauuugacccaaaaaccaaacgcauccucacacuacaaaaagccaacagcugguucaacugccgcaaaaacuaa

SEQ ID NO: 994 - RNA, 1170 nt, Artificial Sequence
  derived and/or modified CDS sequence (opt9) from Homo sapiens__NP_002412.1__HsMMP1(1-19,100-469)
augcacuccuucccaccccuacuccuccuacucuucuggggcguagucucccacucauucguacucaccgaaggcaacccccgaugggaacaaacccaccucaccuaccgcauagaaaacuacacccccgaccucccccgcgccgacguagaccacgccaucgaaaaagccuuccaacucugguccaacguaacaccccucaccuucaccaaagucuccgaaggccaagcagacauaaugauaucauucguccgcggcgaccaccgagacaacucacccuucgacggccccggcggcaacuuagcccacgccuuccagcccggcccaggcauaggcggagacgcacacuucgaugaagacgaacgcuggaccaacaacuuccgcgaauacaaccuccaccgcgucgcagcccacgaacucggccacucccuuggacucucacacuccaccgacaucggagcccuaauguacccaucauacacauucucaggcgacguacaacucgcccaagacgacaucgacggcauacaagcaaucuauggccgcucacagaacccaguacaaccaaucggcccccaaacccccaaagccugcgacuccaaacucaccuucgacgcaauaaccacaauucgaggagaagucauguucuucaaagaccgauucuacaugcgcaccaaccccuucuaccccgaaguagaacucaacuucauauccgucuucuggccucaacuacccaacggccucgaagcagcauacgaguucgccgaccgagacgaaguccgauucuucaaaggcaacaaauacugggccguccaaggccaaaacguccuacacggcuacccaaaagacaucuacucuuccuucggcuucccacgaacaguaaaacacauagacgcagcucucucagaagaaaacaccggcaaaacuuacuucuucguagcaaacaaauacuggcgcuacgacgaauacaaacgcucuauggaccccggauaccccaaaaugauagcucacgacuuccccggcauaggucacaaagucgacgcaguauucaugaaagacggcuucuucuacuucuuccacggcacccgccaauacaaauuugaccccaaaaccaaacgcauccucacccuucaaaaagccaacuccugguuuaacugucgcaaaaacuaa

SEQ ID NO: 995 - RNA, 3357 nt, Artificial Sequence
  derived and/or modified CDS sequence (opt9) from Clostridium histolyticum__BAA77453.1__ColG
augaaaaagaacauccuaaagauacucauggacagcuacagcaaagaaucgaaaauccaaaccguucgucgaguaaccuccguaagccuccuagccguauaucugaccaugaacacgagcagccucguacuagccaaacccauagaaaacaccaacgauaccucaaucaaaaacguagaaaaacugaggaacgcacccaaugaagaaaacucaaagaaaguugaagacagcaaaaaugacaaggucgaacacgucaaaaacaucgaagaagcaaaaguagagcaaguagcccccgagguaaaaagcaaaagcacgcucagaucagcaagcauugccaacacaaacagcgaaaaauacgacuucgaauaccuaaacggucuaagcuauaccgaacugacgaacuuaauaaagaacaucaaauggaaccaaauaaacggccuauucaacuacuccacaggcagccaaaaauucuucggggacaaaaacagaguacaggcaauaaucaacgcgcuccaggaauccggccguaccuacacggcgaacgacaugaaggggaucgaaacauucaccgaaguacuccgugccggcuucuaccuuggguauuacaaugacggacucagcuaccucaacgaccgcaacuuucaggacaagugcauccccgcaaugaucgcaauccaaaagaacccuaauuucaaauuaggaacagccguacaggacgagguaaucacgagccugggcaaauuaaucggcaacgccucugcgaacgcagaggucgucaacaacugugugccaguccucaagcaguuccgggagaaccugaaucaauacgcacccgacuacguaaagggcacugccgucaacgaacucauaaaaggcauagaguucgacuucucaggcgccgccuacgaaaaagacguuaaaacgaugcccugguacggaaaaauagaccccuucauaaacgaauuaaaagccuuaggccucuacggcaacaucaccagcgcaacggaaugggccucagacguagguaucuacuaucuuuccaaauucggauuauacagcaccaaccgcaacgacauaguacaaucccuagagaaagccgucgauauguacaaauacggaaaaauagcguucguagccauggaacgaaucaccugggacuacgacggcaucggcucaaacggcaagaaagucgaccacgacaaauuccuggacgacgccgaaaaacacuaucuccccaaaaccuacacauucgacaacgggacguucauaauccgcgcgggcgacaaaguauccgaagagaaaaucaaacgccuauacugggccuccagagaaguuaaaagccaauuucaccgggugguggggaacgacaaagcccuagaagucggaaacgccgaugacguccucacaaugaaaaucuucaauagucccgaagaauacaaauucaacaccaacauaaacggcguuagcaccgacaaugggggccuguacaucgaaccccggggcacauucuacaccuacgaaagaacgccucaacaaucuaucuucagucuggaggaguuguuccgccacgaauacacccacuaccuacaagcacguuaccucgucgacggccuauggggccagggacccuuuuacgaaaagaacaggcuaaccugguucgacgagggcacagccgaguucuucgccgggagcacccgcacauccggaguacugcccaggaaaagcauccucggcuaccuugccaaagauaaaguugaccaucgcuacucacugaagaagacccuuaacagcggauaugacgauagcgacuggauguucuacaacuauggguucgcgguagcacacuaccuauaugaaaaagacaugcccacuuucaucaaaaugaauaaggcaauccucaacaccgacgucaaauccuacgacgaaaucauuaagaaacugagcgacgacgcaaacaagaacaccgaguaccagaaccacauccaggagcuagccgacaaguaccagggggcaggaaucccccuaguaucagacgacuaccucaaagaucacggcuacaagaaagcgagcgaaguauacuccgaaauaucgaaggcagcaagccucacgaacacaagcgugacagccgaaaaaucacaauacuucaacaccuucacucuccgggguaccuacacaggcgagaccuccaagggagaauuuaaagacugggacgaaaugagcaaaaagcucgacggcacccucgaaucacucgccaaaaacuccugguccggcuacaagacauuaacugcauacuucacuaauuaccgcgucaccagcgacaacaaaguccaauacgacgucguuuuccacgggguacuaaccgauaacgcagacaucuccaacaacaaagcaccuaucgcaaaagucacgggaccauccacuggggccguuggacgcaauauugaguucucagguaaagacagcaaagacgaggacggcaaaaucgucagcuacgacugggauuucggagacggcgcgacaucacgaggcaaaaacagcguccacgcauauaagaaagccggcaccuacaacguuacacuaaaggucacagacgacaaaggagcaacagcgacagagucauucacaauagagaucaaaaacgaggacacgacgacaccuaucacaaaagaaauggaaccgaacgacgacaucaaagaagccaacggcccaauagucgaaggaguaaccguuaaaggcgaccucaacggcucagaugacgccgauaccuucuacuucgacgucaaggaagacggggacguaacaauugaacuaccauacucagggucaagcaauuucacauggcucgucuacaaagaaggcgacgaucagaaccauauagcaucaggcauagacaaaaacaacucgaaagugggcaccuuuaaaagcacaaaaggccgccacuacguguucauauacaaacacgacagcgccucgaacaucucuuacucacuaaacaucaagggccuaggaaacgagaagcugaaagaaaaagaaaacaacgacucuucagauaaggccaccgucauucccaacuucaacacaacaaugcaaggcucgcugcucggcgacgacuccagagacuauuacuccuucgagguaaaagaagaaggagaagucaacaucgaauuggacaagaaagacgaguucggggugacauggacccuucacccggaauccaacauaaacgacaggauaaccuacgggcaaguagauggaaacaaagugucgaacaaagucaagcuccgacccggcaaauacuacuugcuagucuacaaauacagcggcucuggcaacuacgaacuacgaguaaacaaauag

SEQ ID NO: 996 - RNA, 3081 nt, Artificial Sequence
  derived and/or modified CDS sequence (opt9) from Clostridium histolyticum__BAA77453.1__HsALB(1-18)_ColG(111-1118)
augaaaugggugacuuucauuucccugcuguuccucuucagcagcgccuacuccaucgcaaacacaaacagcgaaaaauacgacuucgaauaccugaacggacucaguuacaccgaacucacaaaccucaucaagaacaucaaguggaaccaaauaaacggccucuucaacuacucgaccggcucccaaaaguucuucggggauaagaaccgcguccaagccauuaucaacgcccuccaagaaagcgggcgcacauacaccgccaacgacaugaagggcauagaaacauuuacagaagugcuacgcgcgggcuucuaccucggcuauuacaacgacggacucagcuaccuaaacgaccgaaacuuccaggacaagugcauaccggcaaugauagccauccagaaaaaucccaacuuuaaacucggaacugccgugcaagacgaaguaaucaccucgcucggaaaacuaaucggcaacgccucagccaaugccgaaguagucaauaacugcguccccgucuuaaagcaauuccgagagaacuugaaccaauacgcaccagacuacgucaagggcaccgccguaaacgaguuaaucaaagggauagaguucgacuucucgggagccgcauaugaaaaagacgucaaaaccaugccaugguacggcaaaaucgaccccuucauaaacgaacucaaagcccuuggccuauacggcaacauaacaagcgcgacagaaugggccagcgacguaggcaucuacuaccuaucaaaguucggacucuacagcaccaaccggaacgacauaguccaaagccucgaaaaagcaguagacauguacaaauacggcaaaauagccuucgucgcaauggagcgcauaacaugggauuacgacgggaucggcaguaaugguaagaaaguagaccaugacaaguuccucgacgacgcagaaaaacacuaccuaccuaagacauacaccuucgacaacggaaccuucauaauccgcgcaggcgacaaaguuagugaggagaaaaucaaaagacuauacugggcaucaagagaagucaaaucacaauuccaccgcguagucggcaacgacaaagcccucgaaguggggaacgccgacgacguccuaacaaugaaaaucuucaacagccccgaagaauacaaauucaauacuaauauaaacggaguaagcacagacaacggcggccuauauaucgaaccccgcgggacuuucuauaccuacgaaaggacgccgcaacaauccauauucucacuagaagaacuauuccgccacgaauacacccacuaccuccaggcaagauaccuagucgacggccuauggggucagggcccauucuacgaaaagaaccgccuaaccugguucgacgagggaacagccgaauuuuucgccggauccacccgcacaagcggaguccugccccgcaaaucaauacucggguaccuagcgaaagacaaaguggaccaccgauacagccuaaagaaaacacucaacuccggauacgaugacagcgacuggauguucuacaacuacggauucgccgucgcacacuaccuauacgagaaagacaugcccacuuucaucaaaaugaacaaagcgauacucaacaccgacgucaaaagcuacgacgagaucaucaagaaacuguccgacgacgcaaauaaaaacaccgaauaccagaaccacauucaggaacucgccgacaaauaccaaggagccggcaucccacucgucagcgacgacuaccucaaagaccacggguacaaaaaggcguccgaaguauauucugagaucagcaaagccgcaucccugaccaacacaucagucacagcagagaaaucucaguacuucaacacauucacgcuccgggggaccuacacaggcgaaacuagcaaaggggaguucaaggacugggacgagaugagcaagaaacuggauggcacacucgagagucucgcgaaaaacuccuggucgggcuacaaaacgcuuacagcauauuucaccaacuaccgcgucaccucagacaacaaaguccaauacgacgucguguuccacggagugcucaccgacaacgccgacaucuccaacaacaaggcaccuaucgcaaaggugaccggccccucaacaggcgcgguuggacggaacaucgaguucuccgggaaagacaguaaggacgaggacggcaaaauaguaagcuacgacugggacuucggagacggggcgaccucccgaggcaagaacagcguccacgccuacaagaaagccggcacauacaacgugacacuuaaaguuaccgacgacaaaggagccaccgccacggaguccuuuaccaucgagaucaaaaacgaagacaccacaaccccaauaaccaaagaaauggaaccuaacgacgacauuaaggaggcaaacggcccaauaguagaaggaguuacggucaagggugaccucaacgguuccgaugacgcagacaccuucuacuucgacgucaaagaagacggggauguaaccaucgaacuacccuacuccggauccucaaauuucacuuggcuaguauacaaggagggcgacgaccaaaaccacauagccucggggauagacaaaaacaacucuaaaguaggaaccuuuaaguccacaaagggacggcacuacgucuuuaucuacaagcacgacuccgcuuccaacauaucguacucguuaaacaucaaaggacuaggaaacgaaaaacucaaagagaaagaaaacaacgacucaucggacaaagcgacaguaauaccaaacuucaacaccacgaugcagggcucccuauugggagaugacagccgagacuacuacucguuugaaguaaaagaggaaggcgaagucaacaucgaacuagauaagaaagacgaguucggaguuacguggacccuccaccccgagagcaacaucaaugaccgaauuaccuauggccaggucgacgguaacaaaguaucuaauaaagucaaacuccgcccaggcaaauacuaccuccucgucuacaaguacagcgguagcggcaacuacgaacuacgcgugaauaaauaa

SEQ ID NO: 997 - RNA, 3429 nt, Artificial Sequence
  derived and/or modified CDS sequence (opt9) from Clostridium histolyticum__BAA77453.1__HsALB(1-18)_ColG(1-110)_CS-F_ColG(111-1 118)
augaagugggugacauucaucucccuacuguucuuauuuaguuccgccuauaguaugaaaaagaacauucucaaaauccucauggacagcuacagcaaagagagcaagauccagaccgugcgucgaguaaccagcgucagcuuacuagcgguauaccuaaccaugaacacauccagccuaguccuggcaaaacccaucgaaaacaccaaugacacuuccaucaagaacgucgagaagcuacgaaacgcaccaaacgaagagaauagcaagaaaguugaagauuccaaaaaugacaaaguagagcacgucaaaaacaucgaagaagcaaaagucgaacaaguagccccggaagucaaauccaagagcacgcuccgcuccgccaguagacggcgcaggaaacgcaucgcaaacacaaacuccgagaaauacgacuucgaauacuugaacggauuaagcuacacggagcuaaccaaccucaucaaaaauauaaaauggaaccaaauaaacggccuauucaacuauagcaccgggucccagaaauucuucggagauaagaaccgcguacaagcuaucaucaaugcccugcaggaauccggccgcacauacacggccaacgacaugaaagguauagaaacauucacagaagugcuaagggccggcuucuaccucggcuacuacaacgacgggcuaucauaccuaaaugacagaaauuuucaggacaaaugcauaccggcuaugaucgcgauacagaaaaacccgaacuucaagcuaggcacggccguacaagacgaagucaucaccuccuugggaaaacucauaggcaacgccuccgcgaacgccgaagucgucaacaacuguguacccguccuaaaacaguuuagagagaaccuaaaccaguacgcuccggacuacgucaaagggacagcagugaaugaacugauuaagggaauagaguucgacuucucaggcgcugccuacgaaaaggacgugaaaaccaugcccugguacggcaagaucgacccauucaucaacgaauuaaaagcacucggccuauauggcaacauaaccuccgccaccgaaugggcaucggacgucggaauauacuaccucaguaaauuuggacuguauagcaccaacagaaacgacaucguccaaagccucgagaaagcagucgacauguacaaauacggcaaaauagccuucguggcaauggaaaggaucacaugggacuacgacggcaucggguccaacggaaagaaaguagaccacgacaaauuucuugacgacgccgagaaacacuaccuaccaaaaacuuacaccuucgacaacggcaccuucauaaucagagcaggagacaaagucagcgaagagaaaaucaaacggcuuuacugggccucacgugaagugaaaagccaguuccaccgcgucgugggaaaugacaaggcauuggaaguagggaacgcggacgacguccuaacaaugaaaauauucaacagcccagaagaauacaaauucaacacuaacauaaauggagucuccaccgacaacggcggccucuacauagaaccaaggggcaccuuuuacacauacgaacgcacaccucagcaaagcauauuuucacuagaagaacucuuccgucacgaauacacccacuaccuccaggcuagauaccucguugacggacuguggggccagggccccuuuuaugagaaaaaccgccucacgugguucgacgaaggcacagccgaguucuucgccggcagcacacgaaccagcggcguacuaccacgaaaaucgauccucggcuaccuggcaaaagacaaagucgaucauagguacagccucaaaaagacacuaaacagcggauaugacgacucugacuggauguuuuacaacuacggguucgccgucgcacacuaccucuacgaaaaggacaugcccacauucaucaaaaugaacaaggcgauccuaaacacugacguaaaaagcuacgacgaaauaauaaagaagcuaagcgacgaugccaacaagaacacagaguaccaaaaccacauucaggaacuugccgacaaauaccagggagccggaaucccgcucguauccgacgacuaccuaaaagaccacggauacaaaaaggcauccgaagucuacagcgaaauaagcaaggccgcgucacuaacaaacacgucagucaccgcagagaaaucccaauacuucaacaccuuuacacugagagggacauacaccggcgaaaccucaaaaggagaguucaaagacugggacgaaauguccaagaaacuagacggaacacucgaaucgcuagcuaaaaacuccuggagcggauacaaaacccucacggcuuauuucaccaacuaccgcgucacgagcgacaacaagguacaauaugacguugucuuccacggcguccucacggacaacgccgacaucucaaacaauaaggcccccauagcaaaaguaacaggaccauccaccggcgcagucggccgaaacauagaguucucaggcaaagauuccaaagacgaagacgggaaaaucguuaguuacgauugggacuucggcgacggcgccaccucgcgagguaagaacuccgugcacgcauacaaaaaggccggaaccuacaacguuacccuaaaggugacagacgacaaaggagcgacggcgacagaaucuuucacaaucgaaaucaaaaacgaagacacuacaacacccaucacgaaagaaauggagcccaacgacgacaucaaggaagcaaacgggccgaucguugaaggaguaaccgucaaaggagaccucaacgggagcgacgacgcagacaccuucuacuucgaugucaaagaggacggggacguaacaaucgagcuccccuacucaggaagcagcaacuucacauggcuaguguacaaggagggcgacgaccagaaccacauagcguccggcaucgacaaaaacaacucaaaaguaggcaccuucaaaaguaccaaaggccgccacuacguuuucaucuacaagcacgacuccgccuccaacauaagcuacucgcuaaacaucaagggcuuaggcaacgaaaaacugaaagaaaaagaaaacaacgacucaucugacaaggccaccguaauacccaauuucaacacaaccaugcagggcucacugcucggagacgacucacgagauuacuacuccuuugaaguaaaagaagaaggcgaaguaaacaucgaauuggauaagaaagacgaguucggcgugacguggacacuucacccagaaucaaacaucaacgacaggauaaccuaugggcaaguagacggcaacaaaguaucuaacaaggucaagcuccgccccggcaaguacuaccugcucgucuacaaauacagcggaucuggaaacuaugaacuccgcguaaacaaauaa

SEQ ID NO: 998 - RNA, 3105 nt, Artificial Sequence
  derived and/or modified CDS sequence (opt9) from Clostridium histolyticum__BAA34542.1__ColH
augaacuuccucaaaaucauacugaaccgcggaaaaaccaugaagagaaagugccuauccaaaagguuaaugcucgccauaaccauggccacgauauucacagugaacucgacccucccgauuuacgccgccguagacaaaaacaacgcgaccgccgcgguacagaacgaguccaaacgguacacgguauccuaucucaagacccucaacuacuacgacuuggucgaccuucucgucaaaacagagauagaaaaccuucccgaucuauuccaauacucuagcgacgccaaagaguucuacggaaacaaaacaagaaugucguucaucauggacgagaucggccgccgcgcuccucaauacacagaaauagaccacaaaggcauacccacccuggucgaggucguccgcgccggcuucuaccuagguuuccacaacaaagaacuaaacgaaaucaacaagcgcagcuucaaagaaagggucauacccuccauacuggcuauccagaaaaaccccaacuucaaauugggaaccgaaguacaagacaaaauagucucagccacaggccugcucgcagguaacgagacugcaccaccggaagugguaaauaacuucaccccgauacuccaagacuguaucaagaacaucgaccguuacgcccucgacgaucucaaaagcaaagcacucuucaacgugcucgcagcaccaacguaugauaucacugaauaccugagagcaaccaaagaaaaaccggagaacacccccugguacgggaaaaucgacggguucauaaacgaauugaagaaacuggcccuuuacggcaaaauaaacgacaauaacucauggauaaucgacaacggaaucuaccacauagcaccccucggcaaacuccacaguaacaacaaaauagggaucgagacccuaaccgaagugaugaagguuuaccccuaucucucaaugcagcaucuccagagugcagaccaaauaaaaaggcauuacgacucaaaagacgccgagggcaacaagauaccucucgacaaguucaagaaagagggcaaagaaaaguacugccccaaaaccuacacguuugacgaugguaaagucaucauaaaggcaggagcacgagucgaagaagaaaaagucaaacgucuuuacugggccagcaaggaaguaaacagccaguucuuccgagucuacggcaucgacaaaccacucgaggaaggcaacccggaugacauccucacaauggugaucuacaacagcccggaggaguacaaacuuaacuccgucuuguacggcuaugacaccaacaauggcgggauguacaucgaaccagaaggaacuuucuucaccuaugagcgcgaagcccaagaguccaccuauacccucgaggaacucuuccgacacgaauacacucauuacuuacaaggccgcuacgcaguacccgggcaauggggccgcaccaagcuauacgacaaugacagacuaacuugguacgaggaaggcggagccgaacuauucgcaggcuccacacgcaccucaggaauacucccucgcaaaagcauaguauccaacauacacaacaccacccgaaacaacagauauaaacuaagcgacaccguccacagcaaauacggagcgagcuucgaguucuacaacuacgccugcauguuuauggacuauauguacaacaaagauaugggcauacucaacaaacuuaacgaccuagcaaagaacaacgacgucgacggcuacgacaacuacauacgggaccucagcucgaacuaugcacuaaacgacaaauaccaagaccacaugcaggaacgcauagacaacuacgaaaaccucaccguacccuucgucgcagacgacuaccuaguccgacacgcguacaaaaaucccaacgaaaucuacuccgaaaucagcgaagucgccaagcugaaggaugccaaaagcgaagugaagaaaucacaauauuucucaaccuucacgcuccgcggcucauacacagguggcgccuccaaaggaaaacuagaggaucaaaaagcaaugaacaaguucauagacgacucccucaaaaagcucgacacauacuccugguccggcuacaaaacacuuaccgcguacuucaccaacuacaaaguagacuccucgaaucgaguaaccuacgacgucguauuccacggcuaccuuccaaacgaaggcgacuccaaaaacucccuacccuacggaaagauaaacggcaccuacaaagguaccgaaaaggagaaaaucaaauucuccagcgaagggucauuugacccagacggaaaaaucgucuccuacgaaugggacuucggagacggaaauaagucaaacgaagaaaaccccgaacacagcuacgacaaagugggaaccuacaccguaaagcucaaagugacagaugacaaaggcgaaucaaguguaaguacgaccacugcugagauaaaagacuugucggagaauaaacuucccguaaucuacaugcacguccccaaaucaggagcacuaaaccagaaagucguauucuacggcaaaggaaccuacgaccccgacggcucaauagccggauaucaaugggauuucggggacggaagcgacuuuucgucggaacagaaccccagccacguguacacgaagaaaggggaauacaccgucacccugcggguaauggacagcucaggccaaauguccgagaaaacaaugaaaauaaaaaucaccgaccccgucuaccccaucggcacggaaaaagaacccaacaacuccaaagaaaccgcauccggcccaaucgugcccggcauacccgucuccggcacaauagaaaauaccuccgaccaagacuacuucuauuucgaugucaucacccccggagaggucaaaaucgacaucaacaaacugggcuacggcggagcaaccuggguagucuacgacgagaacaacaacgccgucaguuacgcaaccgacgacgggcaaaaccucagcggaaaguucaaagccgacaaaccaggaagauacuacauccaccuauacauguucaauggcagcuacaugcccuacagaauuaauaucgagggauccgugggccgcuaa

SEQ ID NO: 999 - RNA, 3066 nt, Artificial Sequence
  derived and/or modified CDS sequence (opt9) from Clostridium histolyticum__BAA34542.1__ColH
augaaacgaaaaugccuuagcaaacgccugaugcucgccauuaccauggcgacaauauucaccgugaacaguacgcucccuaucuacgcagccguagacaaaaacaacgcaaccgcagccguacagaacgaguccaaacgcuacaccgucuccuaucucaagacccuaaacuacuacgaccuuguagaccuccucgugaagaccgaaaucgaaaaccuacccgaccucuuccaauacuccagcgacgccaaggaguucuacggaaacaaaacccgaaugagcuucauaauggacgaaaucggucgccgcgcgccccaauacacggaaaucgaccauaaaggaaucccuaccuuagucgaggucguaagagcggguuucuaccuaggauuccacaacaaagagcuaaacgagaucaacaaacgcuccuucaaagaacgcgugauccccucuauccuagccauccagaaaaacccaaauuucaaacucggcaccgaaguacaagauaaaauaguaagcgccaccggacuccucgcuggcaacgaaaccgcacccccagaaguagugaauaacuucacacccauccuccaagauugcaucaaaaauauagaccgauacgcccuggacgauuuaaaaagcaaagcacucuucaacguacucgcugcacccacauacgacaucacagaguacuugagggcaacgaaagagaaacccgaaaacacccccugguacggaaaaauagacggcuucaucaacgaacuaaagaaauuggcgcuauaugggaaaaucaacgacaacaacaguuggauaaucgacaacggcaucuaucacauagcaccccucggcaaacuccauagcaacaacaaaauaggcauagaaacacuaacugaagucaugaaaguauaccccuaucucagcaugcaacaccuacaauccgccgaccaaaucaaacgccacuacgacagcaaagacgcagaaggcaacaaaauaccccucgacaaguucaagaaagaaggaaaagagaaauacugccccaaaaccuacaccuucgacgacggcaaaguaaucaucaaggccggagcacgaguagaagaagagaaaguaaaacgacucuacugggcgagcaaagaagucaauagccaauucuuccgcguuuacgguaucgauaaaccgcuugaagaaggcaacccagaugacauccuaacgaugguuaucuauaacagucccgaagaauacaaacucaacagcguccuuuauggguacgacaccaauaacggcgggauguacaucgaacccgaggggaccuucuucacauacgaacgagaagcccaagaauccaccuacacacuagaagaacucuuccgccacgaauacacccacuaucuucagggcagauacgccguaccaggacaaugggggaggaccaaauuauacgacaacgaccgacucacaugguacgaagaaggcggcgccgaguuauucgcuggaaguacucgaaccuccggcauccuuccccgaaaaagcauagucucgaacauccacaacacaacccguaacaaucgcuacaaacuauccgauacaguccacagcaaauauggagcuagcuuugaguucuacaacuaugccugcauguucauggacuacauguacaacaaggacaugggcauccucaacaaacuaaacgaccuggcgaaaaacaacgacguagacggcuacgacaacuacauacgcgaucuuagcucuaacuacgcccuaaacgacaaauaucaagaccauaugcaggaacggaucgauaauuacgaaaaucucacaguacccuucgucgccgacgacuaccuaguccggcaugcauacaaaaacccgaaugagauauacuccgagaucucagaagucgcaaaacugaaagacgcaaagucggaaguuaaaaagagccaauacuucagcacauucacccuccgcggaucuuacaccggcggggccuccaaggggaaacuugaggaccaaaaagcaaugaacaaauuuaucgacgacagccucaaaaagcucgacaccuacagcuggagcggguacaaaacacuuacggcauacuucaccaauuacaaagucgacucgagcaaucgggucaccuacgacguggucuuccacggcuaccuaccgaacgaaggcgacagcaaaaacucacuaccguacggcaaaauaaacggcacguauaaagggaccgaaaaagaaaagaucaaguucucaucagaaggcuccuucgacccagacggaaaaauagugagcuaugagugggauuucggcgacgggaacaaaucaaacgaagagaacccggagcacagcuacgacaaagucgggaccuacaccgucaaacuaaaagucaccgaugacaaaggcgaguccucaguauccacgaccacggcugaaaucaaagaccugagcgaaaacaagcucccagucauauacaugcacgucccgaaauccggcgcccuaaaccagaaagucgucuucuacggcaaaggcacuuacgacccagacggcagcauagcaggauaccaaugggacuucggggacggcuccgacuucucaucagaacagaacccaucacacgucuacaccaaaaagggcgaguacacaguuacacuccgcgugauggacuccuccggacaaaugagcgagaaaacaaugaaaauaaaaauaaccgacccgguauacccaauaggcacggaaaaggaaccuaacaacagcaaagaaacagcaucaggucccauuguacccggcaucccagucucaggaaccaucgaaaacaccuccgaccaagacuacuucuacuucgauguaauaacacccggcgaaguaaaaaucgacaucaacaaacucggguacgggggagcaaccugggucguauacgaugaaaacaacaacgcugucucauacgcaaccgacgacggacagaaccugagcggcaaguucaaagccgacaaaccagggagguacuacauacaccucuacauguucaaugguagcuacaugccuuaccguauaaauaucgaaggaucuguaggacgauaa

SEQ ID NO: 1000 - RNA, 3000 nt, Artificial Sequence
  derived and/or modified CDS sequence (opt9) from Clostridium histolyticum__BAA34542.1__HsALB(1-18)_ColH(41-1021)
augaaaugggugaccuucauaagccuucucuuccucuucucauccgccuacagcguacaaaacgagucgaaaagauacaccguaucauaccucaagacccucaacuacuacgaucucgucgaucuauuagucaagacagaaaucgaaaaucuacccgaccuauuccaguacucaucggacgccaaagaguucuacggcaacaaaacacgaaugagcuucauuauggacgaaauagguagacgagcgccgcaguacacggaaaucgaccacaaagggauccccaccuuagucgaaguuguacgcgcgggcuucuaccuaggauuucacaacaaagaacuuaacgaaaucaacaaacgcaguuucaaagaacgcgucauccccagcauccuagcgauccagaaaaaccccaauuuuaaacucggcaccgaaguacaggacaagauagugucagcaacaggccugcucgccggaaacgaaacggccccacccgaaguagucaauaacuucacacccauacugcaggacugcaucaaaaauaucgaccgauacgcacucgacgaccucaagagcaaagcccucuucaacgugcucgccgccccaaccuacgacauaaccgaauacuugagggccacaaaagaaaaacccgaaaacaccccaugguacggcaaaauugacggauucaucaacgagcugaagaaacucgcccucuacgggaaaaucaaugacaacaacagcuggaucaucgacaacggcaucuaccacauugccccgcuaggcaaacuacacuccaacaacaaaaucggcaucgaaacgcucacggaagucaugaaaguauauccauaucuauccaugcaacaccuccaaucugccgaccaaaucaaacgccacuacgacagcaaggacgcggaaggaaacaaaaucccacucgacaaguuuaagaaggaaggcaaagaaaaauacugcccuaaaaccuacacguucgaugacgggaaaguaauuaucaaagccggcgcccgagucgaagaggaaaaggugaaacgccuauacugggccuccaaagagguuaauucacaauuuuuccgagucuauggcaucgacaaaccacucgaggaagguaaccccgacgauauccucaccaugguaauauauaauucgcccgaggaauauaaacucaacagcgucuuauacggcuacgacaccaacaacgguggcauguacaucgagccggaaggcaccuucuucaccuacgagcgugaagcccaagaauccacguacacacuugaggaacuauuccgacaugaauacacccacuaccugcaaggccgguacgcaguaccuggccaguggggccgcacuaaacucuacgacaacgaccgucucaccugguacgaagaagguggagccgaacucuucgccggcuccacccgcaccagcggcauccuaccccgaaaauccauagucucgaacauucacaacacaacccgaaauaaccgcuacaaacucagcgacaccguacacucaaaauacggagccagcuucgaguucuacaacuacgcgugcauguucauggacuacauguacaacaaagauauggggauucuaaacaaacuuaacgaccucgccaaaaauaacgacgucgacgguuacgacaacuauauacgagaucuuucaucgaacuacgcacuaaacgacaaauaccaggaccacaugcaagaacgcaucgacaacuacgaaaaccucaccguccccuucgucgcagacgauuaccucguccgacacgcauacaagaaccccaacgaaauauacucggagaucagcgaagucgccaagcucaaagaugcaaaauccgaagucaaaaagucacaguacuuuagcacauucacacuccgcgggagcuacaccggcggcgcguccaagggaaagcucgaagaccaaaaagccaugaacaaauuuauagacgacucccucaagaaacucgacaccuacucguggagcggcuacaaaacacuuaccgcauacuucaccaacuacaaaguagacagcucaaaucggguaacuuacgacguagucuuccacggcuaccuucccaaugaaggagacagcaagaacucacucccuuacggcaaaauaaauggaacguacaagggcacggaaaaggagaaaaucaaauucagcuccgaaggcuccuucgaccccgacggaaaaauaguaucauacgaaugggacuucggcgacggcaacaagaguaacgaagaaaaucccgaacacucauacgacaaagucggcacguacaccgucaaacuaaaaguaacagacgacaaaggcgaauccucagugaguacgaccaccgcagaaaucaaagacuuaucagaaaacaaacuccccguaauauacaugcacgucccaaagagcggggcacucaaccaaaaagucgucuucuacggcaaaggaaccuacgacccugacggauccaucgccggcuaccagugggauuucggcgacggaagcgacuucucaucggagcaaaacccaagccacgucuacacgaaaaagggagaauacacagugacacuccgaguaauggacuccucagggcagauguccgagaaaaccaugaaaauaaagaucaccgacccugucuaccccaucggaaccgaaaaggagccuaacaauuccaaagaaaccgccagcggaccaauaguacccgguauccccgucuccggaaccaucgaaaacacgucagaccaggacuacuucuacuucgacgucauaaccccgggcgaaguaaaaaucgacaucaacaaacuaggcuacggcggagccacaugggucguauacgacgaaaacaacaacgcgguaucuuacgcaacagacgacggccaaaaccuaagcggcaaguucaaagcagacaaacccgggcgcuacuacauccaccuguacauguucaacggaagcuacaugccauacagaauaaauaucgaaggcuccguaggacguuaa

SEQ ID NO: 1001 - RNA, 3138 nt, Artificial Sequence
  derived and/or modified CDS sequence (opt9) from Clostridium histolyticum__BAA34542.1__HsALB(1-18)_ColH(1-40)_CS-F_ColH(41-102 1)
augaaaugggucaccuucaucucucuacuguuccucuucucuagcgcauauagcaugaaacggaaaugucuauccaaacgccugaugcuggccauuacgauggccaccaucuucaccgucaacucuacccugccgaucuacgccgccguagacaagaacaacgccaccgccgcucgccgccgaagaaagaggguccaaaacgaaagcaaaagauacacaguaagcuaccuuaagacacucaacuacuacgaccucguagaccuacucgucaagacagaaauugagaaccuccccgaccuauuccaauacagcagcgacgccaaagaguucuacggcaacaaaacccgaaugucuuucauaauggaugaaauaggacgcagagcgccccaauacacggaaaucgaucacaaaggcauacccacccuaguggaagucguacgagcuggcuucuaucuggguuuccacaacaaagaacugaacgaaauaaacaagcgcagcuucaaagaacgcgugauccccucaauacuggcuauccagaaaaaucccaauuucaaacuagggaccgaaguccaagacaagaucguguccgcgacaggacuccucgccggcaacgaaaccgccccgccggaagucguuaacaacuucacgccaauacuacaagacugcauuaaaaacaucgaccgauacgcccuagacgaucugaaauccaaggcacuauucaacguucuggccgcaccaacauacgacaucacagaguaccugcgugccacaaaagaaaaaccagaaaauacccccugguacggcaaaaucgacggauucauuaaugaguugaaaaagcuagcacucuacggaaaaaucaacgacaauaacagcuggaucaucgacaacggcauuuaccacauagcgccccucggcaaacugcacuccaacaacaaaaucgguauagagacacucacagaggugaugaaaguuuacccauaccuaagcaugcaacaccuucaauccgccgaccaaaucaaacgccacuacgacuccaaagacgcggaaggcaacaaaauaccccucgacaaauuuaaaaaggagggcaaagaaaaauacugcccaaagaccuacaccuucgaugacggcaaaguaauaaucaaagcaggagccagagucgaggaggagaaggucaaaaggcuauacugggcaucuaaggaagugaacagccaauucuuucggguauacggaaucgacaagccccuagaagaagguaaccccgacgacauccuuacaaugguaauauacaacagcccggaagaguacaaacucaacaguguucuauacggauacgauacgaacaacggaggcauguacaucgaaccggagggcaccuucuucaccuacgagcgagaggcccaagaaagcacauacaccuuagaagaacuguuccgacacgaauacacccauuaccuccaaggcagauacgcuguccccggccaauggggacgcacuaaacuauacgauaacgaccgccuaacaugguacgaagaggguggcgccgaacucuucgccggcucaacgagaacgagcggaauccugccgcgcaaaagcaucgucagcaacauacacaacacaacgcgaaacaaucguuacaaacucucggacacgguccacucaaaauacggcgcgucauucgaguucuacaacuacgccugcauguucauggauuacauguacaauaaggacaugggcauccuaaacaaacucaacgaccucgcuaaaaacaacgacgucgacggcuacgacaacuauauccgagaccuaagcucgaacuacgcacucaaugacaaauaccaagaccacaugcaagagcgcaucgacaacuacgaaaaccuaacaguacccuucguugcggacgacuaucucgucaggcacgcauacaagaacccaaacgagauauacagcgaaaucagcgagguagccaaacuuaaggacgccaaauccgaagucaagaaaucgcaguacuucucaaccuucacgcuacguggcagcuacaccgggggagcaagcaaaggaaaacucgaggaccaaaaagcaaugaacaaguuuauugacgacagccuaaagaaacuagauacauauuccugguccggcuacaaaacgcuaacggcauacuucacgaacuacaagguugacucaaguaaccgcguaacauacgacguaguuuuccacggauaccuaccaaaugaaggcgacuccaaaaacucgcugccauacggaaaaaucaauggcacauacaaagggacagagaaggagaaaaucaaauucaguucagaaggauccuucgacccagacggcaaaaucguuucauaugaaugggauuucggagacgggaacaaaucaaacgaagaaaacccugagcacagcuacgacaaagucggcacauauacaguaaagcucaaagucacggacgacaagggcgagagcagcguaagcacgaccaccgcagaaaucaaggaccucuccgaaaauaaacucccagucauauacaugcacguaccaaaaucgggcgcccucaaccagaaaguaguguucuacggaaaaggcacauacgauccggacggauccauagcaggcuaccaaugggauuucggagaugggagcgacuucucgagcgaacaaaacccgucacacgucuacacuaaaaagggcgaguacaccguaacccuucggguaauggacuccuccggacaaaugucugagaaaaccaugaaaaucaagauaaccgacccaguauaccccaucggcaccgaaaaagaaccaaacaacuccaaagaaacugccuccggccccaucguaccgggaaucccagucuccggcaccaucgaaaacaccagcgaccaagauuacuucuacuucgacguaaucacccccggagaagucaaaaucgacaucaacaaacugggcuacggaggagcuaccuggguagucuacgacgaaaacaacaacgccgucaguuacgccaccgacgacgggcaaaaccuguccgguaaauuuaaggccgacaagccagggcgauacuacauccaccuguauauguuuaacggauccuauaugcccuaccgaauaaauaucgaaggaaguguaggccgcuaa

SEQ ID NO: 1002 - RNA, 576 nt, Artificial Sequence
  derived and/or modified CDS sequence (opt9) from Homo sapiens__NP_001133.1__HsAMELX
augggaacauggauacucuucgcaugccuccucggcgcagccuucgccaugccccucccuccccaccccggccaccccggcuacaucaacuucuccuacgaaguccucacaccccucaaaugguaucaauccaucagaccacccuaccccuccuacggcuacgaacccaugggcggcuggcuccaccaccaaaucauccccguccucucacaacaacacccucccacccacacccuccaaccccaccaccacauccccguaguccccgcccaacaacccgucaucccccaacaacccaugaugcccguccccggccaacacucaaugacccccauccaacaccaccaacccaaccucccaccacccgcccaacaacccuaccaaccccaacccguccaaccccaaccccaccaacccaugcaaccccaaccacccguacaccccaugcaaccccucccaccccaaccaccccuaccucccauguuccccaugcaaccccucccacccaugcuccccgaccucacccucgaagccuggcccuccaccgacaaaaccaaacgcgaagaaguagacuaa

SEQ ID NO: 1003 - RNA, 135 nt, Artificial Sequence
  derived and/or modified CDS sequence (opt9) from Homo sapiens__NP_001133.1__HsAMELX-TRAP
augccccuacccccccacccaggccaccccggcuacauaaacuucuccuacgaaguacucacaccccuaaaaugguaccaauccauccgaccccccuaccccucauacggcuacgaacccaugggcggcugguaa

SEQ ID NO: 1004 - RNA, 168 nt, Artificial Sequence
  derived and/or modified CDS sequence (opt9) from Homo sapiens__NP_001133.1__HsAMELX-LRAP
augccccuccccccccaccccggccaccccggcuacauaaacuucucauacgaaguccucaccccccuaaaaugguaccaauccauccgccccccccccaugcuccccgaccucacacucgaagccuggcccucaaccgacaaaacaaaacgcgaagaagucgacuaa

SEQ ID NO: 1005 - RNA, 207 nt, Artificial Sequence
  derived and/or modified CDS sequence (opt9) from Homo sapiens__NP_001133.1__HLA-A2-SP_HsAMELX(17-60)
auggccguaauggccccccgaacccucguccuccuacucucaggagcccucgcccucacccaaaccugggccaugccccucccaccccacccaggccaccccggauacaucaacuucuccuacgaaguacucaccccccuaaaaugguaccaauccauccgcccccccuaccccucauacggcuacgaacccaugggcggaugguaa

SEQ ID NO: 1006 - RNA, 240 nt, Artificial Sequence
  derived and/or modified CDS sequence (opt9) from Homo sapiens__NP_001133.1__HLA-A2-SP_HsAMELX(17-47,168-191)
auggccguaauggcaccccgcacccucguccuacuccuauccggcgcccucgcccucacacaaaccugggccaugccccucccaccccaccccggccaccccggcuacauaaacuucuccuacgaaguccucaccccacucaaaugguaccaauccauccgcccaccacccaugcuacccgaccucacacucgaagccuggcccuccaccgacaaaacaaaacgcgaagaagucgacuaa

SEQ ID NO: 1007 - RNA, 579 nt, Artificial Sequence
  derived and/or modified CDS sequence (opt9) from Homo sapiens__NP_001134.1__HsAMELY
augggcaccuggauccucuucgccugccuagucggcgccgccuucgccaugccccucccaccccaccccggccaccccggcuacaucaacuucuccuacgaaguccuaacaccccuaaaaugguaccaauccaugauccgcccacccuacuccuccuacggcuacgaacccaugggcggauggcuccaccaccaaaucauccccgucgucucccaacaacacccccucacccacacccuccaaucacaccaccacauccccguaguccccgcccaacaaccccgcguacgacaacaagcccucaugcccguccccggccaacaauccaugacccccacccaacaccaccaacccaaccucccacuccccgcacaacaacccuuccaaccccaacccguccaaccccaaccccaccaaccaaugcaaccccaaccacccguccaacccaugcaaccccucuuaccccaaccaccccuaccacccauguucccccuccgcccccuaccacccauccuccccgaccuccaccucgaagccuggcccgccaccgacaaaacaaaacaagaagaagucgacuaa

SEQ ID NO: 1008 - RNA, 138 nt, Artificial Sequence
  derived and/or modified CDS sequence (opt9) from Homo sapiens__NP_001134.1__HsAMELY-TRAP
augccccuaccaccccacccaggccaccccggcuacaucaacuucucauacgaaguccucaccccccuaaaaugguaccaaucaaugauccgccccccauacucauccuacggcuacgaacccaugggcggcugguaa

SEQ ID NO: 1009 - RNA, 171 nt, Artificial Sequence
  derived and/or modified CDS sequence (opt9) from Homo sapiens__NP_001134.1__HsAMELY-LRAP
augccccuccccccccacccaggccaccccggcuacaucaacuucuccuacgaaguacucaccccccuaaaaugguaccaauccaugauccgccccccccccauacuccccgaccuccaccucgaagccuggcccgccacagacaaaaccaaacaagaagaaguagacuaa

SEQ ID NO: 1010 - RNA, 210 nt, Artificial Sequence
  derived and/or modified CDS sequence (opt9) from Homo sapiens__NP_001134.1__HLA-A2-SP_HsAMELY(17-61)
auggcagucauggcaccccgcacccucguccuccuccucuccggcgcccucgcccuaacccaaaccugggcaaugccacuacccccacaccccggccaccccggcuacaucaacuucucauacgaaguccuaacaccccucaaaugguaccaaucaaugauccgcccacccuacuccuccuacggcuacgaacccaugggcggcugguaa

SEQ ID NO: 1011 - RNA, 243 nt, Artificial Sequence
  derived and/or modified CDS sequence (opt9) from Homo sapiens__NP_001134.1__HLA-A2-SP_HsAMELY(17-48,169-192)
auggccgucauggcaccccgaacacucguccuccuccucuccggcgcccucgcccucacacaaacaugggccaugccccucccaccccaccccggccaccccggcuacaucaacuucuccuacgaaguccucacaccccuaaaaugguaccaauccaugauccgcccacccccaauacuccccgaccuacaccucgaagccuggcccgccaccgacaaaaccaaacaagaagaagucgacuaa

SEQ ID NO: 1012 - RNA, 570 nt, Artificial Sequence
  derived and/or modified CDS sequence (opt9) from Sus scrofa__NP_999071.1__SsAMELX-001-1
augggcaccuggauacucuucgccugccuccucggcgccgccuucuccaugccccuaccaccccaccccggacaccccggcuacaucaacuucuccuacgaaguccuaacaccccucaaaugguaccaaaauaugauacgccaccccuacacauccuacggcuacgaacccaugggcggauggcuccaccaccaaaucauccccgucgucucacaacaaaccccacaaucccacgcccuccaaccccaccaccacauccccaugguccccgcccaacaacccggcaucccccaacaacccaugaugccccuccccggccaacacuccaugacccccacccaacaccaccaacccaaccuaccccuacccgcccaacaacccuuccaaccccaacccguacaaccccaaccccaccaaccccuucaaccccaaucucccaugcaccccauccaaccccuccucccccaaccaccccuuccacccauguucucaaugcaaucacuccuccccgaccucccccucgaagccuggcccgccaccgacaaaaccaaacgagaagaagucgacuaa

SEQ ID NO: 1013 - RNA, 138 nt, Artificial Sequence
  derived and/or modified CDS sequence (opt9) from Sus scrofa__NP_999071.1__SsAMELX-TRAP
augccccuaccaccccaccccggccaccccggcuacaucaacuucuccuacgaaguccuaacaccccuaaaaugguaccaaaacaugauccgccacccauacaccucauacggcuacgaaccaaugggcggcugguaa

SEQ ID NO: 1014 - RNA, 171 nt, Artificial Sequence
  derived and/or modified CDS sequence (opt9) from Sus scrofa__NP_999071.1__SsAMELX-LRAP
augccccucccaccccaccccggccaccccggcuacaucaacuucuccuacgaaguccuaacaccccucaaaugguaccaaaacaugauccgacaccccucccuacuccccgaccucccccuagaagcauggcccgccaccgacaaaaccaaacgcgaagaagucgacuaa

SEQ ID NO: 1015 - RNA, 210 nt, Artificial Sequence
  derived and/or modified CDS sequence (opt9) from Sus scrofa__NP_999071.1__HLA-A2-SP_SsAMEL(17-61)
auggccgucauggcaccccgcacccuaguccuccuccucucaggcgcccucgcacucacccaaacaugggccaugccccuacccccacaccccggccacccaggcuacaucaacuucucauacgaaguccucaccccacuaaaaugguaccaaaacaugauacgccaccccuacaccucauacggauacgaacccaugggcggcugguaa

SEQ ID NO: 1016 - RNA, 243 nt, Artificial Sequence
  derived and/or modified CDS sequence (opt9) from Sus scrofa__NP_999071.1__HLA-A2-SP_SsAMEL(17-49,167-189)
auggccgucauggcaccccgcacucucguccuccuacucuccggcgcccuagcccucacccaaaccugggccaugccccuacccccacaccccggccaccccggcuacaucaacuucucauacgaaguccucaccccacuaaaaugguaccaaaacaugauccgccaucccucacuccuccccgaccucccccuagaagccuggcccgccacagacaaaaccaaacgcgaagaagucgacuaa

SEQ ID NO: 1017 - RNA, 534 nt, Artificial Sequence
  derived and/or modified CDS sequence (opt9) from Sus scrofa__P45561-2__SsAMELX-001-2
augggcaccuggauacucuucgccugccuccucggcgcagccuucuccaugccccucccaccccaccccggccaccccggcuacaucaacuucucuuacauccgccaccccuacaccuccuacggcuacgaacccaugggcggcuggcuacaccaccaaaucauccccgucguaucccaacaaaccccacaaucacacgcucuccaaccccaccaccacauccccaugguccccgcccaacaacccggcaucccccaacaacccaugaugccccuccccggccaacacuccaugacccccacccaacaccaccaacccaaccucccccucccagcccaacaacccuuccaaccccaacccguccaaccccaaccacaccaaccacuacaaccacaaucccccaugcaccccauccaaccacuccucccccaaccaccccucccacccauguucucaaugcaaucccuccuacccgaccuuccccuugaagccuggcccgccaccgacaaaaccaaacgagaagaagucgacuaa

SEQ ID NO: 1018 - RNA, 570 nt, Artificial Sequence
  derived and/or modified CDS sequence (opt9) from Sus scrofa__NP_998965.1__SsAMELX-001-3
augggcaccuggaucuucuucgcaugccuccuaggcgccucccucgccaugccccucccaccccaccccggacaccccggcuacaucaacuucuccuacgaaguccucaccccacuaaaaugguaccaaaacaugauccgccaccccuacaccuccuacggauacgaacccaugggaggcuggcuccaccaccaaaucauccccgucgucucacaacaaacaccccaaucccacgcacuccaaccccaccaccacauccccaugguccccgcccaacaacccggaaucccccaacaacccaugaugccccuccccggacaacacuccaugacccccacccaacaccaccaaccaaaccucccccuccccgcccaacaacccuuccaaccacaacccguccaaccccaaccccaccaaccacuccaaccccaaucccccaugcaccccauccaaccacuccucccccaaccaccccucccacccauguucucaaugcaaucccuccuucccgaccucccccucgaagccuggcccgccaccgacaaaaccaaacgcgaagaaguagauuaa

SEQ ID NO: 1019 - RNA, 219 nt, Artificial Sequence
  derived and/or modified CDS sequence (opt9) from Sus scrofa__K7GPB2__SsAMELX-002
augggcaccuggauacucuucgccugccuacucggcgccgcauucucaaugccccuccccccccaccccggccaccccggcuacauaaacuucuccuacgaaguccucaccccccucaaaugguaccaaaacaugauuagacacccaucccuccuccccgaccucccccucgaagcauggcccgcaaccgacaaaaccaaacgcgaagaagucgacuaa

SEQ ID NO: 1020 - RNA, 612 nt, Artificial Sequence
  derived and/or modified CDS sequence (opt9) from Sus scrofa__K7GLD0__SsAMELX-003
augggcacauggauccucuucgccugccuacucggagccgcuuuuuccaugccccucccuccccaccccggccaccccggcuacauaaacuucuccuacgaagaccucuaccucgaagccauccgcaucgaccgcaccgccuucguccucacaccccuuaaaugguaccaaaacaugauccgccaccccuacaccuccuacggcuacgaacccaugggcgguuggcuccaccaccaaaucauccccguagucucacaacaaaccccacaaucccacgcccuccaaccccaccaccacauaccaaugguccccgcccaacaaccaggcaucccccaacaacccaugaugccccuccccggccaacacuccaugaccccaacccaacaccaccaacccaaccucccccuccccgcccaacaacccuuccaaccccaacccguccaaccccaaccccaccaaccccuccaaccccaaucccccaugcaccccauccaaccucuccucccccaacccccacucccaccaauguucucaaugcaaucacuccuccccgacuuaccccuagaagccuggcccgccaccgacaaaaccaaacgagaagaaguagacuaa

SEQ ID NO: 1021 - RNA, 498 nt, Artificial Sequence
  derived and/or modified CDS sequence (opt9) from Sus scrofa__K7GPE9__SsAMELX-004
augggcaccuggauccucuucgccugccuccucggcgccgccuucuccaugccccucccaccccaccccggccaccccggcuacaucaacuucucauaugaaguccucacaccccucaaaugguaccaaaacaugauccgccaccccacaccccaaucccacgcccuccaaccacaccaccacauccccaugguccccgcccaacaaccaggcaucccacaacaacccaugaugccccuaccaggccaacacuccaugacccccacccaacaccaccaacccaaccuaccccuccccgcacaacaacccuuccaaccacaacccguccaaccccaaccccaccaaccccuacaaccccaaucccccaugcacccaauccaaccccuccucccccaaccaccccucccacccauguucuccaugcaaucacuccuccccgaccucccccuagaagccuggcccgcaaccgacaaaaccaaacgcgaagaagucgacuaa

SEQ ID NO: 1022 - RNA, 522 nt, Artificial Sequence
  derived and/or modified CDS sequence (opt9) from Sus scrofa__J9JIM4__SsAMELX-201
augccccucccaccccaccccggccaccccggcuacaucaacuucuccuacgaaguacucaccccucucaaaugguaccaaaacaugauccgacaccccuacaccuccuacggcuacgaacccaugggcggcuggcuccaccaccaaaucauccccgucgucucccaacaaacaccccaaucccacgcacuacaaccccaccaccacauccccaugguccccgcccaacaacccggcaucccccaacaacccaugaugccacuccccggccaacacuccaugacccccacccaacaccaccaacccaaccucccccuacccgcccaacaacccuuccaaccccaacccguccaaccacaaccucaccaaccacuccaaccccaaucacccaugcaccccauccaaccacuccuaccccaacccccacucccacccauguucuccaugcaaucacuccuccccgaccucccccuagaagccuggcccgccaccgacaaaaccaaacgcgaagaagucgacuaa

SEQ ID NO: 1023 - RNA, 2961 nt, Artificial Sequence
  derived and/or modified CDS sequence (opt9) from Homo sapiens__NP_006120.1__HsBMP1
augccaggagucgcccggcuaccccuacuccuaggacuccuccuacuaccacgcccuggacgaccccuagaccuggccgacuacacguacgaccuagccgaagaagacgacuccgaaccccucaacuacaaagaccccugcaaggccgccgccuuccuaggcgacauagcccuagacgaagaagaccuccgagccuuccaaguccaacaagcggucgaccugcgccgacacacggccaggaaaucauccauaaaagccgcuguaccgggaaacacaucaacccccucaugccaaucgacaaacggacaaccacaaaggggcgcaugcggaagauggcgcgggcgaucacgcucacgccgcgcagccacaagccgcccggagcgaguguggcccgacgggguaauacccuucgucauagggggaaacuucacuggaucacaacgggcagucuuuagacaagcaaugagacacugggaaaagcauaccugcgucacauuccuagaacggaccgacgaagauucauacaucguauucaccuaccgcccaugcggauguugcucauacguaggccgaagaggcggcggcccccaagcgauaucgauaggcaagaacugcgacaaauucgggauaguuguacacgaacuaggacacgucguaggcuucuggcacgaacacaccagacccgaccgggaccggcacguauccauaguccgcgaaaacauccaacccggacaagaauacaacuuccuaaaaauggaaccacaagaagucgaaucgcuaggcgaaaccuaugacuucgauuccaucaugcacuaugcucgcaacaccuucucacgaggcaucuuccucgacaccaucguccccaaauacgaaguuaacggagucaaaccacccauaggacaacgcacgcgacucucaaaaggcgauaucgcucaagcacgcaaacucuacaagugucccgccugcggcgaaacgcuccaggacucgacaggcaacuucucaucccccgaauacccgaacggauacagcgcacacaugcacugugucuggcgaaucucaguaacaccaggcgagaaaaucauccuuaacuucacaucccucgaccuguacagaucccgccucugcugguacgauuacgucgaagucagagacggguucuggcgaaaagcaccgcuccgaggccgauucuguggauccaaacugccagaacccauagucuccacagacucucgacucuggguugaguucagaagcucuaguaacugggucggcaaaggcuucuucgccgucuacgaagcaaucugcggaggagacguaaagaaagauuacggccacauacagucccccaacuaccccgacgacuaccggcccaguaaaguauguaucuggagaauccagguaagcgaaggcuuccauguugggcucaccuuucagagcuucgaaauagaacgccacgacucaugcgcuuaugacuaucucgaaguacgcgacggccacuccgaaucaagcacacucauaggcagauacugcggauacgaaaaacccgaugacaucaaauccacguccagccgccuauggcucaaauucgucucagauggaagcauaaacaaagccggauuugcuguuaacuucuucaaggaaguagacgagugcucccgacccaaccgcggcgggugcgaacaacgcugccucaacacacucgguuccuacaaaugcagcugcgacccaggcuacgaacuagccccugauaagcgucgcugcgaagcagccugcgguggguuccucacaaaacuaaacggauccauaacaagcccuggcuggccaaaagaauaucccccuaacaagaacugcaucuggcaacugguggcgcccacacaauaccgaauaagccuacaauuugacuucuucgagacagaaggaaaugacgugugcaaguacgacuucguagaaguccgcuccggguuaaccgccgacuccaagcugcaugggaaauucugcggauccgaaaaaccagaagugauuacgagccaauacaacaacaugcgagucgaguucaagucagacaacacagucuccaagaaaggcuuuaaagcucacuucuucucagacaaagacgagugcucaaaagacaauggagggugucaacaagacugcguuaacacauucggguccuacgaaugccaaugccgcucuggguucguacuucacgauaacaagcacgacugcaaagaagccggaugcgaccacaaggugacaagcaccuccggcaccauaacgucccccaacuggccagauaaauaccccucaaagaaagaaugcacgugggccaucaguagcacucccggccacagagucaaacucacauucauggaaauggacaucgaaagccagccggagugcgcguacgaccaccucgaaguguucgacggacgcgacgcgaaggcuccagugcucggccgauucugcggauccaagaagccagaaccagucuuagcaacuggaagccgaauguuccuacgauucuacuccgacaauuccguucaacgaaaaggcuuccaagccucccacgccaccgaaugcggcggacaaguccgagcggacguaaaaaccaaagaccucuacagccacgcgcaauucggggacaacaacuacccagguggcguagacugcgaauggguaauagucgcagaagaaggcuacggagucgagcuaguauuccagaccuucgaaguugaagaagaaacagacugcggcuacgacuacauggaacuauucgacgguuacgacuccaccgcaccccggcucggacgguacugcggcuccggcccaccagaagaaguauacucagcaggagacagcguccucgucaaauuccacuccgaugauaccauaacaaagaaaggguuucaccuacgcuacacgagcaccaaauuccaagacacucuacacagccgcaaauaa

SEQ ID NO: 1024 - RNA, 1191 nt, Artificial Sequence
  derived and/or modified CDS sequence (opt9) from Homo sapiens__NP_001191.1__HsBMP2
augguagccggcacccgaugccuacucgcccuccuucucccccaaguccuccuaggcggcgccgccggccuggucccagaacuaggccgccgcaaauucgcagccgcauccuccggacgcccaucaucacagcccuccgacgaaguccucuccgaguucgaacucagacuacuaucgauguucggccuuaaacaacgccccaccccaucccgugacgccguagucccaccauacaugcucgaccuauaccgccgccacuccgggcaacccggaucaccagcacccgaccaccgccucgaacgcgccgcaucccgcgccaacacaguccgcuccuuccaccacgaagaaucccucgaagaacuccccgaaacaucaggcaaaacaacccgccgauucuucuucaaccucuccuccauacccacagaagaguucaucaccuccgcagaauuacaagucuuccgcgaacaaaugcaagacgcacucggcaacaacuccuccuuccaccacagaaucaacaucuacgaaaucaucaaacccgcaaccgccaacagcaaauucccaguaacccgacuccuugacacacgacucgucaaccaaaacgccuccagaugggaaucauucgacgucacaccagcagucaugcgcuggaccgcccaaggccacgcaaaccauggauucgugguagaagucgcccaccuagaagaaaaacaaggagucuccaaacgccacguccgcaucucacgcucccuccaccaagacgaacacucauggucacaaauccgaccccuccuaguaacauucggacacgacggcaaaggccacccccuacauaaacgcgaaaaacgacaagccaaacauaagcaacgaaaacgccucaaaucaagcuguaaacgucauccacucuacgucgacuucucugacgucggcuggaacgacuggaucguagcaccacccggcuaccacgccuuuuacugccacggagaaugccccuucccccucgccgaccaccuaaauuccaccaaccacgcaauaguccaaacccuaguuaacuccgucaacuccaaaaucccaaaagcaugcugcguucccacagaacucucagcaaucuccaugcucuaccuugacgaaaacgaaaaagucguccugaaaaacuaccaagacauggucgucgaaggcugcggcugccgauaa

SEQ ID NO: 1025 - RNA, 1227 nt, Artificial Sequence
  derived and/or modified CDS sequence (opt9) from Homo sapiens__NP_001193.2__HsBMP4
augauacccggcaaccguaugcucauggucguccuccucugccaaguacuccucggcggagccucacacgcaucucucauacccgaaacuggcaaaaaaaaagucgccgaaauccaaggccacgcaggaggacgccgcucaggucaaucccacgaacuccuacgcgacuucgaagccacccuacuacaaauguucggccuccgacgccgaccccagcccuccaaauccgccgucauacccgacuacaugcgcgaccucuaccgacuucaauccggcgaagaagaagaagaacaaauacacagcaccggccucgaauaccccgaacguccagccucccgcgccaacaccguccgcucuuuccaccacgaagaacaccucgaaaacauccccggcacauccgaaaacuccgccuuccgauuccucuucaaccuauccucaauccccgaaaacgaagucauauccuccgccgaacuccgucucuuccgcgaacaaguagaccaaggccccgauugggaacgcggcuuccaccgcaucaauaucuacgaagucaugaaaccaccagccgaagucguacccggacaccucaucacacgcuuacuagacacccgccucguccaccacaacguaacacgcugggaaaccuucgacgucuccccagcuguucuccgauggacacgcgaaaaacaacccaacuacggccucgccaucgaagucacccaccuccaccaaacccgaacccaccaaggccaacacgucagaaucucccgcucucucccccaaggcucaggcaacugggcccaacuacgcccccuacuugucaccuucggccacgacggacgaggccacgcacuaacgcgacgccgccgcgccaaacgcucacccaaacaccacucucagcgcgccagaaaaaaaaacaaaaauugccgccgacacucacuguacgucgacuucagcgacgucggcuggaaugacuggaucgucgccccccccggcuaccaagcauucuacugccacggcgacugcccauucccacuagcugaccaccucaacucgaccaaccacgcaauuguacaaacccucgucaauuccgucaacagcuccaucccaaaagcaugcugcgugcccaccgaacucuccgcuaucuccaugcucuaccucgacgaauacgacaaagucguacucaaaaacuaccaagaaauggucgucgaaggaugcggcugccgcuaa

SEQ ID NO: 1026 - RNA, 1542 nt, Artificial Sequence
  derived and/or modified CDS sequence (opt9) from Homo sapiens__NP_001709.1__HsBMP6
augcccggucuaggccgccgcgcacaguggcucugcuggugguggggacuacucugcuccugcugcggcccuccccccuuacguccacccuuaccagcagccgccgccgcggcagcaggaggccaacuacucggcgacgguggcucccccggacgaacggaacaacccccccccucaccccaauccucaagcggcuuccucuaccgccgccucaaaacccaagaaaaacgagaaaugcaaaaagaaauacuauccguccuaggccuuccacaccggccccgcccacuccacggccugcaacaaccccagccacccgcccuccgccaacaagaagaacaacaacaacaacaacaacucccccggggugaacccccuccaggccgccuaaaaucugccccucucuucaugcucgaccucuacaaugcccuauccgccgauaacgacgaagauggagcgucagaaggagaacgccaacaaucauggccccacgaagccgccuccucaucccaacgccgacaacccccgcccggcgccgcccacccccuaaaccguaaaucccugcucgcccccggcucaggcagcgguggugcauccccacucaccucggcccaagacuccgcauuccuaaacgacgcagacauggucaugagcuucgucaaccuagucgaauacgacaaagaauucuccccacgccaacgacaccauaaagaauucaaauucaaccucucacagauacccgaaggagaagucgucaccgccgcagaauuccgaaucuacaaagacugcguaauggguagcuucaaaaaccaaacauuccuaaucucuauauaccaaguacuccaagaacaccaacaccgugacagugaccuauuccuccucgacacccgagucguuugggccucagaagaaggcuggcucgaauucgacaucacagcaaccagcaaccuauggguaguaacaccgcaacacaacaugggccuacaacuauccguagucacccgagacggaguacacguucacccgcgcgcagccggccucguaggacgcgacggccccuacgacaaacagcccuucauggucgccuucuucaaagucuccgaaguacacguccgcaccacccgcuccgccuccucucgacgccgccaacaaucccgaaaccgauccacccaaucccaagacgucgcccgcguuuccucugccucagacuacaauuccucagaacucaaaaccgccugccgaaaacacgaacuauauguaucauuccaagaccuuggcuggcaagacuggaucaucgcccccaaaggcuacgcagccaacuacugcgacggcgaaugcuccuucccacuaaacgcccacaugaacgccaccaaccacgccaucguccaaacacucgugcaccuuaugaaccccgaauacguacccaaaccaugcugcgcccccaccaaacuaaacgccaucuccguacucuacuucgaugacaacuccaacgucauacuaaaaaaauaccguaacaugguaguacgcgccugcgguugccacuga

SEQ ID NO: 1027 - RNA, 1296 nt, Artificial Sequence
  derived and/or modified CDS sequence (opt9) from Homo sapiens__NP_001710.1__HsBMP7
augcacgugcguucacuacgagcagccgccccacacucauucgucgcccucugggcuccccuuuuucuccuacgcucugcccucgccgacuucucccuagacaacgaaguacacagcucauucauccaccgccgucuccgcucucaagaaagacgcgaaaugcaacgugaaauccucuccauccucggccucccccaccgaccccgcccccaccuacaaggcaaacacaacuccgcccccauguucaugcucgaccucuacaacgccauggccguagaagaaggaggaggacccgguggccaaggcuucuccuaccccuacaaagccgucuuuuccacccaaggucccccgcucgcaucacuccaagacucccacuuccucaccgacgccgacauggucaugucauucgucaaccuugucgaacacgacaaagaguucuuccacccccgcuaccaccaucgcgaguuccgcuucgaccucagcaaaauucccgaaggcgaagccgucaccgccgccgaguuccgaaucuacaaagacuacauccgugaacgcuucgacaacgaaacuuuccgcaucucagucuaccaaguccuccaagaacaccuaggccgcgaaucagaccucuuucuccucgacucacgaacccucugggccucagaagaaggauggcucgucuucgacaucacagccacauccaaccacugggucgucaacccucgccacaaccuuggacuccaacuguccgucgaaacccucgacggccaauccauaaaccccaaacucgccggccucauaggccgacacggaccccaaaacaaacaaccauucauggucgcauuuuucaaagcaaccgaaguccacuuuagauccauccguuccaccggaucaaaacaacgcucccaaaaccgcuccaaaacccccaaaaaccaagaagcccuccgcauggccaacguagcagaaaacuccuccagcgaccaacgccaagccugcaaaaagcacgaacucuacguaucauuucgagaccucggcuggcaagacuggauaaucgccccagaaggcuacgccgcauacuacugcgaaggagaaugcgccuucccccuaaauuccuacaugaacgccaccaaccacgccaucguccaaacccucguccacuucaucaaccccgaaacugucccaaaacccugcugcgcccccacacaacuaaacgccaucucaguccucuacuuugacgacucaucuaacguaauccuaaagaaauaucgcaacaugguaguccgcgccugcgguugccacuag

SEQ ID NO: 1028 - RNA, 300 nt, Artificial Sequence
  derived and/or modified CDS sequence (opt9) from Homo sapiens__NP_006264.2__HsCCL7
augaaagccuccgccgcccuccuaugccuccuccucaccgccgccgcauucuccccccaaggccucgcccaaccagucggcauaaacaccuccaccaccugcugcuaccgauucaucaacaaaaaaaucccaaaacaacgacucgaauccuaccgccgcaccaccuccucccacugcccccgagaagccgucaucuucaaaaccaaacucgacaaagaaaucugcgccgacccaacccaaaaauggguccaagacuucaugaaacaccuagacaaaaaaacccaaaccccaaaacucuaa

SEQ ID NO: 1029 - RNA, 3624 nt, Artificial Sequence
  derived and/or modified CDS sequence (opt9) from Homo sapiens__NP_001954.2__HsEGF
augcucuuaacccuuaucauacuucuucccgucgucagcaaguucagcuuugucucacucagugcaccccaacacuggagcugccccgaaggaacacuugccggcaacggcaauagcacaugcguugggccggcucccuuccuaauauucagccacggaaacagcauauuccgaaucgacacagagggaaccaacuacgaacagcugguagucgacgcuggcguaagcgucaucauggacuuccacuacaacgagaagcgaaucuacuggguagaucucgaacgccaacuacugcaacggguauucuugaacggcucgcgacaggagcgcgucugcaauaucgaaaagaacgucucaggaauggcuaucaacuggauuaaugaagaggugauauggagcaaccaacaggagggaaucauaaccgucacagacaugaaggguaacaacucccacauccuucucagcgcgcucaaauacccugcaaaugucgccguggauccugucgaacguuuuauauucuggucaagugaaguagccggcucccucuacagagccgaccucgacgguguaggggucaaggcacuacucgaaacguccgagaaaauaacagcaguaucgcuggacguacucgacaaacgccuauucuggauucaguacaaccgagaaggcagcaacuccuuaaucugcaguugcgacuacgacggagguagcgugcauauaaguaaacacccaacgcagcacaaccuauuugccaugucacuguucggggaccgcaucuucuacagcaccuggaaaaugaaaacaauauggaucgcaaacaaacacaccggcaaggauaugguccgcaucaaccuacacucuucauucguaccccuaggggagcucaaaguagugcacccucucgcccaaccaaaagcagaggaugauaccugggaacccgaacaaaagcugugcaaacuccgaaagggcaacugcucgagcaccgucugcggacaagaccugcaaagccaccucugcaugugugcggaaggauacgcacucucacgagaccggaaguacugcgaggacgucaacgaaugcgccuucuggaaccacggaugcacucuuggauguaagaacaccccaggauccuauuacuguaccugcccagucggauucguacuacuaccagacggaaaacgaugccaccaacugguauccugcccccgaaacguauccgaaugcucccacgauugcguccuaaccucagaggggccccucugcuucugcccagagggauccguguuagaacgcgacggcaagacuugcagcggcugcagcagcccagacaacggcgggugcagccaacuaugcguaccacuaucaccaguuucaugggaaugcgacugcuucccggguuacgaccuccagcucgacgaaaaaucaugugcggccagcggaccacagcccuuccuccuauucgccaauucacaagacauccggcacaugcacuucgacggcaccgacuacgguacccuacugagccaacaaauggguaugguguacgcgcucgaccacgacccaguagaaaacaaaauauacuucgcccacacagcccucaaguggaucgaacgagccaacauggauggaucacaacgcgagcggcuaauagaggaagguguggacgugccagaaggccuggccguagacuggauaggccgcagauucuauuggacagacagagguaaaucacucaucggacgaucagaccucaacggcaaaagguccaaaaucaucacuaaagagaacauaucacaaccacgcggcauagccguccaccccauggccaaacgccucuucuggaccgacacgggcaucaacccaagaauagaguccagcagccuccagggccuaggaagacuuguaaucgcaucguccgaucucauuuggcccagcgggaucacaaucgauuuccuaacugacaaacucuacuggugcgacgccaaacaaaguguaaucgaaauggcaaaccucgacggaucgaaacgacggcgccucacccaaaacgauguuggccaucccuucgcaguagcagucuuugaggacuacgucugguucagcgacugggccaugcccuccguaaugcggguuaacaaacgcaccggcaaagaccgaguccgacuacaggguuccaugcuuaaaccgagcucccuaguuguaguacacccacuagcaaaacccggggccgaccccugcuuauaucaaaacggaggaugcgaacacaucugcaagaaacgccucggcaccgcaugguguagcugccgagaaggauuuaugaaagccuccgacggcaaaaccugucuggcccuagauggccaccaacuccuugcgggcggcgaaguagaccuuaaaaaccaagugaccccgcuagacauacucucaaaaacgcgcgucucagaagacaacaucacagaaagccaacacaugcucguagcagaaaucaugguaagcgaccaagacgacugcgcacccguaggaugcagcauguaugcacggugcauaagcgaaggagaagacgcgaccugccaaugccuaaaaggauucgccggagacgguaagcucugcucagauauugacgaaugcgaaaugggaguacccguguguccacccgccagcucaaagugcaucaacacugaaggaggcuacgucugcagaugcagcgagggcuaucaaggcgacggcauccauugccuagauauagacgagugccagcuaggcgagcacucgugcggcgagaacgcgucgugcacaaacacggaagguggcuauacaugcaugugcgccggaagacucagcgaaccgggucuaauuugccccgacagcaccccaccuccacaccuucgcgaagacgaccaccacuacuccguccgcaacucggacucagaaugcccccucagucaugauggcuacugcuugcaugacggcguuuguauguauaucgaagcccuagacaaguacgcaugcaacugcgucguagguuacaucggagagcgcugccaauaucgcgaccuaaaauggugggaacucagacacgcaggucacggucagcaacaaaagguuaucgucguagccguuugugucgugguccuagucaugcuccuucuccuaucgcucuggggcgcccacuacuacagaacccaaaaacuccuauccaaaaacccgaaaaaucccuacgaagaaucgaguagggacguacguucgcgacgacccgcagacacggaagacggcaugaguucgugcccccaaccaugguucguaguuauuaaggaacaucaagauuugaaaaacggcggacagccagucgccggagaggacggccaagcagcagauggauccaugcaacccacaucauggagacaagaaccccaacuaugcggaaugggaacggaacaaggcugcuggauuccagucaguuccgacaaaggcucaugcccacaaguaauggaacgaucguuccacaugccauccuacggaacccaaacacucgaaggcgguguagaaaagccacacagccuccucucggcaaacccccuauggcagcagcgcgcacuagacccuccccaucaaauggagcugacccaauag

SEQ ID NO: 1030 - RNA, 510 nt, Artificial Sequence
  derived and/or modified CDS sequence (opt9) from Homo sapiens__NP_001423.1__HsEREG
augaccgccggcagacgcauggaaaugcuaugcgccggccgaguccccgcacuccuacucugccucggcuuccaccuccuacaagccguccuauccaccacagucaucccaucaugcaucccaggcgaaagcucugacaacugcaccgcccuaguccaaaccgaagacaacccccgcgucgcccaagucuccaucacaaaaugcucauccgacaugaacggcuacugccuacacggccaaugcaucuaccucgucgacaugucccaaaacuacugcagaugcgaagucggcuacaccggaguccgcugcgaacacuucuuccucacaguacaccaaccucucuccaaagaauacgucgcccucaccgucauacucauuauccucuuccucaucaccguagucggcuccacauacuacuucugccgcugguaccgcaaccgcaaauccaaagaacccaaaaaagaauacgaacgcgucaccuccggcgaccccgaacucccccaaguauaa

SEQ ID NO: 1031 - RNA, 468 nt, Artificial Sequence
  derived and/or modified CDS sequence (opt9) from Homo sapiens__NP_000791.1__HsFGF1
auggccgaaggcgaaaucacaaccuucaccgcccucaccgaaaaauucaaccucccccccggcaacuacaaaaaacccaaacuccuauacugcuccaacggcggacacuuccuccguauacuccccgacggcacagucgacggcacccgagaccgcucugaccaacacauccaacuccaacucucagccgaaucagucggcgaagucuacauaaaauccaccgaaacaggccaauaucucgcaauggacaccgacggccuucucuacggcucccaaacccccaacgaagaaugccucuuccucgaacgccuagaagaaaaccacuacaacacauacaucuccaaaaaacacgcagaaaaaaacugguucguaggccucaaaaaaaacggcuccugcaaacgcggcccccgcacccacuacggccaaaaagccauccucuuccucccccuacccgucucauccgacuaa

SEQ ID NO: 1032 - RNA, 867 nt, Artificial Sequence
  derived and/or modified CDS sequence (opt9) from Homo sapiens__NP_001997.5__HsFGF2
augguagggguaggaggaggggauguagaagaugugacgccaaggccaggagggugucaaauaagcggaagaggggcaagaggcuguaacgggauaccgggggcagcggcgugggaggcagcgcugccgagaagacgaccacgaaggcauccgagugugaacccgcggucaagagcggcagggagcccgagaacgagagggagaagaacagaggaaaggccaaguggaaguagauuaggggauaggggaagagggagggcgcuaccgggagggagauugggagggcgagggagagggagagcgccagagaggguaggagggcgggggcgggggagggggacagcggcgccgagagcggcaccagcagcgagagggagcaggccagggccggcggggacgauggcggcgggaagcauaacaacacugccggcguuaccggaggacggagggaguggggcguucccgccagggcacuuuaaagauccaaagagguuguauugcaaaaacggaggguucuuucugaggauacauccagaugggagaguagauggaguaagggagaaaucggacccacacauaaaacugcaauugcaagcagaagagagagggguagugagcauaaaaggggugugugcaaacagauaccuagcgaugaaggaagauggaagacuguuagcgucgaaauguguaacggacgagugcuuuuucuuugaaaggcucgagagcaauaacuauaacacauacaggagcaggaaguauacaucaugguauguagcacucaagagaacgggacaauacaagcuagggagcaagacggggccggggcaaaaggcaauacuauuucuaccgaugucggcaaagagcuag

SEQ ID NO: 1033 - RNA, 585 nt, Artificial Sequence
  derived and/or modified CDS sequence (opt9) from Homo sapiens__NP_002000.1__HsFGF7
augcacaaauggauccucaccuggauccuacccacccuccuguaccgcagcugcuuccacaucaucugccucgucggaaccauaucccucgccugcaacgacaugacccccgaacaaauggccacaaacguaaacugcagcucccccgaacgccacacccgcuccuacgacuacauggaaggcggagacauccgcguacgccgccuauucugcagaacccaaugguaccuacgcauagacaaaagaggcaaagucaaaggcacacaagaaaugaaaaacaacuacaacaucauggaaauccgcaccgucgcagucggaaucguagccaucaaaggagucgaaagcgaauucuaccuagccaugaacaaagaaggcaaacuauacgccaaaaaagaaugcaacgaagacugcaacuucaaagaacuaauccucgaaaaccacuacaacaccuacgccuccgccaaauggacccacaacggcggcgaaauguucguagcccucaaccaaaaaggaauacccguccgcggaaaaaaaaccaaaaaagaacaaaaaaccgcccacuuccuccccauggccaucaccuaa

SEQ ID NO: 1034 - RNA, 627 nt, Artificial Sequence
  derived and/or modified CDS sequence (opt9) from Homo sapiens__NP_001936.1__HsHBEGF
augaaacuccuccccuccgucguccucaaacucuuccuagccgcaguccucuccgcacucgucaccggcgaaucccucgaacgacuccgacgcggccuggccgcaggcaccuccaaccccgacccaccaaccgucucaacagaccaacuacuaccccucggcggaggccgcgacagaaaaguccgcgaccuucaagaagcagaccucgaccuccuccgagucacccucuccagcaaaccccaagcccucgccacacccaacaaagaagaacacggaaaacgcaagaaaaaaggcaaaggccucggcaaaaaacgcgaccccugccuacgcaaauacaaagacuucugcauccacggggaaugcaaauacgucaaagaacuacgcgcccccucaugcauaugccaccccggcuaccacggcgaacgcugccacggccucucccuccccguagaaaaccgacucuacaccuacgaccacaccaccauccucgccgucgucgccgucguccucuccuccguaugccuacucgucaucguaggccuccuaauguuccgcuaccaccgccgaggcggcuacgacgucgaaaacgaagaaaaagucaaacucggaaugaccaacucccacuaa

SEQ ID NO: 1035 - RNA, 2187 nt, Artificial Sequence
  derived and/or modified CDS sequence (opt9) from Homo sapiens__NP_000592.3__HsHGF
augugggucacgaaacuccucccagcacuacuacuacaacacguccuauuacaccuccuccuccuacccauagcaauacccuacgcggaagggcagcgaaaaagacgcaacacgauccacgaguucaagaaguccgcaaaaacaacccuaaucaaaauagaccccgcccucaaaaucaaaaccaagaaagucaauaccgcagaccaaugcgcaaaccgcugcacacgcaacaaaggccucccauuuaccugcaaagccuucguuuuugacaaagccagaaagcaaugccuuugguucccauucaacagcaugagcuccggcgucaagaaagaguucggacacgaguucgaccuguacgaaaacaaagacuacauccgaaacugcauaaucggcaaaggccgcagcuacaaaggaacagucuccauaaccaaaucaggcaucaaaugccagccuuggagcuccaugauaccccacgaacacucauuccucccgucaagcuaccgagggaaagaccuacaagaaaauuacugccgaaacccacgcggggaagaaggcggacccuggugcuucaccucaaacccagaaguccgcuacgaaguaugcgacaucccccaaugcucagaaguugaaugcaugaccugcaauggagaaagcuacagagggcucauggaccacaccgaaagcggcaaaauaugccaacgaugggaccaccaaacaccacaccgacacaaauuccuccccgaacgauacccggacaaaggguucgaugacaacuacugccguaaccccgacggccagccacgcccauggugcuacacacuagacccacacacucgcugggaauacugugcaaucaaaacaugcgccgacaauaccaugaacgacacagacgucccccuggaaacaaccgaaugcauccaaggccaaggugaaggcuaccgcggcacggucaauaccauauggaacggcauacccugccaacgaugggacagccaauacccgcacgaacacgacaugacaccagaaaacuucaaaugcaaagaccuucgggaaaacuacugccgaaaccccgacggauccgaaagccccuggugcuucacaaccgaccccaacauccgcguaggauacuguucacaaaucccaaacugugacaugagccacggacaggacugcuacagagguaacggcaaaaacuacaugggcaaccucucccaaacacgauccggacugaccugcagcaugugggacaagaacauggaagaucuccauagacacaucuucugggaaccagacgcaagcaaauuaaacgaaaacuacugccgaaaccccgacgacgacgcccacggccccuggugcuacacaggaaacccucugauucccugggauuauugucccaucucccgcugcgagggcgacaccacccccacaaucgugaaccuagaccaccccguaauaucaugcgcaaaaacgaaacagcuccgaguugugaacggcauaccaacuagaacuaacaucggcuggauggucucacuacgauaccguaacaaacacaucugcggagguucgcuaauaaaagaaagcuggguccucaccgcacgccaaugcuuccccagccgggaucugaaagacuacgaagccuggcugggaauacacgacguccacgguagaggagacgaaaaaugcaaacagguccucaacguaucccaacucguauacggcccggagggcagugaccucguacucaugaaacuagcccgacccgccguccuugacgacuucguauccaccauagaccuccccaacuacggcugcaccaucccagaaaagaccagcugcagcgucuacggauggggauacaccggccuaauaaauuacgacgggcuacuccgcgucgcccaccuguacaucaugggcaacgaaaaaugcucccagcaccacagaggcaaaguaacccuaaaugaaagcgaaauaugcgcaggggccgagaaaaucggcaguggcccaugcgaaggcgacuacgggggcccccuaguaugcgaacaacauaaaaugcgcaugguccucggagugaucguccccggacgaggcugcgcgaucccaaaucgcccaggcaucuucguccgcguggcuuacuacgccaaauggauacacaaaauaauacuaaccuacaaaguaccccaaagcuga

SEQ ID NO: 1036 - RNA, 1926 nt, Artificial Sequence
  derived and/or modified CDS sequence (opt9) from Homo sapiens__NP_005336.3 __HsHSPA1A
auggcuaaagcggcggcaaucggaauagaccucggaaccaccuacucaugcgugggcguuuuucagcacggcaaaguagaaauaauagcaaacgaucaaggaaacaggacaacucccucguacguggcauuuacagacacagagagacugauuggggacgccgccaaaaaccaagucgcacugaacccccagaacacaguuuucgacgcgaaaaggcucauaggacgaaaauucggagacccagugguccaaagugacaugaagcacuggccauuccaagugauaaaugacggcgacaaacccaagguacaagucucguacaaaggcgaaaccaaggcauucuacccagaagagauaucguccaugguccucacaaagaugaaagaaauagccgaagccuaccucggguacccagucacaaacgcggucauaaccguacccgcguacuucaacgacagccaacgacaagcgacaaaagacgccggagucauagcaggccucaacguacugcgcauaaucaacgaaccgaccgcggcagccauagccuacgggcuagaccgcacaggaaaaggggagcgcaacgucuuaaucuucgaccuaggcggaggcacauucgacgucucaauacuaaccauagacgacggcaucuucgaaguaaaagccacagccggggacacgcaccuaggcggcgaagacuucgauaaccgccuaguaaaccacuucguagaagaguucaagagaaagcacaagaaagacauaagccaaaacaaacgggccgugcgcaggcuaaggaccgcaugcgaacgcgcaaaacgaacccucagcucaaguacccaagcaagccuggaaaucgacagucucuucgaaggaauagacuucuacaccuccaucacccgagcgcgauucgaagaacuaugcagcgaccuauuccgcucgacacuggaaccgguggaaaaagcacucagagacgcgaagcuagacaaagcccaaauccacgaccuaguauuggugggaggcaguacaagaaucccaaaaguacaaaagcuccuacaagauuucuucaacggaagggaccucaacaaauccaucaaccccgacgaagcaguggccuacggggcagcaguccaggcagccauacugaugggagacaaaagcgaaaacgugcaagaccuacuccuccuggacguagccccacuaagccuaggacucgaaacagccggaggaguaaugacagcacugauaaaaaggaacagcaccauccccacgaaacaaacccaaaucuucacaacguacucagacaaccaacccggagugcuaauacaaguauacgaaggcgagcgcgcaaugacuaaagacaacaaccuccugggcagguucgagcuaucaggaauaccaccggcaccacggggagucccgcaaauagaagugaccuucgacauagacgccaauggcauacuaaacguaaccgcaaccgacaaaucuaccgggaaagcaaacaagauaacgaucacgaacgauaaagggcgcuuaagcaaggaagaaaucgaacgcaugguccaagaagcagaaaaauacaaagccgaggacgaaguacaacgcgaaagagugagcgcgaaaaacgcacuagaaucauacgcguucaacaugaaaagcgcagucgaagacgaaggccucaaagggaaaauauccgaggccgauaaaaagaaaguacuagacaaaugccaagaagucauaagcuggcuagacgccaacaccuuagccgaaaaagacgaguucgaacacaaaaggaaagaacuggaacaaguaugcaaccccauuauauccggccuauaccaaggagcuggaggaccgggacccggcggauucggagcccaaggccccaaaggaggaagugggagcgggcccacgauagaagaagucgacuaa

SEQ ID NO: 1037 - RNA, 1926 nt, Artificial Sequence
  derived and/or modified CDS sequence (opt9) from Homo sapiens__NP_005337.2 __HsHSPA1B
auggcgaaagccgcagccaucggaauagaccucggcaccaccuacucaugcgucggcguauuccaacacgggaaaguagagaucaucgcaaacgaccaaggaaacaggaccacaccaucauacguagccuucacagacaccgagcgccuaaucggagacgccgccaagaaccaaguugcgcucaacccacaaaacacagucuucgacgcaaaacgacugauaggccgaaaauucggcgacccagugguccaauccgacaugaagcacuggccauuccaaguaaucaaugacggagacaaacccaaaguacaggucagcuacaaaggagaaacaaaggccuucuacccagaagaaauaagcucaaugguccugaccaaaaugaaagaaauagcagaggcuuaccucggcuaccccguaacaaacgcggucaucaccguacccgcauacuucaacgacagccaacggcaagccacgaaagacgccggagucauagcaggccuaaacguacuccgcauuauaaacgaaccaaccgccgccgccaucgcauacggacucgaccgaacaggcaagggcgagagaaacguacugaucuucgaccucggaggaggaacauucgacgucaguauacucacgaucgacgacggaauauucgagguaaaggcaacggcuggagacacacaccuaggcggagaagacuucgacaacaggcuugucaaccacuucgucgaagaguucaaacgaaaacacaagaaagacauaagccaaaacaaaagggccguccguagacuaagaaccgccugcgaaagagcgaaaaggacacucagcuccucaacccaagcaagccuagaaauagacucacuauucgaaggcaucgacuucuacaccucgaucacccgugcacguuucgaagaacuaugcagcgaccucuuccgcucaacccuagaacccguagaaaaagcacuacgagacgcgaaacuagacaaagcgcaaauacacgaccugguccuaguaggaggcucaacaagaauaccuaaaguacaaaaacucuugcaagauuucuucaauggccgcgaccucaacaaaagcauaaacccagacgaagccgucgcauauggagccgcggugcaggcagcaauccuaaugggagacaaaagcgaaaacgugcaagaccugcugcuccuagacguagcaccacucucacuuggccucgaaaccgcaggaggcguaaugacugcacuuaucaaaaggaacucgaccauacccaccaaacagacacaaaucuucacuacauacucggacaaccagcccggaguccuuauccaaguauacgagggcgaacgcgcgaugacaaaagacaacaaccuacucggaagauucgaacucucaggaauaccaccagccccacgcggcgucccacaaaucgaaguaacauucgacaucgacgcgaacggaauauuaaacgucacagccacagacaaaucgaccggaaaagcaaacaaaauaacaaucacaaacgacaaaggccgacuuaguaaagaagaaaucgagcgaauggugcaagaagcggagaaauacaaagcagaagacgaaguacaaagagagcgaguauccgccaagaacgcccucgaaucauacgccuucaacaugaaaagcgcggucgaagacgaaggccuaaaggggaagauaagcgaagcagacaagaagaaaguacuagacaaaugccaagagguaaucagcuggcuagacgcaaacacccucgcugaaaaagacgaguucgaacacaaacgaaaagaacucgagcaagucugcaaccccauaaucucgggccucuaucagggagcgggaggacccggcccagggggcuucggagcgcaaggacccaaaggcggcagcggaagcggccccacaaucgaagaaguagacuag

SEQ ID NO: 1038 - RNA, 1926 nt, Artificial Sequence
  derived and/or modified CDS sequence (opt9) from Homo sapiens__NP_005518.3 __HsHSPA1L
auggccacagccaaggggaucgcaaucggcaucgaccuaggaaccacauauuccugcguaggagucuuccagcacggcaaaguggaaauaaucgcaaacgaucaaggcaacagaacaaccccaagcuacguagcauucaccgacacagagagacugaucggcgacgccgcgaaaaaccaaguggcaaugaacccacagaacaccgucuucgacgccaaacggcucauaggcagaaaauucaacgaccccguaguacaagccgacaugaaacucuggcccuuucaagucauaaacgaaggcggaaagcccaaaguccuaguaagcuacaaaggcgaaaacaaggccuucuaccccgaagaaaucucgagcaugguccucaccaagcugaaggaaacagcagaagccuuccuaggccacccaguaacaaacgccguaauaacagugccagcauacuucaacgacagccaacgacaagcgaccaaggaugcggguguaauagcgggccucaacguccuacgaaucauaaacgaaccuacagcggccgccaucgccuacggacuggacaaaggaggccagggagaaagacacguacugauauucgaccuaggaggcggcaccuucgacgucucaauacugaccaucgacgauggcaucuucgaaguaaaagccacugcaggcgacacccaccucggcggcgaagacuucgacaaccggcucgucagccauuucgucgaagaauuuaaaaggaaacacaagaaagacaucucccagaacaaaagagcagucagacgacuucggaccgcgugcgaacgcgcaaaacgcacgcuaagcagcaguacacaagcaaaccuagaaaucgacucccuuuacgaaggaaucgacuucuacacaucaaucacccgcgcaagguucgaggagcucugcgccgaccucuuccguggcacccuagaacccgucgaaaaagcacuccgcgacgccaaaauggacaaggcaaaaauacacgacaucguacucgucgggggcucaaccagaauccccaagguccagcgccuacuacaagauuacuucaacggacgagaccucaacaaaagcauaaauccagacgaagcggucgcguacggcgcagcaguacaggccgcgauccuaaugggggacaaaagcgaaaaaguccaagaccuccuccugcuagacguagcaccgcuuucccuaggccuagaaacagccggagguguaaugaccgcccuaaucaaacgcaacagcacaauacccaccaaacaaacccaaaucuucaccacauacagcgacaaccagccgggcguccucauacagguuuacgaaggcgaacgcgcaaugacaaaagacaacaacuuacuaggacgauucgaccugaccggcaucccaccagcacccagaggcgucccccaaauagaaguaaccuuugacauagacgccaacggcauacuaaacguaacagccacagacaaaaguacgggcaaagucaacaaaaucaccauaaccaacgacaaaggcaggcucucaaaagaagaaaucgaacggaugguccuagacgcagaaaaauacaaagcagaagacgaaguacagcgagagaaaauagcggccaaaaacgcacucgaaagcuacgccuucaacaugaaaagcguuguauccgacgaaggauuaaaaggaaaaauaagcgaaagcgacaaaaacaaaauacucgacaaaugcaacgaacuccuguccuggcuggaaguaaaccaacucgccgaaaaagacgaguucgaccacaaacgaaaagaacucgaacaaaugugcaaccccauaaucaccaaacuguaccaaggcgguugcaccggaccagccugcggaaccggcuauguacccggacgcccagcgacaggcccaaccaucgaagaggucgacuaa

SEQ ID NO: 1039 - RNA, 1920 nt, Artificial Sequence
  derived and/or modified CDS sequence (opt9) from Homo sapiens__NP_068814.2 __HsHSPA2
augagcgcacgcggccccgcaaucgggaucgaucuaggcaccacauacucgugcguaggcguauuccaacacgggaaagucgaaaucaucgcaaacgaccaaggaaaccgcaccacccccagcuacguagccuucaccgacaccgaacgacucaucggagacgcagccaaaaaccagguagcaaugaacccaaccaacacaaucuucgacgcaaaaaggcugauaggccgaaaauuugaggacgccacgguccaaagugacaugaaacauuggcccuuccgcguaguauccgaaggaggcaaacccaaaguccaaguagaauacaagggcgagaccaagaccuucuucccggaagaaauauccagcaugguccugaccaaaaugaaagaaauagccgaagccuaccuugggggaaaaguccacagcgccgucauaaccguuccagccuacuucaacgacagccaacggcaagccacgaaagacgcaggcacaauaacaggacucaacguccuucgaauaauaaacgaaccaaccgcagccgcgaucgcauacgggcucgacaaaaaggggugugcagggggcgagaaaaacguguuaauauuugaccuaggcgggggcaccuucgacguaagcauccucaccauagaagacggcauauuugaagucaaaagcaccgccggagacacacaccugggaggagaagacuucgacaaucggaugguaagccaccucgcagaagaguucaagcgcaagcacaagaaagacauugggccaaacaaaagggccgugcgacgccucagaaccgcaugcgaacgcgcaaaacgcacccugagcucaaguacgcaagcaagcaucgaaauugacagucuguacgaaggaguagacuucuacacaucaauaacacgagcacgcuucgaagaacucaacgccgaccucuuccgcggaacacuagaacccgucgaaaaagcacuccgggacgcaaaacuggacaaaggccaaauccaagaaauaguacucgucgggggauccacccgaauaccaaagauacagaaacuacugcaagacuucuucaacgggaaagaacuaaacaagucgauaaaccccgacgaagcaguagcguacggcgccgccguacaagccgcgauccugauaggagauaaaagugaaaacgugcaagaccuacugcuccuggacgucacgccccuaucacucgggaucgaaaccgcuggcggaguaaugacaccccucauaaaaaggaacaccaccauaccaaccaaacaaacccaaacauucaccaccuacucggacaaccaaucaucugugcuaguacaaguauacgaaggcgaacgggcuaugacgaaagacaacaaucuacuagguaaguucgaccuaacaggcauacccccggcaccccgaggaguaccacaaauagaaguaaccuucgacaucgaugcaaacgggauacuaaacguaaccgcagccgacaaaucgaccggaaaagaaaacaaaaucacaaucacaaacgacaaaggacgccucagcaaagacgacauagaccgaaugguucaggaagcagagagguacaagagcgaagacgaagcgaaccgagaccgaguggcggccaaaaacgcacuggaaagcuacaccuacaauauaaaacaaacaguugaagacgaaaaacuccguggaaagaucagcgaacaagacaaaaacaaaauacuagacaaaugccaagaagucauaaacuggcuggaccgaaaccagauggccgaaaaagaugaauacgaacacaaacaaaaagagcuagagcgcguaugcaaccccauaaucucgaaacuguaccaaggcggaccaggaggaggaagcggaggaggaggaucgggcgcaagcggcggcccgacaaucgaagaggucgacuga

SEQ ID NO: 1040 - RNA, 2523 nt, Artificial Sequence
  derived and/or modified CDS sequence (opt9) from Homo sapiens__NP_002145.3 __HsHSPA4
augagcguaguaggcaucgaccuaggguuucagagcugcuacgucgcagucgcaagagcggguggcauagaaacaauagcaaacgaauacagcgacagaugcacccccgcaugcaucucguuuggccccaaaaauagaagcauuggagcugcagccaaaagccaagucaucagcaacgcgaaaaacacgguacaaggcuucaagcgguuucacggaagggcauucagcgaccccuucguugaagcggagaaguccaaccuagcguacgacaucguccaacuacccaccggacugaccgguauaaaaguaacauacauggaagaagaaaggaacuuuacaacagaacaaguaaccgccaugcuccucagcaaacuaaaagaaacagcagaauccguccucaagaaacccgucgucgacugcgucgugucgguccccugcuucuacaccgaugcagaaaggcgcucagucauggacgcgacgcagauagcggggcucaacugccuacgccuaaugaacgagacgacagcagucgcccucgccuacggcaucuacaaacaagaccuucccgcacuagaagaaaaaccccgaaaugucgucuucgucgacaugggacacucagcauaccaaguaucuguaugcgcguucaaccgaggcaaacuuaaagugcuggccaccgccuucgacacaacacucggcggccggaaauucgacgaaguccuaguaaaucacuucugcgaagaguucggcaagaaauauaaacuagauauaaaauccaaaauacgcgcccuccugcgcuugagccaggaaugcgaaaaacucaaaaagcuaaugagcgcaaacgcgucagaccugccacugagcauagaaugcuucaugaacgacguagacguauccggaaccaugaaccggggaaaauucuuagaaaugugcaacgaccuccuagcacgcguugaacccccucuaagaucugugcuggaacaaacaaaacugaagaaagaagacaucuacgcaguagaaaucgucggaggggcaacucgaauaccggccgucaaagagaaaaucagcaaauucuucgggaaggaacucagcaccacccugaacgcagacgaagcgguaaccaggggcugcgcgcuccaaugcgccauacugucaccagccuucaaaguacgagaguucagcauaacagacguggucccauacccaauaagccuccgauggaacucaccagcagaagaaggcucgagcgacugcgaaguauucagcaaaaaccacgcagcaccauucuccaaaguccucacguuuuaccggaaagaaccguucacccucgaggcauacuacuccucaccccaagaccuccccuaccccgacccagccaucgcacaauucagcguccaaaaggucacuccccagagcgacggcaguagcagcaaagucaaagucaaaguccgcgucaacguacacgggaucuucagcguaucaucagccagccucguggaaguccacaagagcgaggaaaacgaggaaccaauggagaccgaccaaaacgccaaagaagaagagaaaaugcaagucgaccaggaagaaccccacguagaagaacagcagcagcaaacccccgcggaaaacaaagcagaauccgaagaaauggaaaccucgcaagccggcaguaaagacaagaaaauggaccaaccaccccaagcaaagaaagcaaaaguaaaaacguccacaguagaccugccaauagagaaccaacuacuuuggcaaauagaccgagaaaugcuaaacuuauacaucgagaacgaagggaaaaugaucaugcaagauaaacuagaaaaagaaagaaacgaugccaaaaacgcagucgaagaguacguuuacgagaugcgggacaaacuaagcggcgaguacgagaaguucgucuccgaggacgaccgcaacagcuucacacugaaacucgaagacaccgaaaacuggcuauacgaagacggcgaagaccaaccaaagcaaguauacgucgacaagcucgcggaacucaaaaaccucggccaaccaauaaaaauccgguuccaagaaagcgaggagagaccaaagcuauucgaagaacucggaaaacaaauccagcaauacaugaaaauuauaucaaguuucaaaaacaaagaagaucaauacgaucaucuggacgccgcagacaugacaaaaguagaaaaaucgaccaacgaagcaauggaauggaugaacaacaaauuaaaucugcaaaacaaacaaagccuaaccauggaccccguaguaaaaucaaaagagaucgaagccaaaaucaaagaacucaccuccacaugcagccccaucauaagcaaacccaagcccaaagucgaaccacccaaagaggaacagaaaaacgcagaacaaaacggccccgucgauggacagggcgauaaccccggaccgcaagccgccgaacaaggcacggacacagccgugcccucagacagcgacaagaaacuaccagaaauggacaucgacuaa

SEQ ID NO: 1041 - RNA, 2520 nt, Artificial Sequence
  derived and/or modified CDS sequence (opt9) from Homo sapiens__NP_055093.2 __HsHSPA4L
augucagucgucggaauagaccucggauuccucaacugcuacauagccguagcacgcuccggagguauagagacaaucgccaaugaguacuccgacagguguacccccgcgugcaucagccugggcucccgcacucgcgccaucggcaacgcggcgaagucccaaaucgucaccaacgucagaaacacaauccacggauucaagaaacuccacggacgauccuucgacgaccccauaguccaaaccgagcgcauacgccugcccuacgaacuacagaaaaugccaaauggcagcgccggcguaaaaguccgcuaccucgaggaggaacgccccuucgccaucgaacaagucacaggcaugcuauuagcaaagcucaaagagaccuccgaaaaugcacucaagaaacccguggcagacugcguaaucagcauuccguccuucuucacagacgcagagcgacggucagucauggcagccgcacaagucgccggccugaacugucuccgacugaugaaugagacaacggccgucgcccucgcauacggcaucuacaaacaagacuuaccuccgcucgacgaaaaaccgagaaacgucgucuucaucgacaugggacacagcgcauaccaaguccucguaugugcauucaacaaaggaaaacuaaaaguucuugccaccacauucgauccauaccucggaggccgcaacuucgacgaagcacucguugacuacuucugugacgaguucaaaacaaaauacaaaauaaacgucaaagaaaacagccgcgcccuucuccgucuauaccaggagugcgaaaaacucaagaaacucaugagcgccaacgccagcgaucucccacuaaacaucgaauguuucaugaacgaccuggacgugaguuccaaaaugaaccgugcccaauucgagcaacucugcgccagcuuacuagcaagaguagaaccaccacucaaagcggucauggagcaagccaaucuccaacgggaagacaucagcuccauagagaucgucgggggagcaacccgaauacccgcuguaaaagaacaaauaacuaaauucuuccuaaaagacauaagcacaacccugaacgccgacgaagcagucgcccgaggcugcgcacuccagugcgccauacucucccccgcguucaaaguacgcgaguucaguaucacagaccucguaccauacucaaucacccuacgcuggaagacaucuuucgaagacggcuccggagaaugcgaagucuucugcaaaaaucaccccgcccccuuuuccaaagucaucacauuccacaaaaaggaaccguucgaacucgaagcguuuuacacgaaccuccacgagguaccauaccccgacgcgagaauaggaucauucaccauacaaaacguauucccacaauccgacggcgauucauccaaggucaaagucaaaguaagagucaacauacacggcaucuuuucagucgccagcgccagcgugauugagaaacaaaaccuugaaggcgaucacagcgacgcccccauggaaaccgaaacgagcuucaagaacgaaaacaaggacaacauggacaagaugcagguagaccaagaggaaggacaccaaaaaugccaugcagaacacacacccgaggaagaaaucgaccacaccggagccaaaacgaagucugccgucagcgauaagcaggaccgucucaaccaaacccucaagaaaggcaaaguaaaaagcauagaccuaccaauccaaagcucacucugccgccaacucgggcaagaccuccuaaacuccuacauagaaaacgaaggcaaaaugaucaugcaagauaaacuagaaaaagaacgcaacgacgccaaaaacgcagucgaagaauacgucuaugacuuccgagaccggcucggaaccgucuacgaaaaauucauaacccccgaggaccuaucaaaacuaagcgcuguccuagaagacaccgagaacuggcuauacgaagacggagaggaccaaccaaaacaaguauacguagacaagcuccaggagcucaagaaauacggccaacccauccagaugaaauacauggagcaugaagaaagacccaaagcacucaacgaccucggcaagaaaauccagcucguuaugaaaguaauagaagccuaccgaaacaaagacgagcgcuacgaccaccuagacccaaccgaaauggaaaaagucgaaaaaugcaucagcgaugccaugagcuggcucaacuccaagaugaacgcgcagaacaaacuaucccucacccaagaccccguaguaaaaguaucagaaauagucgcaaaaucgaaagaacuggacaacuucugcaacccaaucaucuacaagccgaaaccuaaagcagaggugccagaagacaaaccaaaagcaaauagcgaacacaacggaccaauggacgggcaauccggaacagaaaccaaaagcgauagcacaaaagacucaucccagcacacaaaaagcucaggggaaauggaggucgacuag

SEQ ID NO: 1042 - RNA, 1965 nt, Artificial Sequence
  derived and/or modified CDS sequence (opt9) from Homo sapiens__NP_005338.1__HsHSPA5
augaaacuaagccuaguagcggcaaugcuccugcucuuaagcgccgcaagagcagaagaagaggacaagaaagaggacgucggcaccgucgucggcauagaccuaggcaccacguacagcugcgucgggguauucaaaaacggaagagucgaaaucaucgccaacgaccaaggcaacagaaucacacccagcuacguagccuucacccccgaaggagaacgccucauaggagacgcggccaaaaaccaacucaccagcaacccagagaacacaguauucgacgcaaaacggcuaaucggccggaccuggaacgaccccagcguccaacaagacauaaaauuccuccccuucaaggucgucgagaagaaaacaaaaccauacauucaagucgacauaggaggaggucaaacgaaaacauucgcacccgaggagauaagcgcaaugguacucaccaaaaugaaagaaaccgcagaagcauaccuuggaaagaaagucacgcaugccgucgucacagucccagccuacuucaacgacgcacaaagacaggcgaccaaagacgccggcacaaucgcaggacugaacguaaugcgcauaaucaacgagcccaccgccgcagccaucgcuuacgggcuagacaaacgagaaggagagaaaaacauccucguguucgaccuaggaggaggcacauucgacgucagccuccuaacaaucgacaacggaguguucgaagucguagccaccaacggcgacacgcaccucggaggagaggauuucgaccaaagaguaauggaacacuuuaucaaacuauacaaaaagaaaacaggcaaagacguacgaaaagacaacagagccgugcaaaaacuucgacgugagguagaaaaagccaaacgagcacugucgagccaacaccaagcaagaauagaaaucgagagcuucuacgaaggcgaagacuucagcgaaacccucacucgagcaaaauuugaagaacuaaacauggaccucuucagaagcacaaugaagccaguacagaaggugcucgaagacucagaccucaagaaaagcgauauagacgaaaucguccucgucgggggcagcacccggauaccgaaaauccaacaacucgucaaagaguucuucaacggaaaagaaccuagccguggaaucaacccagacgaagccgucgcguacggagccgcgguccaggcaggcguccuaucaggcgaucaagacacaggcgaccucguccuacuagacgugugcccacuaacacucggaaucgaaaccgugggcggagucaugaccaaacuaauaccccgcaacacagucguucccacgaagaaaagccaaauauucagcacggccucagacaaccagcccaccguaacaaucaaagucuacgaaggggaacgcccacucaccaaagacaaccaccuccugggcacguucgaucugacaggcauaccacccgcgccccgcggagucccgcaaaucgaaguaacauucgaaauagacgugaacgggauacugcgcgucacagccgaagacaaaggaaccggaaacaaaaacaaaaucacaauaacaaacgaccaaaaccgccuaacaccagaagaaauagaaagaaugguaaacgacgccgaaaaauucgcagaagaggacaagaaacuaaaagaacgcauagacacccgaaacgaacucgaaucauaugcauacucccucaaaaaccagaucggcgacaaagaaaaacuagggggcaaacugagcuccgaggacaaggaaacaauggaaaaagcaguagaggagaaaaucgaauggcuggaaagccaucaagacgcagacauagaggacuucaaagccaagaagaaagaacuugaagagaucguacaaccaauaaucucaaaacucuacggcucggcaggaccaccaccgacaggagaagaagacacggccgaaaaagacgaacuguag

SEQ ID NO: 1043 - RNA, 1932 nt, Artificial Sequence
  derived and/or modified CDS sequence (opt9) from Homo sapiens__NP_002146.2__HsHSPA6
augcaagccccaagagaacuagccguggggaucgaccucgggacaacauacuccugcguaggcguguuccaacaaggaagagucgaaauauuagcaaacgaccaaggcaacaggaccacaccaucguacguagcguucacagacacagaacgccuagugggagacgcagcaaagucgcaagcagcacuaaauccacacaacacggucuucgacgcaaagaggcuaauaggaaggaaguucgccgacacaaccguucaaagcgauaugaagcacuggccauucagagucgucucggaaggagggaaaccaaaagugcgggucugcuacagaggcgaagacaaaacauucuacccagaagagaucuccagcaugguacugagcaaaaugaaggaaacagccgaagccuaccucggccaaccagucaagcacgcggucauaaccguacccgccuacuucaaugacagccagcgccaagccacaaaagacgccggggcaauagccggacuaaacguacuacgaaucaucaacgaacccacggcagcagcgauugcauacggccuagaccgaaggggcgccggagaacgcaauguccugauauucgaccugggagggggcacauuugacgucuccguacuaucaauagacgcaggaguauucgaagugaaagcgacggcaggagacacgcaccuaggcggcgaagacuucgacaaccgucuagugaaccacuucauggaagaguucaggcgaaaacacggaaaagaucucagcggaaacaaacgcgcacuccgcaggcuaagaaccgcaugcgaacgcgcaaaaaggacccuaagcuccucgacacaggccacccucgaaauagacucccuauucgaaggagucgacuucuacacaagcaucacccgcgcgcgauucgaagaacuaugcagcgaccuuuuccgcucaacccuagaaccagucgaaaaagcucuccgcgacgcaaaauuagacaaagcacaaauccacgaugucguccuaguaggcggcucaacgcgcauaccaaaaguacaaaagcuccugcaagacuucuucaacgggaaagaacuaaacaaauccauaaaccccgacgaagcggucgccuacggcgcggcgguacaagcagcgguccugaugggcgacaagugcgaaaaagugcaagaccuacuacuccucgacgucgccccauuaagccucggacuggagacggcaggaggaguaaugacaacacuaauccagcgaaacgcgaccauacccacaaagcaaacccaaaccuuuaccacguacucagacaaccaaccgggagucuucauccaaguauaugagggcgaacgcgcaaugacaaaagacaacaaccucuugggccgcuucgaacucuccggcaucccacccgcgccccgaggcguaccgcaaauagaagugaccuucgacauagacgccaacgggauacuaagcguaaccgcgacagaccggucaaccggcaaagcgaacaaaaucacaaucaccaacgacaaaggacggcuaagcaaagaagaaguagaacgcaugguccacgaagccgaacaauacaaagccgaagacgaagcccaacgugaccgcgucgcagcgaaaaacucacucgaagcccacguguuccacguuaaaggaucccuccaagaagaaagccugcgcgacaagauacccgaagaagaccggagaaaaaugcaggacaaaugccgugaaguacucgccuggcucgaacacaaccaacuagccgaaaaagaagaauacgagcaucaaaaacgagaacuggaacaaauuugcagacccauauuuucgagacuguacgggggcccaggcgucccaggaggcucaagcugcggaacccaagccagacaaggagaccccagcacaggaccaaucauagaggaaguagacuag

SEQ ID NO: 1044 - RNA, 1104 nt, Artificial Sequence
  derived and/or modified CDS sequence (opt9) from Homo sapiens__P48741__HsHSPA7
augcaagcaccccgcgaacucgcaguaggcaucgaccuaggcaccaccuacuccugcguaggcgucuuccaacaaggccgcguagaaauacucgccaacgaccaaggcaaccgcaccacccccuccuacgucgcauucaccgacaccgaacgccucguaggcgacgccgcuaaaucccaagccgcccuaaacccccauaacaccgucuucgacgccaaacgacucaucggccgaaaauucgcagacaccaccguacaauccgacaugaaacacuggccuuuccaagucguaucagaaggaggaaaaccaaaaguccgcgucugcuaccgcggagaagacaaaacuuucuaccccgaagaaauauccagcaugguccuaucaaaaaugaaagaaaccgccgaagcauaccucggccaacccgucaaacacgccgucaucaccgucccaaccuacuucuccaacucccaaagacaagccaccaaagaugcaggcgccauagccggccuaaaaguacuccccaucaucaacgaggccaccgccgcagccaucgccuauggacuagaucgccgcggcgccggcaaacgaaacguccugauauucgaccucggcggcggcaccuucgacgucucaguacucagcauagacgcaggcgucuucgaaguaaaagcaaccgcaggagauacacaucucggcggcgaagacuucgacaaucgacuugucaaccacuucauggaagaguucagacgcaaacacggcaaagaccuaucaggcaacaaacgcgcccuacgccgccuacgaaccgccugcgaaagagccaaacgaacacccagcuccucuacgcaagcaacacucgaaauagacucccucuucgaaggcgucgacuucuacaaauccaucacccgagcacgauucgaagaauuaugcuccgaccuguuccgcagcacccucgaacccguagaaaaagcccucagagacgcaaagcuggacaaagcccaaauccacgacuucguccucggaggcggccuccacucccacccccaaggcgcagaaguagcugcaggccuccuacaacgacagggagccgaacaagaacaccaacccuaa

SEQ ID NO: 1045 - RNA, 1941 nt, Artificial Sequence
  derived and/or modified CDS sequence (opt9) from Homo sapiens__NP_006588.1 __HsHSPA8
augucaaaaggaccggccgucggaaucgaccucggcaccaccuacagcugcgucggcguguuccaacacggaaaaguggaaaucaucgcaaacgaucaaggcaacaggaccacacccucguacguggcauuuaccgacaccgaacgccucauuggagacgcggccaaaaaccagguagcaaugaaccccaccaacaccgucuucgacgcaaaaaggcuaaucggcagacgauucgacgacgcagucguccagagcgacaugaaacacuggccauucaugguggucaaugacgcaggccgaccaaaaguccaagucgaauacaaaggcgaaaccaagagcuucuaccccgaagaaguauccagcauggugcugaccaaaaugaaagaaauagcagaggcauaccuaggaaagaccgucacgaacgcagucgugacaguacccgcauacuucaacgacucacaacgccaagccacaaaagacgccggaacaauagccggccuaaacguacuacgcauaauaaacgaaccaacagcagcagcaaucgccuacggacucgacaaaaaggucggggccgaacgcaacguccuaaucuucgaucuaggaggagggacauucgaugucagcauccugacaauagaagacgggauauucgaagucaaaagcacagccggcgacacccaccucggaggagaagauuucgacaaccgcauggucaaccacuuuauagccgaguucaagcgcaagcacaagaaggacaucagcgaaaacaaacgagccguacgccgacuacgcaccgccugcgaacgagcaaaacgcacccugucaagcagcacgcaagcgagcauagagaucgacagccucuacgaaggcauagacuucuacacauccauaacgcgagcacgguucgaagaacucaacgccgaccuguuccgcggcacccuagacccaguagaaaaagcccuacgagacgccaaacucgacaaaucacaaauccacgacauaguucuggucggcggcuccacaagaaucccuaaaauccaaaaacuacuccaagacuucuucaacggaaaagaacucaacaaaagcauaaaccccgacgaagcaguggcguacggagcagccguccaagccgcgauccuauccggcgacaagagcgaaaacguucaagaccuucuccucuuggacguaaccccgcuaucauuaggaauagaaaccgcgggaggaguaaugacaguacuaaucaaaaggaacacuacaauaccgaccaaacaaacacaaaccuucacgacauacucagacaaccaaccaggcgugcucauacaagucuaugaaggagaacgcgcaaugacaaaagacaacaaccuacucggcaaguucgaacucacagggaucccacccgcaccccgcggaguaccacaaauagaaguaaccuucgacaucgacgccaacggaauccucaacgucagcgccgucgacaaaucaacaggaaaagagaacaaaaucacgauaacaaacgacaaagggcgccugagcaaagaagauaucgaacgaaugguucaggaagccgagaaauacaaagcagaggacgaaaagcaacgcgacaaagucagcuccaaaaacucccuagaaucauacgcguucaacaugaaagcgacggucgaagacgaaaaacuacaaggcaaaauuaacgaugaggauaaacagaaaauacuagacaagugcaacgaaaucauaaacuggcucgacaagaaccaaacagcagaaaaagaagaguucgaacaucaacaaaaagaacucgaaaaagucugcaaucccauaauaaccaaacuguaccaaagcgcgggcgggaugcccggcgguaugccgggaggcuuccccggaggcggcgccccaccaagcggcggcgcauccucaggcccaaccaucgaagaagucgacuaa

SEQ ID NO: 1046 - RNA, 2040 nt, Artificial Sequence
  derived and/or modified CDS sequence (opt9) from Homo sapiens__NP_004125.3 __HsHSPA9
augauaagcgccagccgcgcagccgcggcgaggcuaguaggcgcagcggcaaguagaggaccgacggcggcaagacaccaagacucauggaacggccugagccacgaggcguucagacuggugagccgacgcgacuacgcaagcgaggccaucaaaggagcagucgucggaaucgaccuagggacgacgaacucgugcguagcagugauggagggaaagcaggcgaagguccuggagaacgcggaaggagcgagaaccacgccaucagucguagcauucaccgcggacggagagaggcucgugggaaugccagcgaaaaggcaggcaguaacaaacccaaacaacaccuucuacgcgacaaaaaggcuaauagguagaagauacgacgauccagaagugcaaaaggacaucaaaaacguacccuucaagauaguacgagccagcaacggagacgcauggguagaggcacauggcaagcuauauagcccgagccagauaggggcguucguccucaugaagaugaaggaaacggcagagaacuaccugggacacacggcaaagaacgcggucauaacagugccagcguacuucaacgacagccaacggcaagcgacaaaggacgcagggcagauaaguggacucaacguccuacgcgucauaaacgaaccaacagcggcugcccucgcauacgggcucgacaagagcgaagacaaaguaauagcaguauacgaccugggcggaggcacauucgacauaucuauacuagaaauccagaaagggguauucgaaguaaaguccacaaacggcgacacguuccuuggaggggaagacuucgaccaagcgcuauugcgucacaucguaaaggaguucaagagagagacaggaguagaccucacaaaagacaacauggcgcugcaacgaguaagagaagcagcagaaaaagcgaagugugaacuaagcucuagcguacaaacagacauuaaccucccauaucucacaauggacaguucagggccgaaacaccuaaacaugaagcucacaagagcccaguucgagggaauagugaccgaccuaauccgcaggacaauagcgccgugccaaaaggcgaugcaggacgcagaagugagcaagagcgacaucggagaagucauauuaguagggggaaugaccaggaugccgaaagugcaacagacggugcaggaccuguucggcagagcaccgagcaaggcaguaaacccagacgaggcaguagcgaucggagcggccauacaagggggaguacuugcgggagacguaacggacguacuacuauuggacgugacgccauuaagccuaggaauagaaacacuagguggcguguucacuaaacucaucaaucgaaacaccacgauacccacaaagaaaucacaaguguucagcacagcggccgacggacagacccaggucgagauaaaaguaugccaaggagagcgagaaauggccggggacaacaaacuacucgggcaauucacacugauaggaauaccgccagcacccaggggaguaccccagauagagguaacauucgacaucgacgcgaacggaauaguccacgucagcgcaaaagacaaaggaacuggcagggagcaacaaauagugauccaaagcagcggcggacugagcaaggacgacauagagaacauggugaaaaacgcggaaaaauacgcggaggaggacaggagaaagaaagaaaggguagaagcaguaaauauggcggaagggauaauacacgauaccgagaccaagauggaagaguucaaggaucaacucccagcggacgaaugcaacaaauuaaaagaagaaauaagcaagaugagggaacuacuagcgcgcaaagauagcgaaacgggagaaaacauaagacaagccgcgagcagucuccagcaggccagccuaaaacuauucgaaauggcguacaagaaaauggcaagcgaaagagaagggagcgggagcagcggaacaggagagcaaaaagaagaucagaaagaagagaagcaguaa

SEQ ID NO: 1047 - RNA, 2028 nt, Artificial Sequence
  derived and/or modified CDS sequence (opt9) from Homo sapiens__NP_079291.2__HsHSPA12A
auggccgacaaagaggcaggcggaagcgacggaccccgagaaacagccccaacauccgccuacuccagcccagcaagaucacucggcgacaccggcaucacaccacucucaccgucucacaucgucaacgacaccgauucaaacguauccgagcaacaauccuuccuaguagucgucgccgucgacuucgggacaaccuccuccggcuacgcauauuccuucacaaaagaacccgaaugcauccacgucaugcgccgcugggaaggaggagaccccggcguauccaaccagaaaacgcccacuaccauccuacuaacccccgaacgaaaauuccacuccuucggcuacgcugcccgagacuucuaccacgaccucgacccaaacgaagccaaacaauggcucuaccuagaaaaguucaaaaugaaacuucauaccacaggcgaccucaccauggacaccgaucuaaccgccgcaaacggcaagaaagugaaagcucuugaaaucuucgccuacgcccuucaauacuucaaagaacaagcacuaaaagaacucuccgaccaagcaggcucagaguucgaaaacuccgacguucgcugggucaucacaguccccgcaauauggaaacaacccgccaagcaauucaugcgacaagcagcauaccaagccggucucgcaagcccagaaaauucagaacaauuaaucauagcacucgaacccgaagccgcguccauauacugccgcaaacuucgccuccaccaaaugauagaacucuccucaaaagccgcugucaacggguacuccgguagcgacacagucggcgccggcuucacacaagccaaggagcacauacgccgcaaccgccaaucgcgaacauuccucgucgagaacgucaucggagaaaucuggucagaacucgaagaaggcgacaaauacgugguagucgacagcggcggcggaaccguggaccuaaccguccaccagauacgccugccagaagggcaccuuaaagaauuguacaaagccacaggaggacccuacggaucauuaggagucgacuacgaguucgaaaagcugcucuacaaaaucuucggcgaagauuucauugaacaauucaaaauaaaacgccccgccgcaugggucgaucugaugauagccuucgaaucacguaaacgcgcagccgcucccgaccgaaccaauccacucaacaucacccuacccuucucauucaucgacuacuauaagaaauuccgcgggcacuccgucgaacaugcucuccgaaaaucaaacgucgauuucgucaaauggucaucccaaggcaugcuccgcaugucaccggacgccaugaacgcacuauucaaacccacuauagacucaauaaucgaacaccuacgcgaccucuuccaaaagcccgaaguaagcacagucaaauuccucuuccucgugggcggguucgccgaagccccacuccuccaacaggccguccaggccgcauucggagaccagugccguaucauaaucccacaagacguaggccuaaccauacucaaaggcgcaguccuauucggccuagaccccgccgucauuaagguccgccguucccccuuaacauacggagucggcguccuuaaccgcuaugucgaaggaaaacacccacccgaaaagcuccuagucaaggacggcacccgauggugcaccgacgucuucgacaaauucauauccgcagaccaaagcguugcacucggcgaacuugucaaacgaucauacacccccgcgaaacccucacaauuagucauagucauaaacaucuacuccucagaacacgacaacguuuccuucaucaccgaccccggcguaaagaaaugcggaacccucagacuggaccucaccggcacauccggcacugccguacccgcacgacgcgaaauacaaacccucaugcaguucggcgacaccgaaaucaaagcaacugccaucgacauagccacaucaaaauccguaaaaguaggaaucgacuuccuaaacuacuaa

SEQ ID NO: 1048 - RNA, 2061 nt, Artificial Sequence
  derived and/or modified CDS sequence (opt9) from Homo sapiens__NP_443202.3 __HsHSPA12B
augcuagcaguccccgaaaugggccuacaaggccucuacaucggcuccagccccgaacguucacccguacccucaccaccaggcucaccaagaacccaagaaaguugcggcaucgccccacucacgcccucccaaucccccaagcccgaaguccgagcaccccaacaggcuucauucucugucgucguagcaauagacuucggaaccaccucuagcggcuacgcuuucucauucgccagcgaccccgaagccauccacaugaugcgcaaaugggaaggaggagaccccgguguagcacaccagaaaaccccaaccugccuacuccucacacccgaaggagccuuccacagcuucggcuacaccgcccgagacuacuaccacgaccucgaccccgaggaggcucgugacuggcucuacuucgaaaaauucaaaaugaaaauccacuccgccaccgaccucacccucaaaacucaacuagaagcgguuaacggaaaaacaaugcccgcccuagaaguuuucgcacacgcccugcgcuucuuccgagaacacgcacuccaagaacuucgcgaacaaagcccgagccuuccugaaaaagacaccguucgaugggucuugacaguccccgcaauauggaaacaaccggcgaaacaauucaugcgagaagcagccuaccuagccggacugguaucccgagaaaacgccgagcaacuacucaucgcacucgaacccgaagcugcauccgucuacugccgcaaacuacgccuccaccaacuccucgaccuguccggccgcgcaccaggaggcgguagauugggugagcgacgcaguauagacaguuccuuucgacaagcacgcgaacagcuacgccgaagccggcacucccgaacuuuccuuguagaaucaggcgucggcgaacucugggccgaaaugcaagcaggagacagauacguaguugcggacugcggcggcggcaccguugaccugacaguccaccaauuagaacaaccacacggcacucucaaagaacuuuacaaagcauccggcggacccuauggcgccguaggagucgacuuagcauuugaacaacuccugugcagaaucuucggggaagacuuuauagcaaccuucaaaagacaaagacccgcagccugggucgaccuuaccaucgcauucgaagcacggaaacgaacagccggcccacaccgagcaggagcccugaacaucagccuaccauucucauucaucgauuucuaccggaaacaacgcggccacaacgucgaaacagcccuccggcgaagcagcgucaacuucgucaaauggucaucccaaggaaugcuacgaauguccugcgaagcaaugaacgaacucuuccaaccaaccgucucgggcaucauccaacacaucgaagccuuacuagcccgcccagaaguacaaggagucaaacuccucuuccuagucggaggcuucgcagaguccgcaguccuacaacacgcgguucaggccgccuuaggagcacgcggccuccgagucgugguaccccacgacguaggccucacaauccuaaaaggcgccguucucuucgggcaagcucccggcgucguacgcguacgccgcagcccacuaaccuacggcguuggcguacucaaccgcuucgucccgggaagacacccacccgaaaaacuccuaguccgagacgguagacgcuggugcaccgacgucuuugaaagauucguggccgccgaacaaucagucgcccucggcgaagaaguccgacgcagcuacugccccgcacgccccggccaacgacgcguccucaucaaccuauacugcugcgcagcagaagacgcacgcuuuauaaccgaccccggcguccgaaaaugcggcgcacucucacucgaauuagaacccgcagacugcggucaagacaccgccggagccccgcccggaagacgagaaauccgcgccgcaaugcaauucggcgacaccgaaaucaaagucacagccgucgaugucuccacaaaccgaagcguaagggccucgauagacuuccuaaguaacuag

SEQ ID NO: 1049 - RNA, 1416 nt, Artificial Sequence
  derived and/or modified CDS sequence (opt9) from Homo sapiens__NP_008879.3__HsHSPA13
auggcaagagaaaugacaauccuuggcuccgccgugcuaacccuccuacuagccgguuaccucgcccaacaguaccuaccccuccccaccccaaaagucaucggaaucgaucucggcaccaccuacugcucagucggcgucuucuuccccggcaccggaaaaguaaaaguuauaccggacgaaaacggccacaucuccauccccucaauggucuccuucaccgacaacgacgucuacgucggcuacgaaagcguggaacucgccgacuccaacccccaaaauacaauauacgacgccaaacgcuucaucggcaaaaucuucaccgccgaagaacucgaagccgaaauaggccgcuacccuuucaaagugcucaacaaaaacggcauggucgaguucuccgucaccagcaacgaaacaauaacaguaucgccagaauacgucggcucccgccuccuccuuaaacuaaaagaaauggcagaagccuaccuaggcaugcccgucgccaacgcaguaaucucagucccagccgaguucgaccuuaaacaaaggaacuccaccaucgaagcagcuaaccucgccggccugaaaauccuccgagucaucaacgaacccaccgccgcggccauggcauacggacuucacaaagccgacgucuuccacguccucguaaucgaccugggcggcggcacccuagacgucagccuucucaacaaacagggaggcauguuccucacacgcgcgaugucaggaaacaacaaacuaggaggccaggacuucaaccaacgccuacuccaauaccuauacaaacaaauauaccaaaccuacggauucguuccaucccgaaaagaagaaauccacagacuccgacaagcaguagaaaugguaaaacucaaccuaacccuacaccaauccgcacaacuaagcguccuccuuacaguagaagaacaagaccgaaaagaaccacacuccuccgacaccgaacuccccaaggauaagcuauccagcgcugacgaccacagaguaaacuccgguuucggccguggccucagcgacaagaaaucuggugaaucacagguccuauucgaaaccgagauaucccgaaaacucuucgacacccucaacgaagaccucuuccagaaaauccucguccccauccaacaaguccucaaagaaggccaccucgagaaaacagaaaucgacgaagucguacucguaggaggcuccacacgcaucccccgcauccgacaaguaauccaagaguucuucggcaaagaccccaacaccucaguagacccugaccuggccgucguaaccggagucgccauccaggccggaauugauggcggauccuggccccuacaagugagcgcccucgaaaucccaaacaaacaccuccagaaaacaaacuuuaacuga

SEQ ID NO: 1050 - RNA, 1530 nt, Artificial Sequence
  derived and/or modified CDS sequence (opt9) from Homo sapiens__NP_057383.2__HsHSPA14
auggccgcaauaggcguccaccuaggcugcaccagcgccugcgucgccgucuacaaagacggcagagcaggcguagucgccaacgacgccggagaccgcgucaccccagcagucgucgccuacagcgagaacgaagaaaucguggggcucgcagccaaacaaucccgcauccgaaauaucuccaacacagucaugaaaguaaaacaaauccuaggacgcaguucgucagauccccaggcccaaaaauacauagccgaaucaaaaugccuaguaauagagaaaaacggcaaacuccgauacgaaaucgacaccggugaagaaacaaaauucguaaacccagaagacgucgcacgccuaauauucagcaagaugaaagaaaccgcccacucugugcucggaagugacgccaacgacguagucaucaccguaccauucgacuucggcgaaaaacagaaaaacgcccuaggcgaagccgcaagagccgccgguuucaacguccugcgacucauacacgaaccaagcgccgcgcuccucgccuacggcaucggccaagacuccccaaccgggaaguccaacauccuaguauucaagcuaggaggcaccagucuaucccuauccgucauggaagucaacagcggcauauaccgcguacucucaaccaacacagacgacaacaucggcggagcccauuucaccgaaacacuagcccaauaccucgccuccgaguuccaacgcucuuucaaacacgacguccgcggcaacgcgcgcgccaugaugaaacuaaccaacagcgccgaaguagcuaaacacucacucucaacacucggcuccgcaaacugcuuucuugacagccuauacgaaggccaagacuucgacugcaacgucucaagagccagguucgaacuacuaugcucaccacucuucaacaaaugcaucgaagccauacguggacuacucgaccaaaacggauucacugccgacgacaucaauaaaguaguacucugcggaggaucuucacgaauaccuaaacuacaacaacucaucaaagaccucuucccagccgucgaacuucuuaacuccaucccacccgacgaagucauccccaucggcgccgccaucgaagccggcauccucaucggaaaagaaaaccuacuuguagaggacucccucaugaucgaaugcuccgccagagacauccuagucaaaggcguagacgagagcggcgccagccgauucaccguccuauuccccuccggaacaccacuaccagcccgacgccaacacacacuacaagccccaggaucaauauccuccgucugccucgaacucuacgaaagcgacggcaaaaacuccgcaaaagaagaaaccaaauucgcacaagucguccuccaagaccucgacaagaaagaaaacggccuccgcgacaucuuagcagugcucaccaugaaacgcgacggcagccugcacguaacaugcacagaccaggaaaccggcaaaugcgaagccaucuccauagaaaucgccucauaa

SEQ ID NO: 1051 - RNA, 2577 nt, Artificial Sequence
  derived and/or modified CDS sequence (opt9) from Homo sapiens__NP_006635.2 __HsHSPH1
augagcguaguaggacucgacguagggagccaauccugcuacauagccgucgcccgcgccgguggcaucgaaaccaucgcaaacgaguucagugaccgaugcacccccuccguaauauccuucggaagcaaaaacagaaccauaggcguagcugcuaaaaaucagcaaaucacacacgcgaauaacacggucucaaacuucaaacgauuccacggcagagccuucaaugaccccuucauccaaaaagaaaaagaaaaccuaucauacgaccuaguaccccucaaaaacggaggcguaggaaucaaagucauguacaugggagaagaacaccuauucagcguagaacaaauaacugccaugcuacucaccaaacucaaggaaaccgcagaaaacucacugaaaaagccagucaccgacugcgugauaagcguccccucuuucuucaccgacgccgaacgccgaucgguccuagacgcagcccaaauagucggccuaaacugucuacgacuaaugaacgacaugacagcaguggcccugaacuacggcaucuauaagcaagaccugcccucgcucgacgaaaaaccacgcaucguaguauucgucgauaugggccacucagcauuccaagugucagccugcgcauucaacaagggcaaacucaaagugcuaggcaccgccuucgaccccuuucucggaggcaaaaacuucgacgaaaagcuaguggaacacuucugcgcagaauuuaaaaccaaauauaaacucgacgccaaauccaaaaucagagcccugcuacgacucuaccaagaaugcgaaaaacuaaagaaacugauguccuccaacucaaccgaccugccccugaacaucgaaugcuucaugaacgacaaagacgucuccgggaaaaugaacagaucacaauucgaagaacuuugcgccgaacuacuccagaaaaucgaaguaccacucuacucccuccuggaacaaacccaccuaaaagucgaagacguguccgccguagaaauugucggcggcgcaacacgcauaccggccguaaaagaacgaauagcgaaauucuucggcaaagacaucuccaccacccuuaacgcagacgaagccgucgcacgcggcugcgcccuccagugcgcaauacucucgccggccuucaaaguccgcgaguucuccgucacggaugccgucccauucccgaucucccugauuuggaaccacgacagcgaagacacugaaggaguccaugagguauucagccgaaaccacgcagcucccuucagcaaaguacucacauuccuacgccgcggaccauucgaacuggaagcguucuacagugacccccagggaguaccguacccggaagcaaaaaucggacgcuucguggugcaaaacguaucagcacaaaaggacggcgagaaaagccgcgucaaaguaaaaguaagaguaaauacgcacggaaucuucacaaucucaacagccucaauggucgaaaaaguacccaccgaggaaaacgaaaugagcuccgaagccgauauggaaugccucaaccaacgcccacccgaaaaccccgauacagacaagaacguccaacaagacaauuccgaagcgggcacacaaccccagguccaaacagacgcacagcaaacaagccaguccccacccucacccgagcucaccucggaagagaacaaaauacccgaugccgacaaagcuaacgagaaaaagguggaccaaccacccgaagccaagaaacccaaaaucaaagucguuaacguagaacuaccaauagaagccaaucuuguauggcagcucgggaaagaccuccugaauauguacaucgaaacagaaggcaaaaugaucaugcaggacaaacucgaaaaagaacgaaacgaugccaaaaacgccgucgaagaauacguauacgaguuccgagacaaacuaugcggccccuacgaaaaguucaucugcgaacaagaccaucaaaacuuccuccgacuccucaccgaaacagaagacuggcuauacgaagaaggcgaagaccaagccaagcaggcguacguagacaaacuagaggaacuaaugaaaaucgggaccccuguaaaaguacgauuccaagaagccgaagaacgaccaaaaauguuugaagaacugggacagcgccuccagcacuacgccaagaucgccgcagacuuccgcaauaaagacgaaaaauacaaccauauagacgaaagcgaaaugaaaaaggucgaaaagagcgucaacgaggucauggaauggaugaacaacgucaugaacgcucaagccaagaaaagucuagaccaagaccccguagugagggcgcaagaaaucaaaaccaaaauaaaagagcugaacaacacaugugaaccagucgucacgcaaccgaaaccaaaaaucgaaagcccgaaacucgagcgcacacccaacggacccaacaucgacaagaaagaagaagaccuagaagacaaaaacaacuucggugccgagcccccgcaccaaaacggugaaugcuaucccaacgagaaaaacagcgugaacauggaccuugacuaa

SEQ ID NO: 1052 - RNA, 3000 nt, Artificial Sequence
  derived and/or modified CDS sequence (opt9) from Homo sapiens__NP_006380.1 __HsHYOU1
auggcagacaaagugagacgacaacguccgcgucggcggguuugcugggcacucguggcaguccuccuagcagacuugcucgcccuaagcgauacccuagcagugaugucuguagacuuaggaucggaaucgaugaaaguagccaucgucaaaccgggagugccaauggaaaucguacuaaacaaagaaucacgcaggaaaacccccgugaucgucacgcugaaagagaaugagcgauucuucggcgauuccgcagcauccauggcgaucaaaaacccgaaggcaacacugagauacuuucagcaccuccucggaaaacaggcagacaacccacacguagcccucuaccaagcacgcuuccccgagcacgaacuaacauucgacccccaacgccaaaccgugcacuuccaaaucagcagucagcuccaauuuagcccagaagagguacucggaaugguacucaacuacuccaggagccucgcugaagauuuugccgaacagcccauaaaagacgcagucauaacaguacccgucuucuucaaccaagccgaaagacgagcgguacuccaagcagcaagaauggccggccucaagguccuucaacugaucaacgacaacacagcgacagcacucuccuacggaguauucagaagaaaagacauaaacaccacagcacagaacaucauguucuacgacaugggaagcggaaguacuguuugcacaauaguaaccuaccaaaugguaaagaccaaagaggcaggaaugcaaccacaacuucaaauacgaggggucggcuuugacaggacucuaggaggacuggagauggaacuccggcuucgagaacgccuagcaggacucuucaacgaacaacgaaagggccagagagccaaagacguacgagaaaauccacgagcaauggccaaacuccuaagagaagcgaaccgacucaaaacgguccuaagcgcaaacgcggaccacauggcccaaaucgaaggacuaauggacgacguugacuucaaagccaaaguaacacgaguagaguuugaagaacucugcgccgaccucuucgaacgagugccaggaccgguacaacaagcacuccagagcgcagaaaugucccuagacgaaaucgagcaagugauccuaguaggaggcgcaacccggguaccacgcguacaagaaguauuacugaaagcggugggaaaagaagaguuagggaaaaacauaaacgccgacgaagccgcagcaaugggagcaguauaccaagccgcggcccucagcaaagccuucaaaguaaaacccuucguagugcgggacgcagucguauacccaauacugguggaguuuaccagagaagucgaagaggaacccggcauccacagccuaaaacacaacaaaagaguccuguucuccaggaugggacccuacccacaacgcaaggugauaacauucaaccgauacagucacgacuuuaacuuccacauaaacuauggggaccugggcuuccuaggacccgaggaccuccgcgucuucggaucccaaaaccuaacaaccguaaaacucaaaggaguaggagacucuuucaaaaaguaccccgacuacgaaucaaaggggauaaaagcccacuuuaaccucgacgaaagugggguccucagccuggaccgcguagagucggucuucgaaacacucgucgaagacagugccgaagaagaaucaacccuaacgaaacuaggcaacacaauaucaagccucuucggaggaggcacaacaccugacgccaaagaaaacggaacagacaccguacaagaagaagaggaaagccccgcggagggaucaaaagacgaaccaggcgaacagguggaacucaaagaagaagcggaagccccagucgaggauggaagccaacccccaccacccgaaccgaaaggcgacgcaacaccggaaggcgaaaaggccaccgagaaagaaaacggggacaagucagaagcccaaaagccaagugaaaaagccgaagcaggcccagaaggaguagccccggccccagaaggagagaaaaagcagaaacccgccaggaaacgccgaaugguggaggagauaggcgucgaacucguaguacuggaucuaccagaccuccccgaagauaagcuagcacaaagcgugcaaaaacuccaggaccucacccugcgcgacuuagaaaaacaagagagagagaaagcagcaaacagccuggaggccuucaucuucgaaacacaagacaagcuguaccagcccgaauaccaagaagugagcacggaagaacaaagagaagagaucuccggcaagcuauccgcagccagcacguggcucgaagacgaaggaguaggggccacaacaguuaugcucaaagaaaaauuagcagaacuaagaaagcuaugccaaggacuauuuuucagaguggaagagagaaagaaauggccggaaaggcucagugcccucgacaaccuacucaaccauuccagcauguuccugaagggcgcaaggcuaauaccagaaauggaccaaauauucacagaaguagaaaugaccacucucgagaaaguaauaaacgagacaugggcguggaaaaacgcaacccucgcagaacaagcgaagcugccagccacggagaagccgguucuacucagcaaggauauagaagcaaagaugauggcacuagacagagaaguccaguaccuguuaaacaaagcaaaauucacaaaaccacgcccaaggccgaaagacaaaaacggaacacgagcagaaccaccacugaacgcgucagcuucagaccaaggagaaaaaguaauacccccagcagggcaaaccgaggacgcagaaccaaucagugaaccagagaaaguugagacgggaagcgaaccaggagacacggaacccuuagaauuaggaggcccaggcgcagaaccagaacaaaaagagcaaagcacuggccaaaagcguccccucaaaaacgacgagcuauga

SEQ ID NO: 1053 - RNA, 2199 nt, Artificial Sequence
  derived and/or modified CDS sequence (opt9) from Homo sapiens__NP_005339.3 __HsHSP90AA1
augcccgaagagacgcaaacgcaagaucaaccgauggaggaggaagaaguggaaaccuucgcguuccaggcagaaaucgcgcaacugaugagccucauaaucaacacguuuuacagcaacaaagaaauauuccugcgcgagcuaauaagcaacagcagcgacgcacucgacaagauacguuacgaaucccuaacggacccgagcaaacuagacagcgggaaggaacuacacaucaaccucauccccaacaagcaggaccgaacccugaccauagucgacaccggaauagggaugacgaaagcagaccucaucaacaaccucggaacgaucgccaaaagcggcacgaaggcuuucauggaagcacuacaagcgggcgccgacauaaguaugauaggccaauucggaguaggauucuacagugccuaccuaguggcagagaaagucaccguaauaacaaaacacaacgacgacgaacaauacgccugggaaagcagcgccgggggcuccuuuacaguaagaacagacaccggagaaccaaugggccgcggaacaaaaguaauacuccaccuaaaagaggaccaaacagaauaccucgaggaaagacgaauaaaggagaucgucaaaaagcacagccaauucauaggauacccaauaacgcuauucguggaaaaagaacgagacaaagaagugucagacgacgaagcggaggaaaaagaggauaaggaagaagagaaagagaaagaagaaaaagaaagcgaagacaagccagaaaucgaggacguagggucggacgaagaggaggaaaagaaagacggcgauaagaaaaagaaaaagaaaaucaaagaaaaguacaucgaccaagaggagcuaaacaaaacaaaaccgaucuggacacgaaacccagacgacaucacgaacgaggaauacggcgaguucuacaaaucacucacaaacgacugggaagaccaucuagcaguaaagcacuucagcgucgaaggccaacuggaguucagagcucuccuguucguacccaggcgcgcccccuucgaccucuucgaaaacagaaagaagaaaaacaacauaaaauuauacguaagacgaguauucauaauggacaacugcgaagaacugaucccggaauaccucaauuucauccgcggagucguagacagcgaggaccuaccacuaaacauaagcagagagaugcuacagcagaguaaaauccuaaaaguaauacggaaaaaccuugucaaaaagugccuggagcuauucaccgaacuugcagaggacaaagaaaacuacaagaaguucuacgagcaguucagcaagaauauaaaacuaggcauacacgaagacucacagaaccgcaagaaacuaagcgaacuccugagauacuacaccagcgccagcggggacgagauggucagccuaaaagacuacugcacaagaaugaaagaaaaccaaaaacacaucuacuauaucacgggagaaacaaaagaccaggucgcgaacucagccuucgucgagcgacuccgcaaacacgggcucgaaguaaucuauaugauagagcccauugacgaguacugcguacagcaacuaaaagaguucgaaggaaaaacccucguaagcgucacgaaagaaggccuagaacugcccgaagacgaagaggagaaaaagaaacaagaagaaaagaaaacaaaauucgaaaaccugugcaaaaucaugaaagacauccuggagaagaaaguggagaaaguagucguaagcaaccgccuaguaacgagcccaugcugcauagucacaagcacauacggauggacggcgaacauggagcgaauaaugaaagcccaagcccugcgagacaacagcacaaugggauacauggcggccaaaaagcaccuagaaaucaaccccgaccacuccaucaucgaaacacucagacaaaaagccgaagccgacaaaaacgacaaaagcguaaaggaccuggugauacuccuuuacgaaaccgcccugcucucaagcggcuucucccuggaggacccacagacccacgcgaacagaaucuacagaaugauaaagcugggccuaggaauagacgaagacgacccaacagccgacgacacauccgcagccgucaccgaagaaaugccaccccuagaaggggacgacgacacaagcagaauggaagaaguagacuaa

SEQ ID NO: 1054 - RNA, 339 nt, Artificial Sequence
  derived and/or modified CDS sequence (opt9) from Homo sapiens__NG_005218__HsHSP90AA3P
auggacucaucaaaacuagacuccggcaaaggccuacacauaaaccucguccccaacaaacaaaaccaaacccucaccaucguagacacacgcaucggcaugaccaaaaccgaccucaucaacaaccucggaaccgucaccaaauccggcacaaaagccuucauggaagcccuccaagcagacgcagacauauccaugaucggccacuucggaguaggcuucuacuccgccuaccucgucgccaaaaaagucaccgucaucucaaaacacaacaacgacgaacaauacaccugggaauccuccgcaggaggcagcuucaccguccgcaccgacgaauaa

SEQ ID NO: 1055 - RNA, 2175 nt, Artificial Sequence
  derived and/or modified CDS sequence (opt9) from Homo sapiens__NP_031381.2__HsHSP90AB1
augcccgaggaaguacaccacggagaagaggaagucgaaaccuucgccuuccaagcggaaaucgcccaacuaaugagcuugauaauaaacacguucuacuccaacaaagagauauuccugcgggagcuaauaucgaacgccagcgacgcccuagacaagaucagguacgagucccucaccgaccccagcaaacuagacucgggcaaggaacugaaaaucgacauaaucccgaacccgcaagagcgcacccucacccuaguggacacgggaauaggcaugaccaaagcagaccucauaaacaaccucggcaccauagccaagagcggaaccaaggccuucauggaagcacugcaagcaggagcagacauaaguaugaucgggcaauuuggcguaggguucuacucagcguaccucgucgccgaaaaaguaguagucauaacgaaacacaacgacgacgagcaauacgcgugggagucaagcgcaggagggagcuucaccguacgggcagaccauggcgaacccauaggcagaggcaccaaaguaauccuccaccuaaaggaagaccaaacagaguaccuagaagaacggagaguaaaagaagucgucaagaaacacucccaauucauaggcuaucccaucacacuauaccucgagaaagaacgagaaaaagaaauauccgacgacgaagccgaagaagaaaaaggggaaaaagaagaggaagacaaagacgacgaagaaaagcccaaaauagaagacguuggcucggacgaggaggacgacagcggcaaagacaagaaaaagaaaacgaagaaaauaaaagagaaauacaucgaucaagaagaacucaacaaaaccaaaccgaucuggacacggaaccccgacgauaucacgcaagaggaguacggcgaguucuacaaaucacuaacgaacgacugggaagaccaccucgcggucaagcacuucaguguggaaggccaacuagaguuccgagcgcuauuguucaucccaagacgcgcacccuucgaccucuucgaaaacaaaaagaagaaaaauaacauaaaacuguacguacgacggguguucaucauggacagcugcgacgaauugauaccggaauaccugaacuucauccgaggagucguggacucagaagaccucccacuaaacaucucccgagaaaugcuucaacagagcaaaauccuaaaagugaucaggaaaaacaucguaaagaaaugcuuagaacuauucagcgaacuagcagaggacaaagaaaacuacaagaaauucuacgaagccuucagcaaaaacuugaaacuaggcauacacgaagacagcacgaaccgaaggcgcuuguccgaacuacuacgcuaccacacgucccagagcggcgacgagaugaccagccugagugaauacgugagccgcaugaaagaaacgcagaaaagcauauacuacauaacaggcgaaagcaaagaacaaguagcgaacagugccuuugucgaaagaguacgaaaacgcggauucgaggucguauacaugacggaaccaauagaugaguacugcguccaacaacuaaaagaguucgacgggaaaagccuagucaguguuacgaaagagggccucgaacuacccgaagacgaggaggagaaaaagaaaauggaagaaagcaaagcaaaauucgaaaaccugugcaagcucaugaaagaaauauuggacaagaaagucgaaaaaguaacgaucucgaaucgacucguaucaucccccugcugcauagucacgagcacauacggauggacagcgaauauggagcggaucaugaaggcacaagcccuacgcgacaacagcaccaugggcuacaugauggcgaagaaacaccucgagauaaacccagaccacccgaucguggagacgcuaagacagaaagcagaagccgacaaaaacgacaaagccguaaaagaccuaguaguacugcuauucgaaacagcccugcucagcagcggauucucacucgaagacccgcaaacccacagcaaccgaaucuaccgcaugaucaagcucggacucggcaucgacgaagacgaaguagccgccgaagaaccgaacgcagccgucccugacgagauaccgccccucgaaggcgacgaggacgcaagccgaauggaggaaguagacuaa

SEQ ID NO: 1056 - RNA, 2412 nt, Artificial Sequence
  derived and/or modified CDS sequence (opt9) from Homo sapiens__NP_003290.1__HsHSP90B1
augcgagccuuauggguccucggacucugcugcgugcuacugaccuucggcagcguaagagcagacgacgaggucgacguagacggcacgguagaggaagaccucggcaaaucgcgagaaggcucacgcacagacgacgaaguaguccagcgagaagaagaagcgauacaacuugacgggcugaacgcgagccagauccgcgaacucagggagaaaagugaaaaauucgcauuucaggcagaaguuaacaggaugaugaagcuaaucauaaauucccuguacaaaaacaaagagaucuuccuacgggaacuaauaucaaacgccagcgacgcucuagacaaaaucagacuaauaagccuaacagacgaaaacgcacuaagcggaaacgaagaauugacagucaaaaucaagugcgacaaagagaaaaaccugcugcacgucaccgacacaggcgugggcaugacccgagaggaacucgucaaaaaccugggaacgauagcaaagucagggaccagcgaguuccucaacaaaaugacagaagcccaggaggacgggcagagcacgagcgaacugauagggcaauucggaguaggauucuacagcgcguuccugguagcggacaaagucauagucaccagcaaacacaacaacgauacccagcacaucugggagagcgacaguaacgaauuuagcguaaucgcagacccucgaggcaacacacuagggcgagggaccacaauaacacugguacuaaaggaagaagccagugacuaccucgagcuagauaccaucaagaaucucguaaagaaauacucacaauucaucaacuucccaaucuacgucuggagcagcaaaacagaaacgguugaagaaccuauggaggaagaggaagcggcaaaagaggaaaaggaagaaucagacgacgaggccgccguggaagaggaagaagaggaaaagaaaccaaaaacgaagaaaguggagaaaacaguaugggacugggaacugaugaacgacaucaagcccauauggcaaagaccaagcaaggaaguagaagaagacgaguacaaggcguucuacaaaaguuucuccaaggagucagacgaccccauggcauauauacacuucacggcagagggcgaagucacauucaagagcauacucuucgugcccaccucggcaccacgcggacuauucgaugaguacgggagcaagaaaagcgacuacauaaaacuauacgucaggaggguauucauaacggacgacuuccacgacaugaugcccaaguaccugaacuucgucaagggaguagucgauagcgaugaccuaccccugaacguaagcagggaaacccuacaacaacacaaacuucucaaaguaauccggaaaaagcucgugaggaagacccuagacaugauaaagaaaauagcggacgacaaauacaacgacacauucuggaaagaguucgggacaaacauaaaacuaggugugauagaggaccacagcaacaggacgagacuggccaaacuccuacgauuccaaucaagccaucaccccacagacaucacgagccuagaccaguacguagaaagaaugaaggaaaaacaggacaaaauuuacuucauggcaggguccagcagaaaagaggccgaaagcucccccuucgucgaaaggcugcucaagaaaggguaugaagucauauaccuaacagagccagucgaugaauacugcauacaggcacugccagaguuugacggcaagagauuccaaaacgucgcaaaagaaggagugaaauucgacgaaagugagaagaccaaagagagcagagaagccgucgagaaagaguucgaaccucuccucaacuggaugaaagacaaagcgcuaaaagacaagauagaaaaagcagucguaagccaacgacucacagaaagcccaugcgcgcuagucgccucgcaauacggauggucagggaacauggaaagaaucaugaaagcgcaagcguaccaaacugggaaagacauauccacgaacuacuacgccagccaaaagaaaacguucgaaaucaaccccaggcauccacugauaagggauaugcuacgcagaauaaaagaagacgaggacgacaaaacaguccucgaccucgcagucguccucuucgaaacggcaacccuuagaagcggcuaccugcugccagacaccaaagccuacggagacaggaucgagcgaaugcuacgacucucacuaaacauagacccggacgcaaaaguagaggaagaaccggaggaggagccagaagaaacagccgaagauacaacagaggacacggaacaagacgaagacgaagaaauggacguagguacagacgaggaagaagaaacagccaaagagagcacagcggagaaggacgagcuauag

SEQ ID NO: 1057 - RNA, 2115 nt, Artificial Sequence
  derived and/or modified CDS sequence (opt9) from Homo sapiens__NP_057376.2__HsTRAP1
auggcccgagaauuaagagcccuauuacucuggggacgucgucuccguccccuccuccgcgcaccagcccuagcagccguacccggcggcaaacccauucucugcccaagaagaaccacugcccagcuagggccccgacgaaaccccgcguggucgcuccaagcuggacgacucuucucaacccaaaccgcagaagacaaagaagaaccccuccacagcaucauaucuucaacagaauccguccaagguagcacauccaaacacgaguuccaagccgaaaccaagaaacuguuagauaucgucgcccgcucccucuacagcgaaaaagaagucuucauccgcgaacugaucucaaacgccagcgacgcccuagagaaacuacgccauaagcuagucucagacggccaagcacuacccgaaauggaaauucaccuccaaaccaacgccgaaaaaggcaccauaacaauccaagacaccggaaucggcaugacccaagaggaacucguaagcaaccucggcacuaucgcgcgcucagggucaaaagcauuccuagacgcuuuacaaaaccaggccgaggcuucauccaaaauaaucggccaauucggcguaggcuucuacucagccuucauggucgcggaucgcgucgaagucuacucccgcagcgcagccccagggagccuaggguaccaguggcucagcgacggcuccggcguauucgaaaucgccgaagccuccggagucagaacaggaaccaaaaucauaauucaccugaaaucugacugcaaagaguucagcuccgaagcacgcguucgagacguagucacaaaauacuccaacuucgucuccuucccacucuaccucaacggaagacgcaugaacacccuccaggccaucuggaugauggaccccaaggacguccgugaauggcaacacgaagaguucuaccgauacguggcacaagcccacgauaaaccacguuacacccuacacuacaaaaccgacgccccacucaacaucagaagcaucuuuuacguccccgacaugaaaccgucaauguucgacgucucccgugaacuaggauccuccgucgcacucuacucacgcaaaguccuaauccaaacuaaagccacagacauccuucccaaauggcuccgguucauacgcggcgucguggacucagaagacaucccccuaaaccucucccgcgaacuacuccaagaauccgcgcuaauccgaaaacuuagagacguacuacaacaacggcuaaucaaauucuucaucgaccagaguaagaaagacgccgaaaaauacgcuaaauucuucgaagacuacggacuauucaugcgagaaggcaucgucaccgccaccgaacaagaagucaaagaagauaucgcaaaacuccuacgcuacgagucuuccgcccuacccucaggacaacuuaccucacuaagcgaauacgccagccgcaugcgcgcgggcacacggaauauauacuaccuaugcgcacccaaccgacaucucgccgaacacagcccauacuaugaagccaugaagaagaaagacacugaaguccuauucugcuucgaacaauuugaugagcucacccuacuacaccuccgggaauuugacaaaaagaaacuaauauccgucgagaccgacaucgucguagaccacuacaaagaggaaaaauucgaggaccgcuccccagcagccgagugccuaagcgaaaaagaaaccgaagaacuaauggccuggaugcgcaacguucuaggcucaagaguaaccaacguaaaaguaacccuacgacucgacacccaccccgccaugguaaccguacucgaaaugggagcagcccgccacuuccuacgaaugcaacaacucgccaaaacacaggaggaacgagcccagcuccuacagccaacacucgaaaucaacccccgacacgcacucaucaagaaacucaaccaacuccgggcauccgaaccaggacucgcccagcuccuaguagaccagaucuaugaaaacgccaugaucgcugcaggccuagucgacgacccaagagcaaugguuggacgacuaaacgaacugcucgucaaagcccucgagcgccacuaa

SEQ ID NO: 1058 - RNA, 462 nt, Artificial Sequence
  derived and/or modified CDS sequence (opt9) from Homo sapiens__NP_000609.1__HsIGF1
augggcaaaaucuccucccuacccacccaacuauucaaaugcugcuucugcgacuuccuaaaagucaaaaugcacacaauguccucaucccacuuauucuaccucgcacucugccuccucacauucaccucauccgccaccgcaggccccgaaacccuaugcggcgccgaacucgucgacgcacuccaauucgucugcggcgaccgcggcuucuacuucaacaaacccacaggcuacggcuccuccucaagacgagcaccccaaaccggcaucguagacgaaugcuguuuccgaucaugcgaccuucgccgccucgaaauguacugcgcaccccucaaacccgccaaaucagcccgcuccguccgugcccaacgacacaccgacaugcccaaaacccaaaaagaaguccaccucaaaaacgccucccgcggcuccgcaggcaacaaaaacuaccgcauguaa

SEQ ID NO: 1059 - RNA, 543 nt, Artificial Sequence
  derived and/or modified CDS sequence (opt9) from Homo sapiens__NP_000603.1__HsIGF2
augggaauccccaugggcaaaucaaugcucguccuccucaccuuccucgccuucgccuccugcugcauagccgccuaccgacccuccgaaacacucugcggcggagaacucgucgacacccuacaauucgucugcggcgaccgaggcuucuacuucucccgacccgccucacgaguaucccgccgcucccgcggcaucgucgaagaaugcugcuuccgcucaugcgaccucgcccuccucgaaaccuacugcgccaccccagccaaauccgaacgagacgucuccaccccacccacaguacuucccgacaacuuuccccgauaccccguaggcaaauucuuccaauacgacaccuggaaacaaucaacccaacgacuccgccguggccuccccgcccuacuccgcgcacgccgcggacacguccuagcaaaagaacucgaagccuuccgcgaagccaaacgacaccgcccccucaucgcccuccccacccaagaccccgcccacggaggcgccccacccgaaauggccuccaaccguaaauaa

SEQ ID NO: 1060 - RNA, 639 nt, Artificial Sequence
  derived and/or modified CDS sequence (opt9) from Homo sapiens__NP_000591.1__HsIL6
augaacuccuucuccaccuccgccuucggccccgucgccuucucccucggccuccuccucguccuccccgccgccuuccccgcccccgucccccccggcgaagacuccaaagacgucgcugccccccaccgccaaccccuaaccuccuccgaacgcaucgacaaacaaauccgcuacauccuagacggcaucucugcacuccgaaaagaaaccugcaacaaaucuaacaugugcgaauccuccaaagaagcccuagccgaaaacaaccucaacuuacccaaaauggccgaaaaagacggcugcuuccaauccggcuucaacgaagaaaccugccucgucaaaaucaucaccggccuccucgaauucgaagucuaccucgaauaccuacaaaaccgauucgaauccucagaagaacaagcccgagccguccaaauguccaccaaaguccucauccaauuccuccaaaaaaaagccaaaaaccucgacgccaucaccacaccugacccaaccaccaacgccucacuccucacaaaacuccaagcccaaaaccaauggcuccaagacaugacaacacaccucauccuccgcuccuucaaagaauuccuucaauccucccucagagcccuccgccaaauguaa

SEQ ID NO: 1061 - RNA, 1281 nt, Artificial Sequence
  derived and/or modified CDS sequence (opt9) from Homo sapiens__NP_002183.1__HsINHBA
augccccuacucuggcuacgcggcuuccuacuagcaagcugcuggaucauaguaagaagcucacccaccccaggaagcgaaggacacagcgccgcgccagacugcccaucaugcgcacucgccgcccuccccaaagacguacccaacagccagcccgaaaugguagaagcagugaaaaaacacauacuaaacaugcuccaccuaaaaaagcgacccgacguaacccaacccgucccaaaagcagcacuacuaaacgcaaucagaaaacuccacguagggaaagucggcgaaaacggauacguagaaaucgaagacgacauaggaaggcgcgccgaaaugaacgaacucauggaacaaacgucggaaauaaucacauucgcagaaucagguacggccagaaaaacccuacacuuugagaucagcaaagaagggagcgaccuaagcgucgucgaaagagcagaggucuggcuguuccucaaaguuccaaaagccaacagaacacgcacaaaaguaacaauacgccuauuccagcaacaaaaacacccacaaggcagccuagacaccggagaagaggccgaggaaguaggacuaaaaggagaacggagcgaacuacuacuaagcgaaaaagucguagacgcccgcaaaagcacauggcauguauuccccguaagcagcuccauacaacgacuccuagaccaaggcaaaucaucacucgacguaagaaucgcgugcgaacaaugccaagaaagcggagccagccuuguacuacugggcaagaaaaaaaaaaaagaagaggaaggcgaagggaaaaaaaaaggcggcggagaaggaggcgccggagcagacgaagaaaaagaacaaagccacagacccuuccuaaugcugcaagcacgacagagcgaagaccacccccaccgcagacgccgacgcggacucgaaugcgacggaaaaguaaacaucugcugcaagaaacaauucuucgucagcuucaaggacauaggauggaacgacuggauaauagcaccgagcggcuaccaugcaaacuacugcgaaggcgaaugcccaagccacaucgcaggcacaagcggaagcagccuaagcuuccacagcaccgucaucaaccacuacagaaugcgaggacacagcccauucgccaaccugaaaagcugcugcgucccgacgaaacuaagaccaaugagcaugcuauacuacgacgacggccaaaacauaauaaagaaagacauacaaaacaugauaguagaagagugcggcugcagcuaa

SEQ ID NO: 1062 - RNA, 1224 nt, Artificial Sequence
  derived and/or modified CDS sequence (opt9) from Homo sapiens__NP_002184.2__HsINHBB
auggacggccuccccggccgagcacuaggcgccgcaugccuccuccuacucgcagccggauggcuuggccccgaagcauggggcuccccaacaccaccucccacccccgcagcaccacccccacccccaccacccggcucccccggcggcagccaggacacaugcaccucaugcggcggcuuccgacgccccgaagaacucggccgcgucgacggagacuuccucgaagccguaaaacgccacauccuuucccgccuccaaaugcgaggccgacccaacaucacucaugccguccccaaagccgccauggucaccgcccuacgcaaacuccacgccggcaaaguccgagaagacggccgcgucgaaaucccccaccucgacggccacgccagccccggcgccgacggccaagaacgaguuuccgaaaucaucuccuucgccgaaaccgacggccuugcauccagccgaguacgccucuacuucuucaucucaaacgaaggcaaccaaaaccucuucguaguacaagccucccuuuggcucuaucucaaacuccuacccuacguacuagaaaaaggcucucgccgcaaaguaagagucaaagucuacuuccaagaacaaggccacggcgaccgauggaacauggucgagaaacgcgucgaccuaaaacgcuccgguuggcacacauucccccucaccgaagcaauccaagcccucuucgaacgaggggaacgccgccucaaccuagauguccaaugcgacagcugccaagaacuagccgucguccccgucuucgucgaccccggcgaggaaucccaccgacccuucgucgucguccaagcacgacucggcgacucucgccacagaauacguaaacgaggacucgaaugcgacggccgcaccaaccucugcugcagacaacaauucuucaucgacuuccgccucauuggauggaacgacuggaucauagcacccacuggauacuacggcaacuacugcgaaggcuccugccccgcauaccucgcaggaguccccggaagcgcauccucuuuccacaccgcaguagugaaccaauaccgcaugcgcggccucaaccccggaaccgucaacagcugcugcauccccaccaaacuuuccaccaugagcaugcucuacuucgacgacgaauacaacaucguaaaacgagacguccccaacaugauaguagaagaaugcggaugcgcauaa

SEQ ID NO: 1063 - RNA, 3459 nt, Artificial Sequence
  derived and/or modified CDS sequence (opt9) from Homo sapiens__NP_000623.2__HsITGAM
auggcacuaaggguacuccuccucaccgcccucacacucugccacggauucaaccucgacacugaaaacgcaaugacauuccaagaaaacgcgcggggcuucggacaaucagugguccagcugcaagguagccgcgucgucgugggcgccccgcaagagaucguagcagccaaccagcgcggcucucuauaucaaugcgacuacucaacuggcaguugcgaacccaucagacuacaagucccagucgaagcugucaacaugagccuuggacuaucgcuagccgcaacaaccucgccuccucaacuccucgccugcggcccaaccguccaccagaccugcuccgagaauaccuacgucaaaggccucugcuuuuuguucggcucuaaccugcgccaacaaccgcaaaaauucccggaagcccugcgaggcugcccccaggaagacucagacauagcuuuccuaauugacggguccggcuccaucauaccccacgacuuccgucgaaugaaagaguucguaucaacuguaauggaacaacucaagaaaucuaaaacgcuguucucacucaugcaauacagcgaagaguucaggauccacuucaccuucaaagaguuccaaaacaacccaaacccacgcucgcucgucaagccaauaacccaacuccucggcagaacccauacagcuacaggcauccgaaaagucgucagagaacucuucaacaucaccaacggcgcccggaaaaaugccuucaaaauccuuguagucaucaccgacggugaaaaauucggcgauccucuuggauacgaagacguaauuccugaagccgacagagaaggagugauucgauacgucaucggagugggcgacgcauuccgcagugaaaagucccgacaagaacugaacaccaucgccuccaaaccuccccgagaccacguuuuccaaguaaacaacuucgaagcacucaagaccauccaaaaccaacugcgcgagaaaauauucgcaaucgaaggcacgcaaaccggguccaguucauccuucgaacacgaaaugucccaggaaggauuuuccgcagcgaucacuuccaacggacccuuacuauccacagucggcucguacgacugggccggcggcguauuccuauacaccagcaaagaaaaauccaccuucaucaacaugacccgggucgacagcgacaugaacgaugccuaccucggguaugcagccgcaauuauacuaaggaaccgcguucaaucccucguacugggagcaccccgcuaccagcacauaggccuaguggcuauguuccgucaaaacacaggcaugugggaauccaaugccaacguuaagggcacgcaaauaggagccuacuucggcgccucucuaugcuccguagacguagacuccaacggauccacagaccuaguacugaucggcgcaccccacuacuacgaacaaaccagaggcggacaagucucaguguguccacucccccgcggucgagcacgauggcaaugugaugccguccuauacggcgaacagggacaaccguggggccgcuuuggagcugcccucaccguccucggcgauguaaacggugacaaacucacugauguagccauaggcgcccccggagaagaggauaacagaggagccgucuaccuauuccacggcaccucaggaagcgggaucagcccaucccacucccaacgcauagcgggcucaaagcuaucgccucgccugcaguacuuuggccaaagccucuccggcggccaagaccucaccauggacggucuaguagaccucacaguaggagcccaaggacauguacuccuccuucgcucgcagcccguacucagaguaaaggccaucauggaauuuaauccaagagaagucgcccgaaacguauucgaaugcaacgaucaggugguuaaagguaaagaagccggugagguacgcguaugucuccacguacaaaaaucgacccgggacagacuucgcgaaggacaaauccaaucaguagucaccuacgaccucgcucuagacuccggucguccccauucacgagccguguucaacgaaaccaaaaacucuacaagacgccaaacucagguacucggcuugacacaaacuugugagaccuuaaaacuucagcugccaaacuguaucgaggaccccgucuccccaaucguacugcggcuuaacuucucucucgucggcacaccccuuuccgcguucgguaaccugagacccguccucgcagaagacgcccaacgacucuucaccgcacucuuccccuuugagaaaaacugcggcaacgacaacaucugccaagaugacuuaagcauuacauucucauuuaugagccuagacugucucguaguaggcggaccccgggaauuuaacgucacuguaaccgugcgcaacgacggugaagacuccuacaggacgcaagucacauucuucuucccccucgacuuaagcuaccguaaagucagcacccuucagaaccagcguucucaacgauccuggaggcuugcgugcgaaucagcuagcucaaccgaggucuccggcgcgcucaaauccaccucaugcuccaucaaccaccccaucuuccccgaaaacagcgaaguuaccuucaacauaaccuucgacguagacuccaaggcaucacuaggaaacaaacuccuccucaaggccaacguaaccuccgagaauaacaugccacgcacgaauaaaacagaguuccaauuggaacuccccguaaaauacgcgguauacauggucgucacuucucacggaguaucuaccaaauaccuaaacuuuacagccuccgaaaacacaagccgaguaaugcagcaucaauaccaagugucaaaccugggacaaagaucgcuaccuaucucacucgucuuccugguaccggucaggcuuaaccaaacggucauaugggaccgcccccaaguaaccuuuucagaaaaccucuccagcacaugccacaccaaagaaaggcucccaucacauagcgacuuccuagcagagcuccgcaaggcgcccgucguuaacugcuccauagcagugugccaacgcauccagugcgacauaccauucuuuggcauccaggaggaguucaacgcaacccucaagggaaaccucucuuucgacugguacauaaaaacuucccacaaucaccuccuaaucgucuccaccgcagaaauccucuucaacgacagcguauucacccuacuaccaggccagggagcguucguccggagccaaaccgaaaccaaaguggaaccauuugaaguacccaaccccuuaccccuaaucgucggguccucagucggcggccuacuacuucucgcuuuaaucaccgccgcccucuacaaacuaggcuuuuucaaaagacaauacaaagacaugauguccgaaggaggcccacccggggccgaaccgcaauaa

SEQ ID NO: 1064 - RNA, 1404 nt, Artificial Sequence
  derived and/or modified CDS sequence (opt9) from Homo sapiens__NP_002415.1__HsMMP8
auguucagccucaaaacgcuccccuuccuccuacuccuccacguccaaauaucuaaagccuuucccgucuccucuaaagaaaagaacacaaaaacaguacaagacuaccuggaaaaauucuaccaacucccauccaaccaauaccagucaacccgcaaaaacggcaccaacguaaucgucgaaaaacucaaagaaaugcaacgcuucuucggacucaacgucacugguaaaccaaacgaagaaacccucgacaugaugaaaaagccgagaugcggcguaccagacuccggcggcuuuaugcucacccccggaaacccgaaaugggaacgcaccaaccucaccuaccgcauacgaaacuacacaccccaacucucugaagccgaagucgaacgugccaucaaagacgccuucgaacucuggucaguagccuccccacucauuuucacacgaaucucccaaggugaagccgacaucaacaucgccuucuaccaacgagaccacggcgacaauucccccuuugacggcccaaacggaauacuagcccacgccuuccaacccggucaaggcaucggcggcgacgcccacuucgacgcagaagaaaccuggaccaauaccuccgcaaacuacaaccucuuccucgucgcagcccacgaauuuggacacucacucggccucgcacacucuagcgaccccggcgcccucauguaccccaacuacgccuuccgagaaaccuccaacuacucacucccgcaagacgacaucgauggaauccaagccaucuacggccucuccuccaacccaauccaacccacuggccccucaacccccaaacccugugacccaucccucacauucgacgccauuaccacccuccgcggggaaauccucuucuucaaagaucgcuacuucuggcgccgacacccccaacuacaacgcgucgaaaugaauuucaucucccucuucuggcccucccucccuaccggcauucaagccgccuacgaagacuucgaucgcgaccuuauuuuucucuuuaaaggcaaccaauacugggcccucucgggcuacgacauccuacaaggauaccccaaagacaucuccaacuacggauuccccucuuccguccaagcuauagacgccgccgucuucuaccgauccaagacauacuucuucgucaaugaccaauucuggcgauacgacaaccaacgacaguucauggaacccggguaccccaaauccauuuccggagccuucccaggcaucgaauccaaagucgacgccgucuuccagcaagaacacuucuuccacgucuucucaggcccccgcuacuacgccuucgaccuaaucgcccaacgcgucacccgcgucgcccgaggcaacaaauggcucaacugcagauacggauaa

SEQ ID NO: 1065 - RNA, 2124 nt, Artificial Sequence
  derived and/or modified CDS sequence (opt9) from Homo sapiens__NP_004985.2__HsMMP9
augagccuguggcaaccccucguccucguccuucuuguccucgguugcuguuucgccgcaccccgccaacgacaguccacccucguccucuuccccggagaccuccgcacaaaccuaacugaccgccagcucgccgaagaauaucuuuaccgcuacggcuacacccgcgucgcagaaaugagaggcgaauccaaaucucuggggcccgcccuccuccuccuccaaaaacagcucucccuccccgagaccggagaacuugacuccgccacccucaaagcaaugcgaacaccacgcugcggcgucccagaccucggccgcuuccaaacguucgaaggcgaccuaaaauggcaucaucacaacauuaccuacuggauccaaaacuacuccgaagaccucccccgcgccguaauagacgacgccuucgccagagccuucgcgcucugguccgccgucaccccacuaacauucacccgcgucuacucacgcgacgccgacauagugauucaauucggugucgcugaacacggggacggcuaccccuucgacggaaaagacggccuacuggcccacgcauucccacccggacccggaauccaaggugacgcccacuuugacgacgacgagcuuuggucccuaggaaagggcgucguagucccaacacgcuucggaaacgcagacggcgccgcuugccacuuccccuucauauucgaaggaagguccuacucagcaugcaccaccgacggccgaucagacggccucccguggugcucgaccacagcgaacuacgacacagaugaccgcuucggcuucugccccucagaacgacuauacacccaggacggcaacgccgacggaaaacccugccaauucccauucauauuccagggucagagcuacuccgccuguacgacggacggcagaagcgauggcuaccgcuggugcgcaaccacagcgaacuacgaccgagacaaacuuuucgguuucuguccaacccgcgcagacuccaccguaaugggcggcaacagcgccggagaacuaugcgucuucccauucaccuuccucggaaaagaauacuccacuuguaccucggaaggcagaggcgacggaagacucuggugugcuacaaccucaaacuucgacuccgacaagaaauggggcuucugccccgaucaaggcuacagucuauuccucgucgcagcccacgaguucggacacgcccucgggcucgaccacuccuccguacccgaagcgcuaauguacccaauguacagguuuaccgaaggaccaccccuacacaaagacgacgucaacggaauccgccaccuuuacggcccccgccccgaacccgaaccucguccacccaccacaacaacaccccaacccaccgcaccgccaaccguaugucccacggggcccccuaccguccacccgagcgaaagacccacagcaggcccuaccgguccacccucagcaggacccacaggacccccuacugccggccccucuacagccacuacugucccccuaagcccaguugacgacgcaugcaacguaaacauauuugacgcaaucgccgaaaucggcaaccaacuuuaccuauucaaagacgguaaauacuggcgauucuccgaaggacgcggaagucgcccccagggcccauuccuaaucgcagacaaauggccagcccuaccgagaaaacuagauucagucuucgaagaaagacuaagcaagaaacucuucuucuuuucuggccgacaaguauggguauacacaggagccagcguacuaggccccagaagacucgacaaacuaggccuaggagcagacguugcacaaguaaccggagcucuccguuccggcagaggcaaaaugcuauuguucucuggccgcagacuuuggcgcuucgacgucaaagcucaaaugguagacccccgauccgcauccgaggucgaccgcauguuccccggcguccccuuagacacacacgacguuuuccaguaccgagagaaagccuacuucugccaagaccgcuucuacuggagaguaagcagcagguccgaacucaaccaaguagaccaagucggauacguaacauacgacauccuccaaugcccagaagacuga

SEQ ID NO: 1066 - RNA, 1416 nt, Artificial Sequence
  derived and/or modified CDS sequence (opt9) from Homo sapiens__NP_002418.1__HsMMP13
augcaccccggaguccucgccgcauuccuauuccucuccuggacccacugccgagcccuaccccucccauccggcggagacgaagaugaccucuccgaagaagaccuccaauucgcagaacgcuaccuucgcuccuacuaccacccaaccaaucucgcaggcauccuaaaagaaaacgccgcauccucaaugaccgaacgccuccgagaaaugcaauccuucuucggccucgaagucaccggcaaacucgacgacaacacccucgacguaaugaaaaaaccuagaugcggagucccagacgucggagaauacaacguauucccccguacccugaaauggucaaaaaugaaccucacguacaggaucguaaacuacacccccgacaugacccauagcgaagucgaaaaagccuucaaaaaagccuucaaagucugguccgacgucacuccacuaaacuucacccgucuccacgacggcauagccgacaucaugauauccuucggaaucaaagagcacggcgacuucuaccccuucgacggacccagcggucuccucgcacacgccuuccccccgggccccaacuacggcggagacgcccacuucgaugacgacgagaccuggacauccuccucaaagggcuacaaccucuuccucgucgccgcccacgaauucgggcacucacuuggacucgaccauuccaaagaccccggagcccucauguucccaaucuacacauacaccggcaaaagucacuucaugcuccccgacgacgacguccaaggaauucaaagccucuacggccccggcgaugaagaccccaaccccaaacaucccaaaacacccgacaagugcgacccuucccucagccucgacgcaaucaccucacucagaggcgaaaccaugauauucaaagaccgauucuucuggcgacuccacccgcaacaaguagacgccgaacuauuccuaaccaaauccuucuggccagaacuaccuaaccgaaucgacgccgccuacgaacaccccagccacgaccucaucuucaucuuccgcggcagaaaauucugggcccucaacggcuacgacauccucgaaggcuaccccaaaaaaauaucugaacucggccucccaaaagaagucaaaaaaauauccgccgccguccacuucgaagacaccggcaaaacccuacucuuuagcggcaaccaagucuggcgauacgacgacacgaaccacaucauggacaaagacuacccucgccucaucgaagaagacuucccaggaaucggcgauaaaguagacgcgguuuacgaaaaaaacggcuacaucuacuucuucaacggcccaauacaauucgaauacuccauaugguccaaccgaauagucagagugaugccagcaaauucaauccucuggugcuaa

SEQ ID NO: 1067 - RNA, 1068 nt, Artificial Sequence
  derived and/or modified CDS sequence (opt9) from Homo sapiens__NP_001286.1__HsCCR1
auggaaacccccaacacaaccgaagacuacgacaccaccacggaguucgacuacggcgacgccacccccugccaaaagguaaacgaacgagccuucggcgcacaacuucucccaccccuguacucccuaguguucguaauaggccucgucggcaauauccuagucguauuaguccucguccaauacaaacgccucaagaacaugaccucuauauaccuacucaaccuagcaaucuccgaccuccuuuuccuguucacccuccccuucuggaucgacuauaaacucaaagacgauugggucuucggagacgccaugugcaaaauccucuccggcuucuauuauaccggucucuacuccgaaaucuucuucauaauccuccucaccaucgacagauaucucgccauaguccacgccgucuuugcacuccgcgcccgcaccgucaccuucggugucaucaccuccaucauaaucugggccuuagccauccucgccuccaugcccggacucuacuuuuccaaaacccaaugggaguucacccaccauaccugcucccuccacuucccccacgaaucccuacgcgaauggaaacucuuccaagcacuaaaacuaaaccucuuuggccucguccuuccccuccuagucaugaucaucugcuacacaggcaucaucaaaauccuacuucgucgcccuaaugaaaagaaauccaaagccguccgacucaucuucgucaucaugauaaucuuuuuccucuucuggacacccuauaaucucaccauccucaucucugucuuccaagacuuccucuucacacacgaaugcgaacaaucccgccaccuagaccucgccguccaagucaccgaagucaucgcauacacccacugcugcgucaaccccgucauauacgcauucgucggcgaacgcuuccgcaaguaccuccgccaacucuuccaccgacgcgucgcaguccaucucgucaaaugguuacccuuucucucugucgaccgccucgaacgcguauccucaacaucacccuccaccggcgaacaugaacuuucagccggcuucuaa

SEQ ID NO: 1068 - RNA, 636 nt, Artificial Sequence
  derived and/or modified CDS sequence (opt9) from Homo sapiens__NP_002598.4__HsPDGFA
augcgaacccucgccugccuccuccuccucggcugcggcuaccucgcccacguacucgccgaagaagcagaaaucccccgcgaagucaucgaacgccucgcacgcucccaaauccacuccauccgugaccuccaacgacuccuggaaaucgacuccgucggauccgaagacucccuagacaccucccuaagagcccacggcguacacgccacaaaacacguccccgaaaaacgaccccuccccauccgcagaaaacgauccauagaagaagccguccccgccguaugcaaaacacgcacagucaucuacgaaauaccccgcucccaagucgacccaaccuccgccaacuuccuaaucuggccccccugcgucgaagucaaacgcugcaccggcugcugcaacaccuccucagucaaaugccaacccagccgcguccaccaccgcagcgucaaagucgcaaaagucgaauacguacgcaaaaaacccaaacucaaagaaguccaagucagacucgaagaacaccuagaaugcgcaugcgccaccaccagccuaaacccagacuaccgcgaagaagacaccggccgaccccgcgaauccggcaaaaaacgcaaacgcaaaagacuaaaacccaccuaa

SEQ ID NO: 1069 - RNA, 726 nt, Artificial Sequence
  derived and/or modified CDS sequence (opt9) from Homo sapiens__NP_002599.1__HsPDGFB
augaaccgcugcugggcccuauuccuaagccuaugcugcuaccuccgccuagucucggccgagggcgaccccauccccgaagaacucuacgaaaugcucagcgaucacucaauccgcuccuucgacgaccuccaacgccuccuccacggcgaccccggcgaagaagacggagccgaacuagaccucaacaugacacgcucacacuccggaggggaacucgaaucccucgcacgcggccgccgcagccuaggcucacuaacaaucgccgaaccagcaaugaucgccgaaugcaaaacaagaacagaagucuucgaaaucucacgccgccuaaucgaccgcaccaacgccaacuuccuagucuggccacccugcgucgaaguccaaagaugcuccggaugcugcaacaacagaaacguccaaugccgccccacccaaguccaacuccgaccaguacaaguaagaaaaauagaaaucguccgcaaaaaacccaucuucaaaaaagcaaccguaacccucgaagaccaccucgcaugcaaaugcgaaaccgucgccgcagcccgccccgucacccgcagccccggcggaagccaagaacaacgagcaaaaacaccccaaaccagagucaccauccgaacaguccgcguacgcagaccccccaaaggaaaacaccgcaaauucaaacacacacacgacaaaaccgcccuaaaagaaacccuaggcgccuaa

SEQ ID NO: 1070 - RNA, 1038 nt, Artificial Sequence
  derived and/or modified CDS sequence (opt9) from Homo sapiens__NP_057289.1__HsPDGFC
augucccucuucggccuacuccuccuaacaucugcacucgccggccaacgccaaggcacccaagccgaauccaaccucagcucuaaauuccaauucuccucaaacaaagaacaaaacggcguccaagacccccaacacgaacgcauaaucacagucucaaccaacggcuccauccauucaccccguuucccccacaccuacccccgcaacaccguccuaguauggcgccuaguagcaguagaggaaaacgucuggauccaacucaccuucgacgaacgcuuuggacucgaagauccagaagacgauaucugcaaauacgacuucgucgaaguagaagaaccuuccgacggcacaauccuaggccgauggugcggcuccggcaccgucccaggcaaacaaauauccaaaggcaaccaaauccgcauccgcuucgucuccgacgaauacuuccccuccgaacccggcuucugcauccacuacaacaucgucaugccccaauucaccgaagccgucucccccuccguccucccacccuccgcacucccccuagaccugcucaacaacgccaucaccgccuucucaacccucgaggaccucauacgcuaccuagagcccgaacgcuggcaacucgaccucgaagaccucuaccgcccaacauggcaacuccucggcaaagccuucgucuucggccgcaaaucccgcguagucgaccuaaaccuacuaaccgaagaaguacgccucuacagcugcacaccacgcaacuucucagucuccauccgcgaagaacucaaacgcaccgacaccaucuucuggccaggcugccuccuaguaaaacgcugcggcgggaacugcgccugcugccuccacaacugcaacgaaugccaaugcgucccauccaaagucaccaagaaauaccacgaagugcuacaacuaagaccaaaaaccggcguccgcggacuccacaaaucucucaccgacguagcccuagaacaccacgaagaaugcgacugcgucugccgcggcuccaccggcggcuaa

SEQ ID NO: 1071 - RNA, 1095 nt, Artificial Sequence
  derived and/or modified CDS sequence (opt9) from Homo sapiens__NP_149126.1__HsPDGFD
augcaccgccucauauuugucuacacacugauaugcgccaacuucuguucaugccgcgacaccuccgccaccccccaaucugccuccauaaaagcccucagaaacgccaaccuacgacgcgacgaccucuaccgacgcgacgaaacaauacaagucaaaggcaacggcuacguacaauccccacgcuuccccaacuccuacccccgcaaccuccuccucaccuggcggcuacacucccaagaaaacacccgcauacagcuuguauucgacaaccaauucggccuagaagaagccgagaacgacaucugccgauacgacuucgucgaagucgaagacaucagcgaaaccuccaccaucaucagaggaagauggugcggccacaaagaaguccccccucgaaucaaaucccgcacaaaccagauaaaaauaacauucaaauccgacgacuacuucgucgccaaacccggcuucaaaaucuacuacucccuccucgaagauuuccaacccgccgccgccuccgaaacaaacugggaauccgucaccuccuccauauccggugucucauacaacuccccaagcgucacagacccaacccucauugcagacgcacuagacaaaaaaaucgccgaauucgacaccgucgaggaccuccuaaaauacuucaaccccgaauccuggcaagaagaccucgaaaacauguaccucgacacaccccgcuacagaggccgcuccuaccacgaccgcaaauccaaggucgaccucgaccgccucaacgacgacgccaaacgcuacagcugcacaccccgcaauuacagugucaacaucagagaggaacuaaaacuagccaacguagucuucuucccacgcugccuacuaguacagcgaugcggcggcaacugcggcugcggcaccgugaacuggcgguccugcaccuguaacuccggcaaaacaguaaaaaaauaucacgaaguccuacaguuugaacccggacacaucaaacgccguggccgcgccaaaacuauggcccucguugacauccaacucgaccaccacgaacgcugcgacugcauaugcucuucccgcccaccccgauaa

SEQ ID NO: 1072 - RNA, 678 nt, Artificial Sequence
  derived and/or modified CDS sequence (opt9) from Homo sapiens__NP_003946.3__HsSOCS3
auggucacccauucaaaauuccccgccgccggcaugucccgcccccucgacaccucccuccgccucaaaacauucuccuccaaauccgaauaccaacucgucgucaacgccguccgcaaacuccaagaauccggcuucuacuggucugccgucaccggaggcgaagccaaccuccuacuaucagccgaaccagcuggcaccuuccuaauccgugacuccuccgaccaacgccacuucuucacccucucagucaaaacccaauccggcaccaaaaaccuccgcauccaaugcgaaggcggauccuucucccuacaauccgacccccgcucaacucaaccagucccccgauucgacugcguccucaaacucguccaccacuacaugcccccacccggagcccccuccuuccccuccccacccaccgaacccuccuccgaaguccccgaacaacccuccgcccaaccccuccccggaucaccaccccgccgcgccuacuacaucuacuccggcggcgagaaaaucccccuaguccucucccgcccacucucauccaauguugccacccuacaacaccucugccguaaaaccguaaacggacaccuagacuccuacgaaaaaguuacccaacuacccggccccauccgcgaauuucucgaccaauacgaugcaccccucuaa

SEQ ID NO: 1073 - RNA, 483 nt, Artificial Sequence
  derived and/or modified CDS sequence (opt9) from Homo sapiens__NP_003227.1__HsTGFA
augguccccuccgccggccaacuagcccucuucgcccuaggcaucguccucgcagccugucaagcacucgaaaacuccaccuccccccucucagccgacccacccguagccgcagccguagucucccacuucaacgacugccccgacucccacacccaauucugcuuccacggaaccugccgauuccucguccaagaagacaaacccgccugcguaugccacuccggcuacgucggcgcccgcugcgaacacgccgaccuccuagccguaguagccgccucacaaaaaaaacaagccauaaccgcacucguagucgucuccaucgucgcccucgccguccuuauaauaaccugcguccucauccacugcugccaaguacgcaaacacugcgaauggugccgcgcccucaucugcagacacgaaaaacccuccgcacuacucaaaggccgcaccgccugcugccauuccgaaaccguaguauaa

SEQ ID NO: 1074 - RNA, 1173 nt, Artificial Sequence
  derived and/or modified CDS sequence (opt9) from Homo sapiens__NP_000651.3__HsTGFB1
augccaccauccggccuacgucuccucccucuccuccugccacuccucuggcuauuaguccuaacaccaggccgcccagccgccggccucucaaccugcaaaacuaucgacauggaacuugucaaacgcaaacgaauagaagccauccgcggccaaauccuauccaaacuccgccucgccuccccacccucacaaggcgaaguaccacccggaccccuacccgaagccguccuugcacucuauaacuccacccgcgaccgaguugcuggagaaucagccgaacccgaaccagagccagaagccgacuacuacgccaaagaagucacccgcguacucauggucgaaacacacaacgagauauacgauaaauucaagcaauccacccacuccauauacauguucuucaacaccucagaacuacgagaagccguccccgaacccguccuacuaucacgagccgaacuucgucuccuccgacucaaacucaaggucgaacaacacgucgaacucuaccaaaaauauucaaacaacucauggcgcuaccuaucaaaccgccuacuagcaccaucagacucacccgaauggcuaucauucgacgucaccggagucguccgccaauggcuaucacgaggaggcgaaaucgaaggcuucagacucucagcccacugcuccugcgacucccgagacaacacccuccaagucgacaucaacggcuucaccaccggccgacgcggagaccucgccacaauacacggaaugaaccgacccuuccuacuccucauggcaacaccacucgaacgcgcccaacaccuccaaucuucccgccaccgccgagcccuggacaccaacuacugcuucuccuccacugagaaaaauugcugcgugagacaacucuacaucgacuuccgcaaagaccucggcuggaaauggauccacgaaccaaaaggcuaccacgcaaacuucugccucggccccugcccauacauauggucccuagacacccaauacuccaaaguucuagcccuauacaaccaacacaaccccggcgccuccgcggcucccugcugcguuccccaagcccucgaaccccucccaauagucuacuacgucggccgcaaaccaaaagucgaacaacucuccaacaugaucguccgauccugcaaaugcuccuaa

SEQ ID NO: 1075 - RNA, 1245 nt, Artificial Sequence
  derived and/or modified CDS sequence (opt9) from Homo sapiens__NP_003229.1__HsTGFB2
augcacuacugcguacucucagccuuccucauccuccaccucgucaccgucgcacuaucacuaucuaccugcagcacacucgauauggaccaauucaugcgcaaacgcauagaagcuauccguggccaaauccuauccaaacucaagcucaccagcccacccgaagacuauccugaacccgaagaagucccacccgaaguaaucuccaucuacaacuccacacgcgaccuccuacaagaaaaagccucccgacgcgcagccgccugcgaacgagagcgcuccgacgaagaauacuacgccaaagaaguauacaagauagacaugccacccuucuucccuuccgaaaacgccauacccccaaccuucuaccgcccauacuuccgcaucguccgcuucgacgucucugcuauggagaaaaaugcauccaaccucgucaaagccgaguuccgcguauuccgccuacaaaaccccaaagcgcgcgucccugaacaacgcaucgaacucuaccagauccucaaauccaaagaucuuaccucgcccacacaacgcuacaucgacuccaaagucguaaagacccgcgccgaaggagaauggcucuccuucgacguaaccgacgccguccacgaauggcuacaccacaaagaccgcaaccucggcuucaaaaucucccuacacugccccugcugcaccuucguccccuccaacaauuacaucauccccaauaaauccgaagaacucgaagccagauucgccggcaucgacggcaccucaaccuacacauccggcgaccagaaaaccaucaaaucaacccgcaagaaaaacuccggcaaaaccccacaucuccuccucaugcuucucccuucauaccgucucgaaucucaacaaaccaaccgacgcaagaaacgcgcccucgacgccgccuacuguuuccgcaacguccaagacaacugcugccuacgaccccucuacauagacuucaaacgcgaccucggcuggaaauggauccacgaacccaaaggcuacaacgcuaacuucugcgcgggcgccugccccuaccuaugguccuccgacacccaacacucacgcguccucucccucuacaacaccaucaauccugaagccuccgccucacccugcugcgucucccaagaccucgaaccacucaccauacuauacuacaucggcaaaacgccuaaaauagaacaacuaucuaacaugaucgucaaauccuguaaaugcagcuaa

SEQ ID NO: 1076 - RNA, 1239 nt, Artificial Sequence
  derived and/or modified CDS sequence (opt9) from Homo sapiens__NP_003230.1__HsTGFB3
augaaaaugcaccuccaacgcgcccuagucguacucgcacuacucaacuuugccaccguaucacuuucacucuccacaugcaccacacucgacuuuggccacaucaaaaagaaacgagucgaagcuauacgaggccaaauccuaucaaaacuacgccucacauccccacccgaacccacaguaaugacccacguccccuaccaaguacucgcccuauacaacuccacccgcgaacuccuagaagaaaugcacggagaaagagaagaaggaugcacccaggaaaacaccgaaucagaauacuacgccaaagaaauacacaaauucgacaugauccaaggccucgccgaacacaacgaauuagccgucugccccaaagguaucacuagcaaaguauuccgauucaacguuuccucggucgagaaaaaccgcaccaaccuauuccgagccgaguuccguguccuccgcguccccaacccaagcucaaaacgcaacgaacaacgcaucgaacuuuuccaaauacuaagacccgacgaacacaucgccaaacaacgcuacauaggcggcaaaaaccucccaacccgcggcaccgcagaauggcucucuuucgacgucaccgacaccguacgugaauggcuacucagacgcgaauccaaccuaggucuagaaaucucaauacacugccccugccacaccuuccaaccaaacggagacauccucgaaaacauccacgaagucauggaaaucaaauucaaaggagucgacaaugaagacgaccacggacgaggcgaccucggacgacucaaaaagcaaaaagaccaccacaacccccaccucauccuaaugaugaucccaccccaccgccucgacaaccccggacaaggcggccaacgcaagaaacgcgcccucgacaccaacuacugcuuccgcaaccuagaagaaaacugcugcguacgcccccucuacaucgacuuccgacaagaccuaggcuggaaauggguccacgaacccaaaggauacuacgcaaauuucugcagcggaccaugcccauaccuacgguccgccgacacaacccacuccacaguccuaggacuuuauaacacccuaaacccagaagccuccgccucccccugcugugucccccaagaccuugaaccucucaccauccuuuacuacgucggcagaacccccaaagucgaacaacuauccaacauggucgucaaauccugcaaaugcuccuaa

SEQ ID NO: 1077 - RNA, 1386 nt, Artificial Sequence
  derived and/or modified CDS sequence (opt9) from Homo sapiens__NP_001057.1__HsTNFRSF1B
auggcacccguugcagucugggcagcccuugccgucggccucgaacucugggccgcugcccacgcccuccccgcccaaguugccuucacuccuuacgccccagaaccaggcuccacaugccgacuccgagaauacuaugaccaaacagcccaaaugugcugcuccaagugcucccccggccaacacgccaaagucuucuguaccaaaaccucugacaccgucugcgacuccugcgaagacuccacuuacacccaacuauggaacuggguacccgaaugccucuccugcggcuccagaugcucauccgaccaagucgaaacccaagcaugcacacgcgaacaaaaccgaaucugcacaugcaggcccggaugguacugcgcacucuccaaacaagaaggcugccgccucugcgcaccccuccgaaaaugccgaccaggcuucggcgucgcccgcccaggaacagaaaccuccgacguagucugcaaacccugcgccccuggcacuuucuccaacacaaccagcucaaccgacauaugccgcccacaccaaaucugcaacgucguugcaauacccggcaacgcauccauggacgccgucugcaccuccacaucgcccacccgauccauggcacccggcgccguccaccucccccaaccugucucaacccgaucacaacacacacaacccacccccgaacccucaaccgccccauccaccucauuccuucuacccaugggccccuccccacccgccgaaggcuccaccggagacuucgcccucccagucggccuaaucgucggcgucaccgcccuaggccugcucaucaucggagucgucaacugcguaaucaugacccaagucaaaaagaagccccuaugucuccaaagagaagcaaaaguaccucaccuccccgccgacaaagcccgcggcacacaaggccccgaacaacaacaccuccuaaucaccgccccaucauccuccucaucaagccucgaaucaucagcaucagcucucgaccgccgcgccccaaccagaaaccaaccccaggccccaggcguagaagccuccggagccggagaagcccgagccucaacaggcuccuccgacagcucucccggcggccacggcacacaaguaaacguaaccugcaucgucaauguaugcucgucauccgaccauuccucccaaugcucaagccaagccucaucaaccaugggcgacaccgacucaagcccaucugaaucccccaaagacgaacaaguacccuucaguaaagaagaaugugccuuccgaucccaauuagaaacccccgaaacacuccuaggauccaccgaagaaaaacccuuaccccucggugucccagacgccggcaugaaacccuccuaa

SEQ ID NO: 1078 - RNA, 513 nt, Artificial Sequence
  derived and/or modified CDS sequence (opt9) from Homo sapiens__NP_002623.2__HsPGF
augccggucaugcgcuuguucccgugcuuucuacagcucuuggcagggcucgcacucccagccgugcccccgcaacagugggcguuaucggccgggaacgggagcucggaaguggaagugguaccguuccaggaagugugggggcgcucguacugucgcgcgcuagagcgccuggucgaugucgugagugaguacccgagcgaggucgagcacauguucucgcccucaugcgugagcuugcucaggugcacgggcuguugcggggacgagaaccugcacugugucccggucgagaccgcgaacgugaccaugcaauugcucaagaucaggagcggggacaggcccucguacguggaauugaccuucagccagcacguacgcugugaaugucgcccacucagggaaaagaugaagccagaacgcaggcgaccgaaagggcgcgggaaaaggcgcagagaaaagcaaaggcccacagacugucacuuaugcggggacgcggucccgaggcgcuga

SEQ ID NO: 1079 - RNA, 1239 nt, Artificial Sequence
  derived and/or modified CDS sequence (opt9) from Homo sapiens__NP_001020537.2__HsVEGFA
augacagaccgccagacagacaccgcgccaucgcccucguaccaccuccugcccgggagaaggcgcacggucgacgccgcagccucgcgaggacaagggcccgagccagcgccaggaggcgggguagagggcgugggagcgcgaggggucgcgcucaaacucuucguccagcuucugggcugcagcagguucgggggcgcaguagugcgcgcaggcgaagccgagcccucaggcgcggccaggagcgcaagcucaggcagagaggaaccccagcccgaggagggggaagaagaagaggaaaaagaagaagaaagggguccacaauggcgccugggcgcgcgcaagccaggaaguuggaccggagaagcagcagugugcgcggacucugcaccagccgcgcgagcgccccaggcauuggccagagcaucaggcagaggaggacgaguggcaagaagaggagccgaggaaucaggaccgccccauagcccaagcaggcgagggagugcgagcagagccggaccagggcgcgcaagcgagacaaugaacuuccuccugagcuggguacacuggucgcuagcacuguugcucuaccuccaucacgcaaaauggagccaggccgcgccaauggccgagggaggaggacaaaaccaccacgagguagugaaauucauggacgucuaccaaaggagcuauugccaccccauagaaacgcuaguggacauauuccaggaauauccagacgaaauagaguacauauucaaaccaagcugcgugccgcucaugaggugcggcggaugcuguaacgaugaagggcuagagugcguacccacggaagagagcaacaucaccaugcagaucaugaggauaaaaccgcaccagggccagcacauaggagagaugucauuccugcaacacaacaagugcgagugccggcccaagaaagaccgagcaagacaggaaaagaaaucaguaaggggaaagggcaagggacagaaaagaaaaagaaagaagaguagguacaagagcuggaguguauacguaggggcgagaugcugccugaugccauggagccuaccgggaccgcacccaugcggacccugcagcgaacgcaggaaacaccuguucguccaggacccacaaacaugcaaguguucaugcaagaacacagacucgcgcuguaaagcacgccaacucgagcuuaacgaaaggacaugccgcugcgacaaacccaggagauaa

SEQ ID NO: 1080 - RNA, 699 nt, Artificial Sequence
  derived and/or modified CDS sequence (opt9) from Homo sapiens__NP_001165094.1__HsVEGFA
augaacuuccuacucagcuggguccacuggucacucgcccuccuccucuaccuccaccacgccaaauggucccaagccgcccccauggccgaaggcggcggccaaaaccaccacgaaguaguaaaauucauggacguauaccaacgcagcuacugccaccccaucgaaacccuaguagacaucuuccaagaauaccccgacgaaaucgaauacauauucaaacccuccugcgucccacucaugcgcugcggcggcugcugcaacgacgaaggccucgaaugcguccccacagaagaaagcaacaucacaaugcagauaaugcgaaucaaaccccaccaaggccagcacaucggcgaaaugucauuccuccaacacaacaaaugcgaaugccgaccaaaaaaagaccgcgcaagacaagaaaaaaaauccgucagaggcaaaggcaaaggccaaaaacgaaaacgcaaaaaaucccgcuacaaaagcuggucagucuacguaggcgcccgcugcugccucaugccauggucccuccccggcccccaccccugcgggcccugcagcgaacgccgcaaacaccucuucguccaagacccacaaaccugcaaaugcuccugcaaaaacaccgacucccgcugcaaagcccgccaacucgaacuaaacgaacgcaccugccgcugcgacaaaccccgaagauaa

SEQ ID NO: 1081 - RNA, 624 nt, Artificial Sequence
  derived and/or modified CDS sequence (opt9) from Homo sapiens__NP_003368.1__HsVEGFB
auguccccccuccuccgccgacuccuacuagccgcccuccuacaacucgcccccgcacaagcccccgucucccaacccgacgcccccggccaccaacgcaaagucguauccuggauagacguauacacccgcgccaccugccaaccacgagaagucguagucccacucacagucgaacucaugggcaccgucgcaaaacaacucguaccaucaugcguaaccguccaacgaugcggcggcugcugccccgacgacggccuagaaugcguccccaccggccaacaccaagucagaaugcaaauccucaugauccgcuaccccuccucccaacucggcgaaaugucacucgaagaacacucccaaugcgaaugccgccccaaaaaaaaagacucagccguaaaacccgaccgcgccgccacaccacaccaccgaccccaaccccgcucagucccaggcugggacuccgcccccggcgcacccucccccgccgacaucacccaccccacccccgcacccggccccuccgcacacgccgccccauccaccaccuccgcccucacccccggccccgccgccgccgccgccgacgccgccgccagcuccgucgcaaaaggcggcgccuaa

SEQ ID NO: 1082 - RNA, 1260 nt, Artificial Sequence
  derived and/or modified CDS sequence (opt9) from Homo sapiens__NP_005420.1__HsVEGFC
augcaccuccucggauucuucuccgucgccugcucccuacucgccgccgcacuccuccccggcccacgcgaagcaccagcagccgccgccgcauucgaaucaggccucgaccuauccgacgccgaaccagacgccggcgaagccaccgccuaugcaagcaaagaccucgaagaacaacuacgauccguaucauccguggacgaacuaaugaccguccucuacccagaauacuggaaaauguacaaaugccaacuccgaaaaggcggauggcaacauaaccgcgaacaagccaaccucaacagccgaaccgaagaaacaaucaaauucgccgccgcccacuacaacacggaaauacuaaaauccaucgacaacgaauggagaaaaacacaaugcaugccccgugaagucugcaucgacgucggcaaagaauuuggcgucgccaccaacacauucuucaaaccacccugcgucucaguauaccgaugcggcgggugcugcaacuccgaaggccuacaaugcaugaacaccuccaccucauaccucucaaaaacccucuucgaaauaacaguuccacucagccaaggccccaaacccgucacgauauccuucgcaaaccauacuucaugccgcugcaugucaaaacuugacguauaccgccaaguccacuccaucauccgaagaucacuacccgccacccuaccccaaugucaagccgccaacaaaaccugccccaccaacuacauguggaacaaccacauuugccgcugccuagcccaagaagacuucauguucucaucggacgccggcgacgacucaaccgacggcuuccacgacauaugcggccccaacaaagaacuagacgaagaaacaugccaaugcgucugccgcgccggccuccgacccgcauccugcggaccccacaaagaacuggaccgcaacucaugccaaugcgucugcaaaaacaaacucuuccccucccaaugcggcgcaaaccgcgaguucgacgaaaauaccugccaaugcgucugcaagcgaaccugcccacgcaaccaaccccucaaccccggaaagugcgccugcgaaugcaccgaaagcccacaaaaaugccuucucaaaggaaagaaauuccaccaccaaaccugcucaugcuaccgccgccccugcaccaaccgccaaaaagccugcgaacccggcuucucauacuccgaagaaguaugccgcugcguuccaagcuacuggaaacgcccccaaauguccuaa

SEQ ID NO: 1083 - RNA, 1065 nt, Artificial Sequence
  derived and/or modified CDS sequence (opt9) from Homo sapiens__NP_004460.1__HsVEGFD
auguaccgagaauggguagucgucaacgucuucaugaugcucuacguccaacugguccaagguucauccaacgaacauggccccgucaaacgcuccucccagagcacccucgagcgcuccgaacaacaaauccgcgcugccuccucucuagaagaacuucuccgaaucacccacucugaagacuggaaauuauggcgaugccgccuacgucucaagagcuucaccucaauggacucccgauccgcaucccaccgcucuacacgauucgccgccaccuucuacgacaucgaaacccucaaagucauagacgaagaauggcaacgcacccaaugcuccccaagggaaaccugcgucgaaguagccuccgaacucggcaaauccaccaacacauucuucaaaccucccugcgucaacgucuuccgcugcggcggcugcugcaacgaagaaucccucaucugcaugaacacauccaccuccuacauauccaaacaacuauucgaaauuucugucccccucaccucgguccccgaacucguccccgucaaaguagccaaccacaccggcugcaaaugccugcccaccgccccacgacaccccuauuccaucauccgacgcuccauacagauucccgaagaagaccgaugcucccacucaaagaaacucugccccauagacaugcuaugggacucaaacaaaugcaaaugcguccuccaagaagaaaacccacucgccggcacugaagaccacucgcaccuccaagaacccgcccucugcggaccccacaugauguucgacgaagaccgcugcgaaugcgucugcaaaaccccaugccccaaagaccucauccaacaccccaaaaacugcucaugcuucgaaugcaaagaaucccucgagaccugcugccaaaaacacaaacucuuccaccccgauaccugcuccugcgaagaccgcugccccuuccacacacgcccaugcgccuccggcaaaaccgcaugcgcaaaacacugccguuucccaaaagaaaaacgcgccgcccaaggcccccacucccgcaaaaaccccuaa

SEQ ID NO: 1084 - RNA, 72 nt, Artificial Sequence
  derived and/or modified CDS sequence (opt11) from Homo sapiens__AAA59606.1__signal peptide-HLA-A2-SP
auggccgucauggccccccgcacccucguccuccuccucuccggcgcccucgcccucacccaaaccugggcc

SEQ ID NO: 1085 - RNA, 69 nt, Artificial Sequence
  derived and/or modified CDS sequence (opt11) from Homo sapiens__AAA61213.1__signal peptide-HsPLAT
auggacgccaugaaacgcggccucugcugcguccuccuccucugcggcgccgucuucgucucccccucc

SEQ ID NO: 1086 - RNA, 81 nt, Artificial Sequence; identical to SEQ ID NO: 892
  derived and/or modified CDS sequence (opt11) from Homo sapiens__NP_000790.2__signal peptide-HsEPO

SEQ ID NO: 1087 - RNA, 54 nt, Artificial Sequence
  derived and/or modified CDS sequence (opt11) from Homo sapiens__NP_000468.1__signal peptide-HsALB
augaaaugggucaccuucaucucccuccucuuccucuucuccuccgccuacucc

SEQ ID NO: 1088 - RNA, 18 nt, Artificial Sequence
  derived and/or modified CDS sequence (opt11) from Artificial____cleavage site-Furin
aggaggaggaggaagagg

SEQ ID NO: 1089 - RNA, 630 nt, Artificial Sequence
  derived and/or modified CDS sequence (opt11) from Homo sapiens__NP_061986.1__HsFGF21
auggacuccgacgaaaccggcuucgaacacucaggccucugggucuccguacuagccggccuccuccucggcgccugccaagcccaccccauccccgacuccucaccccuccuacaauucggcggccaaguccgccaacgcuaccuauacaccgacgacgcccaacaaaccgaagcccaccucgaaauccgcgaagacggcaccgucggcggcgccgccgaccaaucccccgaaucccuacuacaacucaaagcccucaaaccuggagucauccaaauacucggcgucaaaaccucccgcuuccucugccaacgccccgacggagcccucuacggcucccuccacuucgacccagaagccugcucuuuccgagaacuccucuuagaagacggcuacaacgucuaccaaucugaagcccacggccucccccuucaccuccccggaaacaaaucaccccaccgcgaccccgcaccccgcggcccagccagauuccucccccuccccggccucccaccagcccuccccgaaccacccggcauccucgcaccccaaccacccgacgucggcuccuccgacccccucucaauggucggccccucccaaggccgcucccccucauacgccucauaa

SEQ ID NO: 1090 - RNA, 1410 nt, Artificial Sequence
  derived and/or modified CDS sequence (opt11) from Homo sapiens__NP_002412.1__HsMMP1
augcacagcuucccaccccuccuccuccuccuguucuggggcgucgucucacacuccuuucccgcuacccucgaaacccaagaacaagacgucgaccucguacaaaaguaccucgaaaaauacuacaaccuuaaaaacgacggccgucaagucgaaaagcgccgcaacucaggccccgucguugaaaaacucaaacaaaugcaagaauuuuucggccugaaagucacaggaaaacccgacgccgaaacccucaaagucaugaaacaaccccgcugcggaguccccgacguagcccaauucguccuaaccgaaggcaacccccgcugggaacaaacccaccucacauaccgcaucgaaaacuacacccccgaccuuccccgcgccgacgucgaccacgccauagaaaaagcauuccaauuaugguccaacgucaccccacucaccuucacuaaggucuccgaaggccaagcagacauaaugaucucuuucguccgcggcgaccaccgagacaacucccccuucgacggccccggaggcaaccuggcccacgcauuccaaccaggccccggcaucggaggagacgcccacuucgacgaagacgaacgcuggacaaacaauuucagagaauacaacuuacaucgcgucgccgcccacgaacucggccacagccucggccucucacacuccacagauaucggcgcccuaauguaccccuccuacaccuucuccggcgacguccaacuagcccaagacgacauagacggcauccaagccauauacggccgaucccaaaaccccguacagcccaucggaccacaaacucccaaagccugcgacuccaaacucaccuucgacgccaucaccacaauacgaggcgaagugauguucuucaaagacagauucuauaugagaaccaacccguucuaccccgaagucgaacuuaacuucaucucagucuucuggccacaacuaccaaacggccucgaagcagccuacgaauuugccgaccgcgacgaaguccgauucuucaagggcaacaaauacugggccguccaaggccaaaacguccugcacggcuacccaaaagacaucuauuccagcuucggcuucccacgcacugucaaacauaucgaugccgcccucagcgaagaaaacacaggcaaaacauacuucuucgucgcuaacaaauacuggcgcuacgaugaauacaaacgcuccauggacccaggcuauccuaaaaugaucgcccacgacuuccccggcaucggccacaaggucgaugccgucuucaugaaggacggauucuucuacuucuuccacggaacccgccaauacaaguucgaccccaaaacuaagcgaauccucacccuccaaaaagccaacuccugguucaacugccgcaaaaacuaa

SEQ ID NO: 1091 - RNA, 1170 nt, Artificial Sequence
  derived and/or modified CDS sequence (opt11) from Homo sapiens__NP_002412.1__HsMMP1(1-19,100-469)
augcauucauucccaccacuacuacuccuccuauucuggggagucgucucccauuccuucguccucacagaaggcaacccccgcugggaacaaacccaccucaccuaccgcauagaaaacuacaccccagaccucccccgcgccgacgucgaccacgccaucgaaaaagcguuccaacuauggucuaacguaacaccccucaccuucaccaaagucuccgaaggccaagccgacauaaugaucucauucgucagaggcgaccaccgcgacaacucucccuucgacggccccggaggcaaccucgcacacgccuuccaacccggccccggaaucggcggcgacgcccacuucgacgaagacgaacgcuggaccaacaacuuccgagaauacaaccuccaccgcgucgccgcacacgaacucggccacagccucgggcucucacacuccaccgacaucggugcccucauguaccccucauacacauucucuggcgacguccaacucgcacaagacgacaucgacggcauccaagccaucuacggccgaucccaaaacccaguccaacccauaggcccacagacacccaaagcaugcgacuccaaacucaccuucgacgccauaaccaccauccgcggcgaaguaauguucuucaaagacagauucuacaugcgcaccaaccccuucuacccagaaguugaauuaaacuucaucuccgucuucuggccacagcucccaaacggucucgaagccgcauacgaauuugcagaccgagacgaaguacgauucuucaaaggcaacaaauauugggccguacaggggcaaaauguccuccacggcuacccuaaagacaucuacuccuccuucggcuucccccgcacagucaaacacaucgacgccgcccucuccgaagaaaacaccggcaaaaccuacuucuucgucgccaacaaauacuggcgauacgacgaauacaaacgcuccauggaccccggauaccccaaaaugaucgcccacgacuuccccggcaucggccacaaaguagacgccguuuucaugaaagacggauucuucuacuucuuccacggaacaagacaguacaaauucgacccaaagaccaaacggauccucacccuccaaaaagcaaacuccugguucaauugccgcaaaaauuaa

SEQ ID NO: 1092 - RNA, 3357 nt, Artificial Sequence
  derived and/or modified CDS sequence (opt11) from Clostridium histolyticum__BAA77453.1__ColG
augaagaagaacauccugaagauccucauggacagcuacuccaaggagagcaagauccagaccgugcgccgggucaccuccgugagccugcuggccguguaccucacgaugaacaccuccagccugguccuggccaagcccaucgagaacaccaacgacaccuccaucaagaacguggagaagcuccgcaacgcgccgaacgaggagaacagcaagaagguggaggacuccaagaacgacaaggucgagcacgugaagaacaucgaggaggccaagguggagcaggucgcccccgaggucaagagcaaguccacgcugcggagcgccuccaucgccaacaccaacagcgagaaguacgacuucgaguaccugaacggccucuccuacaccgagcugaccaaccugaucaagaacaucaaguggaaccagaucaacggccucuucaacuacagcacggggucccagaaguucuucggggacaagaaccgcgugcaggcgaucaucaacgcccugcaggagagcggccggaccuacaccgccaacgacaugaaggggaucgagaccuucacggaggugcugcgcgccggcuucuaccucggcuacuacaacgacgggcuguccuaccugaacgaccggaacuuccaggacaagugcauccccgcgaugaucgccauccagaagaaccccaacuucaagcucggcaccgccgugcaggacgaggugaucaccagccuggggaagcugaucggcaacgccagcgccaacgcggaggucgugaacaacugcgugccgguccucaagcaguuccgcgagaaccugaaccaguacgcccccgacuacgugaaggggaccgccgugaacgagcugaucaagggcaucgaguucgacuucuccggcgccgccuacgagaaggacgucaagacgaugcccugguacgggaagaucgaccccuucaucaacgagcucaaggcgcugggccuguacgggaacaucaccagcgccaccgagugggccuccgacgugggcaucuacuaccucagcaaguucggccuguacuccaccaaccggaacgacaucgugcagagccuggagaaggccgucgacauguacaaguacgggaagaucgccuucguggcgauggagcgcaucacgugggacuacgacggcaucggguccaacggcaagaaggucgaccacgacaaguuccucgacgacgccgagaagcacuaccugccgaagaccuacaccuucgacaacgggaccuucaucauccgggccggcgacaaggugagcgaggagaagaucaagcgccuguacugggccucccgggaggucaagagccaguuccaccgcguggugggcaacgacaaggcccucgagguggggaacgcggacgacguccugacgaugaagaucuucaacucccccgaggaguacaaguucaacaccaacaucaacggcgugagcaccgacaacgggggccuguacaucgagccccgggggaccuucuacacguacgagcgcacgccccagcaguccaucuucagccucgaggagcuguuccggcacgaguacacccacuaccugcaggcccgcuaccucguggacggccuguggggccaggggccguucuacgagaagaaccggcugaccugguucgacgagggcaccgccgaguucuucgccggguccacccgcaccagcggcguccucccccggaaguccauccugggguaccuggcgaaggacaagguggaccaccgcuacagccucaagaagacccugaacuccggcuacgacgacagcgacuggauguucuacaacuacggcuucgccguggcccacuaccuguacgagaaggacaugcccacguucaucaagaugaacaaggccauccucaacaccgacgucaagagcuacgacgagaucaucaagaagcuguccgacgacgccaacaagaacaccgaguaccagaaccacauccaggagcuggcggacaaguaccagggggccggcaucccccuggugagcgacgacuaccucaaggaccacggguacaagaaggccuccgagguguacagcgagaucuccaaggccgccagccugaccaacaccuccgucacggcggagaagucccaguacuucaacaccuucacccugcgcggcaccuacacgggcgagaccagcaagggggaguucaaggacugggacgagaugagcaagaagcucgacggcacccuggagucccuggccaagaacagcugguccggguacaagacccucacggccuacuucaccaacuaccgggugaccagcgacaacaaggugcaguacgacgucguguuccacggcgugcugaccgacaacgccgacaucuccaacaacaaggccccgaucgcgaaggucacggggcccagcaccggcgccgugggccgcaacaucgaguucuccgggaaggacagcaaggacgaggacggcaagaucgugagcuacgacugggacuucggggacggcgccaccucccgggggaagaacagcguccacgccuacaagaaggcgggcaccuacaacgugacgcugaaggugaccgacgacaagggcgccaccgccaccgaguccuucacgaucgagaucaagaacgaggacaccaccacccccaucacgaaggagauggagcccaacgacgacaucaaggaggccaacgggccgaucgucgagggcgugaccgugaagggggaccucaacggcagcgacgacgccgacaccuucuacuucgacgucaaggaggacggggacgugaccaucgagcugcccuacuccggcagcuccaacuucacguggcugguguacaaggagggcgacgaccagaaccacaucgcgagcgggaucgacaagaacaacuccaaggucggcaccuucaagagcaccaaggggcgccacuacguguucaucuacaagcacgacuccgccagcaacaucuccuacagccucaacaucaagggccuggggaacgagaagcugaaggagaaggagaacaacgacuccagcgacaaggccaccgugauccccaacuucaacacgaccaugcagggcucccuccugggcgacgacagccgggacuacuacuccuucgaggucaaggaggagggggaggugaacaucgagcuggacaagaaggacgaguucggcgugaccuggacccuccaccccgagagcaacaucaacgaccgcaucacguacgggcaggucgacggcaacaaggugagcaacaaggugaagcugcggccgggcaaguacuaccugcucgucuacaaguacuccgggagcggcaacuacgagcugcgcgugaacaaguga

SEQ ID NO: 1093 - RNA, 3081 nt, Artificial Sequence
  derived and/or modified CDS sequence (opt11) from Clostridium histolyticum__BAA77453.1__HsALB(1-18)_ColG(111-1118)
augaagugggugacauucaucagccuccucuucuuauucuccagcgccuacuccaucgccaacaccaacagcgagaaguacgacuucgaguaccugaacggccucucuuacacggagcugaccaaucugaucaagaacaucaaguggaaccagauuaacggguuauucaacuacagcaccggcucccagaaguucuucggggacaaaaaccgcguccaggcgauuaucaacgcccugcaggagagcggucggaccuacaccgcuaacgacaugaaggggaucgagaccuucaccgagguucugcgcgccggcuucuaccucggcuacuacaacgacgggcuguccuaccugaacgaccggaacuuccaggacaagugcauccccgccaugaucgcgauccagaagaacccgaacuucaagcucggcaccgccgugcaggacgaggucaucacgagccuggggaagcugaucggcaacgccuccgccaacgcggagguggugaacaacugcguccccgugcucaagcaauuccgcgaaaaccugaaccaguacgcccccgacuacguaaaggggaccgccgucaacgagcugaucaagggcaucgaguucgacuuuagcggcgccgccuacgagaaagacgugaagaccaugcccugguacgggaagaucgacccguucaucaacgagcucaaggcgcugggccuguacgggaacaucaccuccgccacggagugggccagcgacgugggcaucuacuaccucuccaaguucggccuguacucgaccaaccggaaugacaucguacagucccuggagaaggccguggacauguacaaguacgggaagaucgccuucguggcgauggagcgcaucaccugggacuacgacgguaucgggagcaacggcaagaaggucgaccacgacaaauuccucgacgacgccgagaagcacuaccugcccaagaccuacacguucgacaacggcaccuucaucauccgggccggugacaagguguccgaggagaagaucaagcgccuguacugggccagccgagaggucaagagccaguuccaccgcguggugggcaacgacaaggcccucgagguggggaacgcggacgacguccugaccaugaagaucuucaacuccccugaggaguacaaguucaacaccaacaucaacggcguguccacggauaacgggggccuguacaucgagccccgggggaccuucuacaccuaugagcgcaccccgcagcaguccaucuucagccucgaggagcuguuucggcacgaguacacgcacuaccugcaggcccgcuacuuaguggacggccuguggggccaggggcccuucuacgagaagaaccggcugaccugguucgacgagggcaccgccgaguucuucgccgguuccacccgcacgagcggcguccucccccgaaaguccauccugggguaccuggccaaggacaagguggaccaccgcuacagccucaagaagacccugaacuccggcuacgacgacucggacuggauguucuacaacuacggcuucgcggucgcccacuaccuguacgagaaggacaugcccaccuucaucaagaugaacaaggccauccucaacaccgacgugaaguccuacgacgagaucaucaagaagcugagcgacgacgccaacaagaacacggaguaccagaaccacauccaggagcuggcggacaaauaccagggugccggcaucccucucguguccgacgacuaccugaaggaccacggguacaagaaggccagcgaggucuacuccgagauuagcaaggccgccucccugaccaacaccagcgugaccgcggagaagucccaguacuucaacacguucacccuccggggcaccuacaccggcgaaaccagcaagggggaguucaaggacugggacgagaugagcaagaagcuggacggcacgcuggaaucccuggccaagaacagcugguccggguacaagacccucaccgccuauuuuaccaacuaccgcgugacgagcgacaacaagguccaguacgacgugguguuccacggcguccugaccgacaacgccgacaucuccaacaacaaggcccccaucgcgaaggugaccgggcccagcaccggcgccgugggccggaacaucgaguucuccgggaaggacucuaaggacgaggacggcaagauagucuccuacgacugggacuucggggacggcgccacgucccgcgggaagaacuccguccacgccuacaagaaggccggcaccuacaacgugacccugaaggucaccgacgacaaaggcgcgacggccaccgagagcuucaccaucgagaucaagaacgaggacaccacgacccccaucaccaaggagauggagccgaacgacgacaucaaggaggccaacgggcccaucguggagggcgugaccgucaagggggaccucaacggcuccgacgacgcagacacguucuacuucgaugugaaggaggacggggacgugaccaucgagcugcccuacagcggcuccagcaacuucaccuggcuggucuacaaggagggcgacgaccagaaccacaucgcguccgggaucgacaagaacaacagcaaggugggcaccuucaagagcacgaaggggcgccacuacguguucaucuacaagcacgacuccgccagcaacaucuccuacagccucaacaucaagggccuggggaacgagaagcugaaggagaaggagaacaacgacuccagcgacaaggccaccgucauccccaacuucaacaccaccaugcagggcucccuccugggcgacgacagccgggacuacuacuccuucgaggugaaggaggagggggaggugaacaucgagcuggacaagaaggacgaguucggcgucacguggacccuccacccggaauccaacauaaacgaccgcaucaccuacggccagguggacgggaacaagguguccaacaaggucaagcugcggcccggcaaguacuaccugcucguguacaaguacagcggguccggaaacuacgagcugcgcgugaacaaguga

SEQ ID NO: 1094 - RNA, 3429 nt, Artificial Sequence
  derived and/or modified CDS sequence (opt11) from Clostridium histolyticum__BAA77453.1__HsALB(1-18)_ColG(1-110)_CS-F_ColG(111-1 118)
augaagugggugaccuucaucagccuccucuuccuguucuccagcgccuacuccaugaagaagaacauccugaagauccucauggacagcuacuccaaggagagcaagauccagaccguccgccgggugacguccgugagccugcuggccgucuaccucaccaugaacaccuccagccuggugcuggcgaagcccaucgagaacaccaacgacacguccaucaagaacguggagaagcuccgcaacgccccgaacgaggagaacagcaagaaggucgaggacuccaagaacgacaagguggagcacgugaagaacaucgaggaggccaaggucgagcaggucgcccccgaggucaagagcaaguccacccugcggagcgccucccgccggcgccggaagcgcaucgcgaacaccaacagcgagaaguacgacuucgaguaccugaacggccucuccuacaccgagcugacgaaccugaucaagaacaucaaguggaaccagaucaacgggcuguucaacuacagcaccggcagccagaaguucuucggggacaagaaccgggugcaggccaucaucaacgcccugcaggaguccggccgcaccuacaccgccaacgacaugaaggggaucgagacguucaccgaggugcugcgggcgggcuucuaccucggcuacuacaacgacgggcugagcuaccugaacgaccgcaacuuccaggacaagugcauccccgccaugaucgccauccagaagaaccccaacuucaagcucggcaccgccgugcaggacgaggugaucaccucccuggggaagcugaucggcaacgccagcgcgaacgccgagguggugaacaacugcgucccggugcucaagcaguuccgggagaaccugaaccaguacgcccccgacuacgugaaggggacggccgucaacgagcugaucaagggcaucgaguucgacuucuccggcgccgcguacgagaaggacgugaagaccaugcccugguacgggaagaucgaccccuucaucaacgagcucaaggcccugggccuguacgggaacaucaccagcgccaccgagugggccuccgacgugggcaucuacuaccucagcaaguucggccuguacuccacgaaccgcaacgacaucguccagagccuggagaaggccguggacauguacaaguacgggaagaucgcguucgucgccauggagcggaucaccugggacuacgacggcaucggguccaacggcaagaagguggaccacgacaaguuccucgacgacgccgagaagcacuaccugccgaagaccuacaccuucgacaacgggacguucaucauccgcgccggcgacaaggugagcgaggagaagaucaagcggcuguacugggccucccgcgaggucaagagccaguuccaccggguggugggcaacgacaaggcgcucgaggucgggaacgccgacgacgugcugaccaugaagaucuucaacucccccgaggaguacaaguucaacaccaacaucaacggcgugagcaccgacaacgggggccuguacaucgagccccgcgggacguucuacaccuacgagcggacgccccagcaguccaucuucagccucgaggagcuguuccgccacgaguacacccacuaccugcaggcccgcuaccucgucgacggccuguggggccaggggccguucuacgagaagaaccggcugaccugguucgacgagggcaccgccgaguucuucgcgggguccacccgcaccagcggcgugcucccccgcaagagcauccugggguaccuggccaaggacaagguggaccaccgguacucccucaagaagacgcugaacagcggcuacgacgacuccgacuggauguucuacaacuacggcuucgccgucgcccacuaccuguacgagaaggacaugcccaccuucaucaagaugaacaaggccauccugaacaccgacgucaagagcuacgacgagaucaucaagaagcucuccgacgacgcgaacaagaacaccgaguaccagaaccacauccaggagcuggccgacaaguaccagggggccggcaucccccuggugagcgacgacuaccucaaggaccacggguacaagaaggccuccgagguguacagcgagaucuccaaggccgcgagccugaccaacacguccgugaccgccgagaagucccaguacuucaacaccuucacccugcggggcacguacaccggcgagaccagcaagggggaguucaaggacugggacgagaugagcaagaagcucgacggcacccuggagucccuggccaagaacagcugguccggguacaagacgcucaccgccuacuucaccaacuaccgcgugaccagcgacaacaagguccaguacgacgugguguuccacggcguccugacggacaacgccgacaucagcaacaacaaggcgccgaucgccaaggugaccgggcccuccaccggcgccgugggccggaacaucgaguucagcgggaaggacuccaaggacgaggacggcaagaucgucagcuacgacugggacuucggggacggcgccaccucccgcgggaagaacagcgugcacgcguacaagaaggccggcacguacaacgugacccugaaggucaccgacgacaagggcgccaccgccacggaguccuucaccaucgagaucaagaacgaggacaccaccacgcccaucaccaaggagauggagcccaacgacgacaucaaggaggccaacgggccgaucguggagggcgugaccgucaagggggaccucaacggcagcgacgacgcggacaccuucuacuucgacgugaaggaggacggggacgugacgaucgagcugcccuacuccggcagcuccaacuucaccuggcuggucuacaaggagggcgacgaccagaaccacaucgccagcgggaucgacaagaacaacuccaaggugggcaccuucaagagcaccaaggggcggcacuacguguucaucuacaagcacgacuccgccagcaacaucuccuacagccucaacaucaagggccuggggaacgagaagcugaaggagaaggagaacaacgacuccagcgacaaggccacggucauccccaacuucaacaccaccaugcagggcagccuccugggcgacgacucccgcgacuacuacagcuucgaggugaaggaggagggggaggugaacaucgagcuggacaagaaggacgaguucggcgucaccuggacgcuccaccccgaguccaacaucaacgaccggaucaccuacggccagguggacgggaacaaggugagcaacaaggucaagcugcgcccgggcaaguacuaccugcucguguacaaguacuccgggagcggcaacuacgagcugcgggugaacaaguga

SEQ ID NO: 1095 - RNA, 3105 nt, Artificial Sequence; identical to SEQ ID NO: 222
  derived and/or modified CDS sequence (opt11) from Clostridium histolyticum__BAA34542.1__ColH

SEQ ID NO: 1096 - RNA, 3066 nt, Artificial Sequence
  derived and/or modified CDS sequence (opt11) from Clostridium histolyticum__BAA34542.1__ColH
augaagcgcaagugccugagcaagcggcucaugcuggccaucaccauggccaccaucuucacggugaacuccacccugcccaucuacgcggccgucgacaagaacaacgccaccgccgccgugcagaacgagagcaagcgcuacaccguguccuaccucaagacgcugaacuacuacgaccuggucgaccuccuggugaagaccgagaucgagaaccugccggaccucuuccaguacagcuccgacgcgaaggaguucuacggcaacaagacccggaugagcuucaucauggacgagaucgggcgccgggcgccccaguacaccgagaucgaccacaagggcauccccacgcugguggaggucgugcgcgccggguucuaccugggcuuccacaacaaggagcucaacgagaucaacaagcgguccuucaaggagcgcgugauccccagcauccuggccauccagaagaacccgaacuucaagcuggggaccgagguccaggacaagaucguguccgccaccggccuccuggccggcaacgagaccgccccgcccgagguggucaacaacuucacgcccauccugcaggacugcaucaagaacaucgaccgguacgcccucgacgaccucaagagcaaggcccuguucaacgugcucgcggccccgaccuacgacaucaccgaguaccugcgcgccaccaaggagaagcccgagaacacgcccugguacgggaagaucgacggcuucaucaacgagcugaagaagcucgcccuguacgggaagaucaacgacaacaacuccuggaucaucgacaacggcaucuaccacaucgcgccccuggggaagcuccacagcaacaacaagaucggcaucgagacccugaccgaggugaugaaggucuacccguaccuguccaugcagcaccuccagagcgccgaccagaucaagcggcacuacgacuccaaggacgccgagggcaacaagaucccccuggacaaguucaagaaggaggggaaggagaaguacugccccaagaccuacacguucgacgacggcaaggugaucaucaaggccggggcccgcguggaggaggagaaggucaagcggcuguacugggccagcaaggaggugaacucccaguucuuccgcguguacggcaucgacaagccccucgaggagggcaacccggacgacauccugaccauggucaucuacaacagccccgaggaguacaagcugaacuccgugcucuacggguacgacaccaacaacggcgggauguacaucgagcccgagggcaccuucuucacguacgagcgggaggcgcaggagagcaccuacacccuggaggagcuguuccgccacgaguacacccacuaccuccaggggcgguacgccgugcccggccaguggggccgcacgaagcuguacgacaacgaccggcugaccugguacgaggagggcggggccgagcuguucgccgggagcacccgcaccuccggcauccugccgcgcaagagcaucgucuccaacauccacaacacgacccggaacaaccgcuacaagcugagcgacaccgugcacuccaaguacggggccagcuucgaguucuacaacuacgcgugcauguucauggacuacauguacaacaaggacaugggcauccucaacaagcugaacgaccuggccaagaacaacgacgucgacggcuacgacaacuacauccgggaccucuccagcaacuacgcccugaacgacaaguaccaggaccacaugcaggagcgcaucgacaacuacgagaaccugaccgugcccuucguggccgacgacuaccugguccggcacgcguacaagaaccccaacgagaucuacuccgagaucagcgagguggccaagcucaaggacgccaaguccgaggugaagaagucccaguacuucagcacguucacccugcgcgggagcuacaccggcggggccuccaagggcaagcuggaggaccagaaggccaugaacaaguucaucgacgacagccucaagaagcuggacaccuacuccuggagcggguacaagacccugacggcguacuucaccaacuacaaggucgacuccagcaaccgggugaccuacgacguggucuuccacggcuaccuccccaacgagggcgacagcaagaacucccugccguacgggaagaucaacggcaccuacaaggggacggagaaggagaagaucaaguucagcuccgagggcagcuucgaccccgacggcaagaucguguccuacgagugggacuucggggacggcaacaagagcaacgaggagaaccccgagcacuccuacgacaagguggggaccuacaccgucaagcugaaggugaccgacgacaagggcgagagcuccgugagcacgaccaccgccgagaucaaggaccucuccgagaacaagcugcccgucaucuacaugcacgugcccaagagcggggcccugaaccagaagguggucuucuacggcaagggcaccuacgaccccgacggguccaucgccggcuaccagugggacuucggggacggcagcgacuucuccagcgagcagaaccccucccacguguacacgaagaagggggaguacaccgugacccuccgcgucauggacagcagcggccagauguccgagaagaccaugaagaucaagaucacggacccgguguaccccaucggcaccgagaaggagcccaacaacagcaaggagaccgccuccgggcccaucgugccgggcauccccgucagcgggaccaucgagaacacguccgaccaggacuacuucuacuucgacgugaucacccccggcgaggugaagaucgacaucaacaagcugggguacggcggcgcgaccugggucguguacgacgagaacaacaacgccgugagcuacgccaccgacgacgggcagaaccuguccggcaaguucaaggccgacaagcccgggcgguacuacauccaccucuacauguucaacggcagcuacaugccguaccgcaucaacaucgagggguccgucggccgguga

SEQ ID NO: 1097 - RNA, 3000 nt, Artificial Sequence
  derived and/or modified CDS sequence (opt11) from Clostridium histolyticum__BAA34542.1__HsALB(1-18)_ColH(41-1021)
augaagugggugaccuucaucagccugcuguuccuguucuccagcgccuacuccguccagaacgagagcaagcgcuacaccguguccuaccugaagacgcucaacuacuacgaccugguggaccugcucgucaagaccgagaucgagaaccugcccgaccuguuccaguacagcuccgacgccaaggaguucuacggcaacaagacccggaugagcuucaucauggacgagaucgggcgccgggcgccgcaguacaccgagaucgaccacaagggcauccccacgcucguggaggugguccgcgccggguucuaccugggcuuccacaacaaggagcugaacgagaucaacaagcgguccuucaaggagcgcgugauccccagcauccucgccauccagaagaaccccaacuucaagcuggggaccgaggugcaggacaagaucgucuccgccaccggccugcucgccggcaacgagaccgcgccgcccgagguggugaacaacuucacgcccauccugcaggacugcaucaagaacaucgaccgguacgcccuggacgaccucaagagcaaggcccuguucaacguccuggccgcgcccaccuacgacaucaccgaguaccuccgcgccaccaaggagaagccggagaacacgcccugguacgggaagaucgacggcuucaucaacgagcugaagaagcuggcccucuacgggaagaucaacgacaacaacuccuggaucaucgacaacggcaucuaccacaucgcgccccuggggaagcugcacagcaacaacaagaucggcaucgagacccucaccgaggugaugaagguguaccccuaccuguccaugcagcaccuccagagcgccgaccagaucaagcggcacuacgacuccaaggacgccgagggcaacaagaucccgcucgacaaguucaagaaggaggggaaggagaaguacugccccaagaccuacacguucgacgacggcaaggucaucaucaaggccggggcccgcguggaggaggagaaggugaagcggcuguacugggccagcaaggaggucaacucccaguucuuccgcguguacggcaucgacaagccccuggaggagggcaaccccgacgacauccucaccauggugaucuacaacagcccggaggaguacaagcugaacagcguccuguacggguacgacaccaacaacggcgggauguacaucgagcccgagggcaccuucuucacguacgagcgggaggcccaggaguccaccuacacccucgaggagcuguuccgccacgaguacacccacuaccugcaggggcgguacgcggugcccggccaguggggccgcacgaagcucuacgacaacgaccggcugaccugguacgaggagggcggggccgagcuguucgccgggagcacccgcaccuccggcauccucccccgcaagagcaucguguccaacauccacaacacgacccggaacaaccgguacaagcugagcgacaccguccacuccaaguacggggccagcuucgaguucuacaacuacgccugcauguucauggacuacauguacaacaaggacaugggcauccugaacaagcucaacgaccuggcgaagaacaacgacguggacggcuacgacaacuacauccgcgaccuguccagcaacuacgcccucaacgacaaguaccaggaccacaugcaggagcgcaucgacaacuacgagaaccugaccgucccguucguggccgacgacuaccuggugcggcacgccuacaagaaccccaacgagaucuacuccgagaucagcgaggucgccaagcugaaggacgcgaaguccgaggugaagaagucccaguacuucagcacguucacccuccgcgggagcuacaccggcggggccuccaagggcaagcuggaggaccagaaggccaugaacaaguucaucgacgacagccugaagaagcucgacaccuacuccuggagcggguacaagacgcugaccgccuacuucaccaacuacaagguggacagcuccaaccgggucaccuacgacgugguguuccacggcuaccugcccaacgagggcgacagcaagaacucccuccccuacgggaagaucaacggcaccuacaaggggacggagaaggagaagaucaaguucagcuccgagggcagcuucgacccggacggcaagaucgucuccuacgagugggacuucggggacggcaacaagagcaacgaggagaaccccgagcacuccuacgacaagguggggaccuacaccgugaagcugaaggucaccgacgacaagggcgagagcuccgugagcacgaccaccgcggagaucaaggaccuguccgagaacaagcuccccgugaucuacaugcacguccccaagagcggggcccugaaccagaaggugguguucuacggcaagggcaccuacgacccggacggguccaucgccggcuaccagugggacuucggggacggcagcgacuucuccagcgagcagaaccccagccacgucuacacgaagaagggggaguacaccgugacccugcgcgugauggacuccagcggccagauguccgagaagaccaugaagaucaagaucacggaccccgucuacccgaucggcaccgagaaggagcccaacaacagcaaggagaccgccuccgggcccaucgugcccggcaucccggugagcgggaccaucgagaacacguccgaccaggacuacuucuacuucgacgucaucacccccggcgaggugaagaucgacaucaacaagcucggguacggcggcgccaccuggguggucuacgacgagaacaacaacgcggugagcuacgccaccgacgacgggcagaaccuguccggcaaguucaaggccgacaagcccgggcgguacuacauccaccuguacauguucaacggcagcuacaugcccuaccgcaucaacaucgagggguccgugggccgguga

SEQ ID NO: 1098 - RNA, 3138 nt, Artificial Sequence
  derived and/or modified CDS sequence (opt11) from Clostridium histolyticum__BAA34542.1__HsALB(1-18)_ColH(1-40)_CS-F_ColH(41-102 1)
augaagugggugaccuucaucagccucuuauuccuguuuuccagugccuacuccaugaagcgcaagugccugagcaagcggcucaugcuggccaucaccauggcgacgaucuucaccgucaacuccacccugcccaucuacgccgccguggacaagaacaacgccaccgccgcgcgccggcgccggaagcgcgugcagaacgagagcaagcgguacacggucuccuaccucaagacccugaacuacuacgaccugguggaccuccuggugaagaccgagaucgagaaccugccggaccucuuccaguacagcucagacgccaaggaguucuacggcaacaagacccgcaugagcuucaucauggacgagaucgggcggcgcgcgccccaguacacggagaucgaccacaagggcauucccacccuggucgagguggugcgggccggguucuaccugggcuuccacaacaaggagcucaaugagaucaacaagcgcuccuucaaggagcgagucaucccaagcauccuggccauccagaagaacccgaacuucaagcuggggaccgaggugcaggacaagaucguguccgccaccggccuccucgccggcaacgagacggccccgcccgaggucgugaauaacuucacccccauccugcaggacugcaucaagaacaucgaccgcuacgcccucgacgaccucaagagcaaggcgcuguucaacguccuggcagccccgacauacgacaucaccgaguaccuccgggccacuaaggagaagcccgagaacacccccugguacgggaagaucgacggcuucaucaacgagcugaagaaacucgcccuguacgggaagaucaacgacaacaacuccuggaucaucgacaacggcaucuaccacaucgcgccccuggggaagcuccacagcaacaacaagaucggcaucgagaccuugaccgaggucaugaagguguacccguaccuguccaugcagcaccuccaaagcgccgaccagaucaagcgccacuacgacuccaaggacgccgagggcaacaagaucccccuugacaaguucaagaaggaggggaaggagaaauacugccccaagacguacaccuucgacgacggcaaggugaucaucaaggccggggcccgggucgaggaggagaaggugaagcgguuauacugggcgucaaaagaggugaacagccaguucuuccgggucuacggcaucgacaagccccucgaggagggcaacccggacgacauccugaccauggugaucuacaacucccccgaggaguacaagcugaacagcgugcucuacggguacgacacaaacaacggcggaauguacaucgagcccgagggcacguucuucacguacgagcgcgaggcccaggaguccaccuacacccuggaggagcuguuccggcacgaguacacgcacuaccuccaggggagauacgccguccccggccaguggggccgcaccaagcuguacgacaacgaccggcugaccugguacgaggagggaggggccgagcuguucgccgggagcacccgcacguccggcauccugccgcgcaagagcaucguuuccaacauccauaacaccacccggaacaacagauacaagcugagcgacaccguccacuccaaguacggggcgagcuucgaguuuuacaacuacgccuguauguucauggacuacauguacaacaaggauaugggcauacucaacaagcugaacgaccuggccaagaauaacgacguggacggcuacgacaacuacauccgcgaccugucaagcaacuacgcccucaacgacaaguaccaggaccacaugcaggagcggaucgacaacuacgagaaccugacggugcccuucgucgcggacgacuaccuggugcgucacgccuacaagaaccccaacgagaucuacucugagaucagugagguggccaagcucaaggacgccaagucagaggucaagaagucccaguacuucagcaccuucacccugcgggggagcuauaccggcggggccuccaagggcaagcuggaggaccagaaggccaugaacaaguucaucgacgacagccucaagaagcuggacaccuacagcugguccggguacaagacgcugaccgcguacuucaccaacuacaagguggauagcuccaaccgcguaaccuacgacgucguguuccacggcuaccuccccaacgagggcgacagcaagaacucccugccguacgggaagaucaacggcacguacaaggggaccgagaaggagaaaaucaaguucagcuccgagggcuccuucgaccccgacggcaagaucguguccuacgagugggacuucggggacggcaacaagagcaacgaggagaaccccgaacacuccuacgacaaggucgggaccuacaccgugaagcugaaggugacggacgacaagggcgagagcuccgucucuaccaccaccgccgagaucaaggaccucuccgagaacaagcugcccgugaucuacaugcacgugcccaagucaggggcccugaaccaaaaggucguguuuuacggcaagggcacguacgaccccgacggguccauagccggcuaccagugggacuucggggacggcagcgacuucagcuccgagcagaaccccagccacguguacaccaagaagggggaguacaccgucacccucagggugauggacuccagcggccagauguccgagaagacgaugaagaucaagaucaccgauccgguguaccccaucggcaccgagaaggagccgaacaacagcaaggagaccgcguccgggcccaucgucccgggcauccccgugagcgggacgaucgagaacaccuccgaccaggacuacuucuacuucgacgugaucacccccggcgaggucaagaucgauaucaacaagcugggguacggcggcgccaccugggugguguacgacgagaacaacaacgccgucagcuacgcuacggacgacgggcagaaccuguccggcaaguucaaggccgacaagcccgggcgguacuacauccaccucuacauguucaacggcagcuacaugccguaccggaucaacaucgagggguccguaggccgauga

SEQ ID NO: 1099 - RNA, 576 nt, Artificial Sequence
  derived and/or modified CDS sequence (opt11) from Homo sapiens__NP_001133.1__HsAMELX
augggcaccuggauacuauucgccugccuccucggcgccgccuucgccaugccccuacccccccaccccggccaccccggcuacaucaacuucucauacgaaguccucaccccccucaaaugguaccaaucaauccgcccccccuaccccuccuacggcuacgaacccaugggaggcuggcuccaccaccaaaucauccccguccucucccaacaacacccccccacccacacccuccaaccccaccaccacauccccgucguccccgcccaacaacccgucaucccccaacaacccaugaugcccguccccggccaacacucaaugacccccauccaacaccaccaacccaaccuccccccccccgcccaacaacccuaccaaccccaacccguccaaccccaaccacaccaaccaaugcaaccccaaccccccguccaccccaugcaaccccuccccccccaacccccccuaccccccauguuccccaugcaaccccucccccccaugcuccccgaccucacccucgaagccuggcccuccaccgacaaaaccaaacgcgaagaagucgacuaa

SEQ ID NO: 1100 - RNA, 135 nt, Artificial Sequence
  derived and/or modified CDS sequence (opt11) from Homo sapiens__NP_001133.1__HsAMELX-TRAP
augccccuccccccccaccccggccaccccggcuacaucaacuucuccuacgaaguccucaccccccucaaaugguaccaauccauccgcccccccuaccccuccuacggcuacgaacccaugggcggcugguaa

SEQ ID NO: 1101 - RNA, 168 nt, Artificial Sequence
  derived and/or modified CDS sequence (opt11) from Homo sapiens__NP_001133.1__HsAMELX-LRAP
augccccuccccccccaccccggccaccccggcuacaucaacuucuccuacgaaguccucaccccccucaaaugguaccaauccauccgccccccccccaugcuccccgaccucacccucgaagccuggcccuccaccgacaaaaccaaacgcgaagaagucgacuaa

SEQ ID NO: 1102 - RNA, 207 nt, Artificial Sequence
  derived and/or modified CDS sequence (opt11) from Homo sapiens__NP_001133.1__HLA-A2-SP_HsAMELX(17-60)
auggccgucauggccccccgcacccucguccuccuccucuccggcgcccucgcccucacccaaaccugggccaugccccuccccccccaccccggccaccccggcuacaucaacuucuccuacgaaguccucaccccccucaaaugguaccaauccauccgcccccccuaccccuccuacggcuacgaacccaugggcggcugguaa

SEQ ID NO: 1103 - RNA, 240 nt, Artificial Sequence
  derived and/or modified CDS sequence (opt11) from Homo sapiens__NP_001133.1__HLA-A2-SP_HsAMELX(17-47,168-191)
auggccgucauggccccccgcacccucguccuacuccucuccggcgcccucgcccucacccaaaccugggccaugccccuccccccccaccccggccaccccggcuacaucaacuucuccuacgaaguccucaccccccucaaaugguaccaauccauccgccccccccccaugcuccccgaccucacccucgaagccuggcccuccaccgacaaaaccaaacgcgaagaagucgacuaa

SEQ ID NO: 1104 - RNA, 579 nt, Artificial Sequence
  derived and/or modified CDS sequence (opt11) from Homo sapiens__NP_001134.1__HsAMELY
augggcaccuggauccucuucgccugccucgucggcgccgccuucgcaaugccccuccccccccaccccggccaccccggcuacaucaacuucuccuacgaaguccucaccccacucaaaugguaccaauccaugauccgcccacccuacucauccuacggcuacgaaccaaugggcggcuggcuccaccaccaaaucauccccgucguaucccaacaacacccccucacccacacccuccaaucccaccaccacauccccgucguccccgcacaacaaccccgcguccgccaacaagcccucaugcccguccccggccaacaauccaugacccccacccaacaccaccaacccaaccucccccuccccgcccaacaacccuuccaaccccaacccguccaaccccaaccccaccaacccaugcaaccccaacccccaguccaacccaugcaaccccuccucccccaacccccccucccccccauguucccacuccgaccccucccccccauccuacccgaccuccaccuugaagccuggcccgccaccgacaaaaccaaacaagaagaagucgacuaa

SEQ ID NO: 1105 - RNA, 138 nt, Artificial Sequence
  derived and/or modified CDS sequence (opt11) from Homo sapiens__NP_001134.1__HsAMELY-TRAP
augccccuccccccccaccccggccaccccggcuacaucaacuucuccuacgaaguccucaccccccucaaaugguaccaauccaugauccgcccccccuacuccuccuacggcuacgaacccaugggcggcugguaa

SEQ ID NO: 1106 - RNA, 171 nt, Artificial Sequence
  derived and/or modified CDS sequence (opt11) from Homo sapiens__NP_001134.1__HsAMELY-LRAP
augccccuccccccccaccccggccaccccggcuacaucaacuucuccuacgaaguccucaccccccucaaaugguaccaauccaugauccgccccccccccauccuccccgaccuccaccucgaagccuggcccgccaccgacaaaaccaaacaagaagaagucgacuaa

SEQ ID NO: 1107 - RNA, 210 nt, Artificial Sequence
  derived and/or modified CDS sequence (opt11) from Homo sapiens__NP_001134.1__HLA-A2-SP_HsAMELY(17-61)
auggccgucauggccccccgcacccucguccuccuccucuccggcgcccucgcccucacccaaaccugggccaugccccuccccccccaccccggccaccccggcuacaucaacuucuccuacgaaguccucaccccccucaaaugguaccaauccaugauccgcccccccuacuccuccuacggcuacgaacccaugggcggcugguaa

SEQ ID NO: 1108 - RNA, 243 nt, Artificial Sequence
  derived and/or modified CDS sequence (opt11) from Homo sapiens__NP_001134.1__HLA-A2-SP_HsAMELY(17-48,169-192)
auggccgucauggccccccgcacccucguccuccuccucuccggcgcccucgcccucacccaaaccugggccaugccccuccccccccaccccggccaccccggcuacaucaacuucuccuacgaaguccucaccccccucaaaugguaccaauccaugauccgccccccccccauccuccccgaccuccaccucgaagccuggcccgccaccgacaaaaccaaacaagaagaagucgacuaa

SEQ ID NO: 1109 - RNA, 570 nt, Artificial Sequence
  derived and/or modified CDS sequence (opt11) from Sus scrofa__NP_999071.1__SsAMELX-001-1
augggcaccuggauccucuucgccugucuccucggcgccgccuucuccaugccccuccccccccaccccggccaccccggcuacaucaacuucuccuacgaaguccucaccccccucaaaugguaccaaaacaugauccgacaccccuacaccuccuacggcuacgaacccaugggcggcuggcuccaccaccaaaucauccccgucgucucccaacaaaccccccaaucccacgcccuucaaccccaccaccacauccccaugguccccgcccaacaacccggcauaccccaacaacccaugaugccccucccuggccaacacuccaugacccccacccaacaccaccaacccaaccucccccuccccgcccaacaacccuuccaaccccaacccguccaaccccaaccccaccaaccccuccaaccccaaucccccaugcaccccauccaaccccuccucccccaaccaccccuaccccccauguucuccaugcaaucccuccuccccgaccucccccucgaagccuggcccgccaccgacaaaacaaaacgugaagaagucgacuaa

SEQ ID NO: 1110 - RNA, 138 nt, Artificial Sequence
  derived and/or modified CDS sequence (opt11) from Sus scrofa__NP_999071.1__SsAMELX-TRAP
augccccuccccccccaccccggccaccccggcuacaucaacuucuccuacgaaguccucaccccccucaaaugguaccaaaacaugauccgccaccccuacaccuccuacggcuacgaacccaugggcggcugguaa

SEQ ID NO: 1111 - RNA, 171 nt, Artificial Sequence
  derived and/or modified CDS sequence (opt11) from Sus scrofa__NP_999071.1__SsAMELX-LRAP
augccccuccccccccaccccggccaccccggcuacaucaacuucuccuacgaaguccucaccccccucaaaugguaccaaaacaugauccgccaccccucccuccuccccgaccucccccucgaagccuggcccgccaccgacaaaaccaaacgcgaagaagucgacuaa

SEQ ID NO: 1112 - RNA, 210 nt, Artificial Sequence
  derived and/or modified CDS sequence (opt11) from Sus scrofa__NP_999071.1__HLA-A2-SP_SsAMEL(17-61)
auggccgucauggccccccgcacccucguccuccuccucuccggcgcccucgcccucacccaaaccugggccaugccccuccccccccaccccggccaccccggcuacaucaacuucuccuacgaaguccucaccccccucaaaugguaccaaaacaugauccgccaccccuacaccuccuacggcuacgaacccaugggcggcugguaa

SEQ ID NO: 1113 - RNA, 243 nt, Artificial Sequence
  derived and/or modified CDS sequence (opt11) from Sus scrofa__NP_999071.1__HLA-A2-SP_SsAMEL(17-49,167-189)
auggccgucauggccccccgcacccucguccuccuccucuccggcgcccucgcccucacccaaaccugggccaugccccuccccccccaccccggccaccccggcuacaucaacuucuccuacgaaguccucaccccccucaaaugguaccaaaacaugauccgccaccccucccuccuccccgaccucccccucgaagccuggcccgccaccgacaaaaccaaacgcgaagaagucgacuaa

SEQ ID NO: 1114 - RNA, 534 nt, Artificial Sequence
  derived and/or modified CDS sequence (opt11) from Sus scrofa__P45561-2__SsAMELX-001-2
augggcaccuggauccucuucgccugccuccucggcgccgccuucuccaugccccuccccccccaccccggccaccccggauacaucaacuucuccuacauccgacaccccuacaccuccuacggcuacgaacccaugggcggcuggcuccaccaccaaaucauccccgucgucucccaacaaaccccccaaucccacgcccuccaaccacaccaccacauccccaugguccccgcccaacaacccggcaucccccaacaacccaugaugccccuccccggccaacacuccaugacccccacccaacaccaccaacccaaccucccccuucccgcccaacaacccuuccaaccccaacccguccaaccccaaccccaccaaccccuacaaccccaaucccccaugcaccccauccaaccccuccucccccaacccccccuaccccccauguucuccaugcaaucccuccuccccgaccucccccucgaagccuggcccgccaccgacaaaaccaaacgcgaagaagucgacuaa

SEQ ID NO: 1115 - RNA, 570 nt, Artificial Sequence
  derived and/or modified CDS sequence (opt11) from Sus scrofa__NP_998965.1__SsAMELX-001-3
augggcaccuggaucuucuucgccugccuccucggcgccucccucgccaugccccucccaccccaccccggccaccccggcuacaucaacuucuccuacgaaguccucacaccccucaaaugguaccaaaacaugauccgccaccccuacaccuccuacggcuacgaacccaugggcggcuggcuccaccaccaaaucauccccgucgucucucaacaaacaccccaaucccacgcccuccaaccccaccaccacauccccaugguccccgcccaacaacccggcauaccccaacaacccaugaugccccuccccggccaacacuccaugacccccacccaacaccaccaacccaaccucccccuccccgcccaacaacccuuccaaccccaacccguccaaccccaaccccaccaaccccuccaaccccaaucccccaugcaccccauccaaccccuacucccccaaccaccccuaccacccauguucuccaugcaaucccuccuccccgaccucccccucgaagccuggcccgccaccgacaaaaccaaacgcgaagaagucgacuaa

SEQ ID NO: 1116 - RNA, 219 nt, Artificial Sequence
  derived and/or modified CDS sequence (opt11) from Sus scrofa__K7GPB2__SsAMELX-002
augggcaccuggauccucuucgccugccuccucggcgccgccuucuccaugccccuccccccccaccccggccaccccggcuacaucaacuucuccuacgaaguccucaccccccucaaaugguaccaaaacaugauccgccaccccucccuccuccccgaccucccccucgaagccuggcccgccaccgacaaaaccaaacgcgaagaagucgacuaa

SEQ ID NO: 1117 - RNA, 612 nt, Artificial Sequence
  derived and/or modified CDS sequence (opt11) from Sus scrofa__K7GLD0__SsAMELX-003
augggcaccuggauccucuucgccugccuccucggagccgccuucuccaugccccuacccccccaccccggccaccccggcuacaucaacuucuccuacgaagaccuuuaccucgaagccauccgcaucgaccgcaccgccuucguccucaccccccuaaaaugguaccaaaacaugauccgccaccccuacaccuccuacggcuacgaacccaugggcggcuggcuccaccaccaaaucauccccgucgucucccaacaaaccccccaaucccacgcccuccaaccccaccaccacauccccaugguccccgcccaacaacccggcaucccccaacaacccaugaugccccuccccggccaacacuccaugacccccacccaacaccaccaacccaaccucccccuccccgcccaacaacccuuccaaccccaacccguacaaccccagccccaccaaccccuucaaccccaaucccccaugcaccccauccaaccccuccucccccaacccccccuaccccccauguucuccaugcaaucccuccuccccgaccucccccucgaagccuggcccgccaccgacaaaaccaaacgcgaagaagucgacuaa

SEQ ID NO: 1118 - RNA, 498 nt, Artificial Sequence
  derived and/or modified CDS sequence (opt11) from Sus scrofa__K7GPE9__SsAMELX-004
augggaaccuggauccucuucgccugccuccucggcgcagccuucuccaugccccuccccccccaccccggccaccccggcuacaucaacuucuccuacgaaguccucaccccccuaaaaugguaccaaaacaugauccgccaccccacaccccaaucacacgcccuccaaccccaccaccacauccccaugguccccgcacaacaacccggcaucccccaacaacccaugaugccccuccccggccaacacuccaugacacccacccaacaccaccaacccaaccuaccccuccccgcccaacaacccuuccaaccccaacccguccaaccccaaccccaccaaccccuccaaccccaaucccccaugcaccccauccaaccccuccucccccaacccccccucccacccauguucuccaugcaaucccuccuccccgaccucccacucgaagccuggcccgccaccgacaaaaccaaacgcgaagaagucgacuaa

SEQ ID NO: 1119 - RNA, 522 nt, Artificial Sequence
  derived and/or modified CDS sequence (opt11) from Sus scrofa__J9JIM4__SsAMELX-201
augccccuacccccacaccccggccaccccggcuacaucaacuucuccuacgaaguccucaccccacucaaaugguaccaaaacaugauccgccaccccuacaccuccuacggcuacgaacccaugggcggcuggcuccaccaccaaaucauccccgucgucucccaacaaaccccacaaucccacgcccuccaaccccaccaccacauccccaugguccccgcccaacaacccggcaucccccaacaacccaugaugccccuccccggccaacacuccaugacccccacccaacaccaccaacccaaccuaccccuccccgcccaacaacccuuccaaccccaaccaguccaaccccaaccccaccaaccccuccaaccccaaucccccaugcacccaauccaaccccuacucccccaaccuccccuaccacccauguucuccaugcaaucccuccuccccgaccucccccucgaagccuggcccgccaccgacaaaaccaaacgcgaagaagucgacuaa

SEQ ID NO: 1120 - RNA, 2961 nt, Artificial Sequence
  derived and/or modified CDS sequence (opt11) from Homo sapiens__NP_006120.1__HsBMP1
augccaggaguugcccgccuaccacuacuacuaggucuccucuuacucccgcgacccggccgcccacucgaccuagcagacuacacauacgaccucgcagaagaagacgacucagaaccacuaaacuacaaagaucccugcaaagccgcggcauuccucggagacauagcccuggacgaagaagaucuacgagcauuccagguccaacaagcaguagaccuccggcgacacacagcucgcaaaucguccaucaaagcggccgucccaggcaacacaaguaccccuuccugccaguccaccaacggucaaccccaacggggagccugcggacgcuggcguggcaggucacgaucccggcgagcagccaccagcagaccggaacgaguauggcccgacggggucaucccauucguaaucggugggaacuucacgggaucgcaacgagcaguauuccgacaggccaugcgccacugggaaaaacacacaugcgucaccuuccucgaacgcacagacgaagacagcuacauagucuucacauacagaccaugcggaugcugcaguuacgucggacggagaggcggcggcccgcaagcaauaucgauagggaaaaacugcgacaaauucggcauagucguccacgaacuagggcaugucguaggguucuggcacgagcacaccaggcccgaccgagaccgccacguaagcauaguccgcgaaaacauccaacccggacaggaauacaacuuccucaagauggaaccccaagaagucgagucgcugggggaaacauacgacuucgacuccauaaugcacuacgcccgaaacaccuucagccgagguaucuuccucgacacaaucguccccaaguacgaagucaacggcgucaaacccccaauaggccaacggacccgacucucaaaaggugacaucgcucaggcccgcaaacuguauaagugccccgccuguggggagacccuacaggacagcacgggcaacuucagcuccccugaauaccccaacggcuacagcgcacacaugcacugcgucuggcgcaucagugucaccccaggagagaaaaucauccucaacuucaccucacucgaucucuaccgaagcagacucuguugguacgacuacguggagguccgagacggguucuggcgcaaagcaccgcuccgcggccgcuucugcggcucuaaacuucccgaacccauugucagcaccgacucgagacucugggucgaguucaggaguuccagcaacuggguaggcaaaggauucuuugcagucuacgaagccauaugcggcggcgacgucaagaaagacuacggccacauccaguccccaaacuacccagacgacuaccgccccuccaaagucugcauauggaggauacaaguaucagaaggguuucacgucggacugacauuccaaaguuucgaaauagaacgucacgacucaugcgcguacgacuaccuggaaguacgcgacggccauuccgaaagcagcacacuaauaggccgguacuguggcuacgaaaagcccgacgacauaaaaucaacaucaagcagacuguggcuaaaguucgucucggacggaagcauaaacaaagcaggauucgcagugaacuucuuuaaggaagucgacgaauguucgcgcccaaacaggggaggcugcgaacaaagaugccuuaacacacuggggucauauaagugcagcugcgaccccggauacgagcuugcaccagacaagcgaagaugugaggccgccugcggaggcuuccucacaaaacugaacggauccaucacaucacccggauggccaaaagaguaucccccgaauaaaaacugcauauggcagcuaguagcgccaacccaauaccggaucagccuccaguucgacuucuucgaaaccgaaggcaacgacgugugcaaauacgacuucgucgagguacgcagcggucuuaccgcggacucaaaacugcacggcaaauucugcggcagcgaaaaaccagaaguaaucaccagccaauacaacaacaugagagucgaauuuaaaucagacaacaccguauccaagaaaggcuucaaagcccacuucuuuuccgauaaagacgaaugcaguaaagauaacgggggcugucagcaagacugcguuaacacauucggaagcuacgaaugucaaugccgcaguggguucgugcugcacgacaacaaacacgacugcaaagaagcaggaugcgaccauaaagucaccagcacaagcggaacgaucacuagccccaacuggccggacaaauacccauccaagaaagaaugcacaugggccaucuccagcacccccggccaccgcgucaaauuaacauucauggagauggacaucgaaucacaacccgaaugcgccuacgaccaccuggagguauucgacggccgagacgccaaagcaccagugcucggccgcuucugcggcuccaagaaaccagaaccagugcuagccaccggcagucgaauguuccuccgcuucuacagugacaacaguguacaacgaaaaggauuccaagcaagccacgcaacagaaugcgguggccaaguccgggccgacgucaaaacaaaagaccuauacucacaugcucaauucggugacaacaacuacccgggcgguguagacugcgaaugggucaucgucgcagaagagggauacggggucgaacucguguuccaaacauucgaagucgaggaagagacagauuguggcuacgacuacauggaacucuucgacggguacgacagcaccgcccccagacuaggccgcuacuguggaucagguccacccgaagaagucuacagcgccggugacucaguacucgugaaauuccacagcgacgacacaauuacaaagaaaggcuuccaccuaagauacacguccaccaaauuccaggacacccuccacagccgcaaauga

SEQ ID NO: 1121 - RNA, 1191 nt, Artificial Sequence
  derived and/or modified CDS sequence (opt11) from Homo sapiens__NP_001191.1__HsBMP2
auggucgccggcacccguugccuccuugcccuccuccuaccccaaguccuacuaggcggagcagccggccucguccccgaacucggccgccgcaaauucgccgccgccucauccggacgccccuccucacaacccagcgacgaaguacucucagaauucgaacuucgucuacucuccauguucggccucaaacaacgacccacucccucccgcgacgcagucguccccccuuacaugcuagaccuuuaccgccgccacuccggccaacccggaucacccgcccccgaccaucgccucgaaagagccgccucccgagccaauaccguccgcucauuccaccacgaagaaucacucgaagaacuacccgaaaccagcggaaaaacaacacgcagauucuucuucaaccucuccagcauccccaccgaagaauucaucaccuccgccgaacuacaaguauucagagaacaaaugcaggacgcccucggcaacaacuccagcuuccaccaccgcaucaacauauacgaaauaaucaaacccgccacagcuaacuccaaguuccccgucacacgccuacucgacacccgccuagucaaccaaaaugccucccgcugggaauccuucgacgucacccccgccgucaugcgauggaccgcacaaggccacgccaaucacggcuucgucguagaaguugcacaccuagaagaaaaacaaggcgucuccaaacgccacguccgcaucuccagaucccuacaccaagacgaacacucauggucccaaauccgcccccuccuagucaccuucggacaugacggcaaaggacacccgcuccacaaacgcgaaaaacgccaagccaaacacaaacaacgcaaacgccucaaaucauccugcaaacgccacccacucuacguagacuucuccgacguaggauggaacgacuggauagucgcacccccaggcuaccacgcauucuacugccacggagaaugcccauucccacuugccgaccaccucaacuccaccaaccacgcuaucguacaaacacucgucaacuccgucaacucaaaaaucccaaaagcaugcugcguccccacagaacucucagccaucuccaugcucuaccucgacgaaaacgaaaaggucguccuaaaaaacuaccaagacauggucgucgaaggcugcggcugccgcuag

SEQ ID NO: 1122 - RNA, 1227 nt, Artificial Sequence
  derived and/or modified CDS sequence (opt11) from Homo sapiens__NP_001193.2__HsBMP4
augauaccgggcaaccgcaugcucauggucguucuccugugccaaguccuacucggcggcgcaagccacgccucacucauccccgaaacugggaaaaaaaaagucgccgaaauccaaggccacgccggcggaagacgcuccggccaaucacacgaacuccuccgcgacuucgaagccacccuacuacaaauguucggccuccgccgccgcccacaacccucaaagagcgccgucauccccgacuacaugcgcgaccuauaccgacuccaauccggcgaagaagaagaagaacaaauccacuccaccggacucgaauaccccgaacgccccgccucccgagcaaacaccguacguucuuuccaccacgaagaacaccucgaaaauauccccggcaccuccgaaaacuccgcauuccgcuuccuauucaaccucuccuccauccccgaaaacgaaguaaucucauccgcagaacuccgccuauuccgcgaacaagucgaccaaggccccgacugggaaagaggcuuccaccgaauaaacauuuacgaagucaugaaacccccagccgaagucguacccggccaccucaucacacgacuucucgacacacgccuaguccaccauaacguaacucgcugggaaaccuucgacguaagccccgccguccuccgauggacccgugaaaaacagcccaacuacggccucgcaauugaagucacccaccuccaccaaacacgcacacaccaaggccaacauguccgcauaucccgaucacucccacaaggcuccggcaacugggcccaacuccguccacuccucguuaccuucggccaugacggacgcggucacgcccucaccagacgccgcagggccaaacgaucccccaaacaucacucccagcgcgcucguaaaaaaaacaaaaacugccgccgccauucccuauacguagacuucuccgacgucggcuggaacgacuggauagucgcaccccccggauaccaagccuucuacugccacggcgacugccccuucccacucgcagaccaccuaaacucaaccaaucacgccaucguacaaacccucguaaacucagucaacuccuccauucccaaagccugcugcguacccaccgaacuauccgccaucuccaugcucuaccuagacgaauacgacaaagucguccucaaaaacuaccaagaaauggucgucgaaggcugcggcugccgauag

SEQ ID NO: 1123 - RNA, 1542 nt, Artificial Sequence
  derived and/or modified CDS sequence (opt11) from Homo sapiens__NP_001709.1__HsBMP6
augcccgggcuaggccgacgagcacaauggcuaugcuggugguggggccuacuaugcucaugcugcggaccaccuccccuacgcccaccccugcccgcagccgcugccgcagcugccggcggccaacuacuaggcgacggcggcucacccggccgaacagaacaacccccucccucuccccaauccucauccggauuccuauaccgcagacucaaaacccaagaaaaacgcgaaaugcaaaaagaaauccuaucaguacucggccugccacauagacccagaccccuccacggacuccaacaaccccaaccucccgcccugcgucaacaagaagaacaacaacaacaacagcaacuaccccgcggcgaacccccacccggccgccuaaaaucagcaccccuauuuaugcucgaccuuuacaacgcccucucugccgacaaugaugaagacggcgccuccgaaggugaacgccaacaauccuggccccacgaagccgccucaucaucacaacgacgacaacccccacccggcgccgcccacccacucaaccgaaaaucccuucucgcccccggaucugguuccgggggcgcuuccccacucaccuccgcacaagacagcgccuuccuaaacgacgccgacaugguuaugucauucguaaaccuagucgaauacgacaaagaauuuucacccagacaaagacaccauaaagaguucaaauucaaccucucccaaaucccagaaggcgaagucguaacagccgccgaguuccgaaucuacaaagacugcgucaugggauccuucaaaaaccaaaccuuccuaauaagcaucuaccaaguacuacaagaacaccaacaccgugacuccgaccucuuucuucuagacacccgaguagucugggccucagaagaagguuggcuugaguucgacaucaccgccaccagcaaccuauggguagucacaccccaacacaacaugggacugcaacuaucagucguaacccgcgacggcguacacguucacccccgagcagccggacucguaggucgcgacggacccuacgacaaacaacccuucauggucgccuucuuuaaagucuccgaaguacacguccgaacaacacgauccgcaucaucccgccgccgccagcaaucccggaaccgaucaacacaaucccaagacgucgcccgcgucagcucggcuucggacuacaacuccagcgaacuaaaaacagcaugccgcaaacacgaacuauacgucuccuuucaagaccucggauggcaagacuggaucaucgcacccaaaggauacgcagcaaacuacugcgacggagaaugcuccuucccccuaaaugcacacaugaacgcaaccaaccacgccaucguccaaacccucguccaccuaaugaaccccgaauauguacccaaacccugcugcgccccaaccaaacuaaacgcaaucucaguacucuacuucgacgacaacuccaacguaauccucaagaaauaccgcaacaugguuguccgugccugcggaugccacuaa

SEQ ID NO: 1124 - RNA, 1296 nt, Artificial Sequence
  derived and/or modified CDS sequence (opt11) from Homo sapiens__NP_001710.1__HsBMP7
augcacguccgaucacuacgcgccgcagccccacacuccuucguagcacucugggcaccccuauucuuacuccgcuccgcacuagccgacuucucccucgacaacgaaguccacucgagcuucauccaccgccgccuacggucccaagaaagacgcgaaaugcaacgcgaaauccucucaauucuaggacucccccaccgcccccgcccccaccuccaaggcaaacacaacucugcccccauguucaugcucgaccucuacaacgccauggcaguagaagaaggaggcggacccggcggccaaggcuucucauaccccuacaaagccguuuucucaacccaaggcccgccccucgcaucccuccaagacucacacuuccuaaccgacgccgacaugguaaugucauucgucaaccucguagaacaugacaaagaauucuuccacccccgcuaucaccaccgcgaauuccgauucgaccucucgaaaauacccgaaggcgaagccgugaccgcagccgaauuccgcauauacaaagacuacauccgcgaacgcuucgacaacgaaacauuccgcaucuccgucuaccaagugcuccaagaacaccucggccgcgaaagcgaccucuuccuacuugacucccgcacacuuugggccucugaagaagguuggcucguauucgacauaacagccaccucaaaccacuggguagucaacccccgucacaaccuaggacuccagcuaucaguagaaacacucgacggccagagcaucaaccccaaacuugcgggacucaucggccgccacggaccacaaaacaagcagcccuucauggucgccuucuuuaaagccaccgaaguacauuucagauccauacgcuccaccggguccaaacaacgaucacaaaaccgauccaaaaccccaaaaaaccaagaagcucuacgaauggcaaacguagcugaaaacagcuccucagaccaacgccaagccugcaaaaaacacgaacucuacgucuccuuccgagaccucggcuggcaagacuggaucaucgccccagaaggcuacgcagcauacuacugcgaaggcgaaugcgccuucccccuuaacucuuacaugaacgccaccaaccacgcaaucguccagacccucguacacuucaucaaccccgaaacuguccccaaacccugcugcgcccccacccaauuaaacgcaaucuccguccucuacuucgacgacuccucgaacgucauacucaaaaaauaccgaaacauggucguccgcgccugcggcugccauuaa

SEQ ID NO: 1125 - RNA, 300 nt, Artificial Sequence
  derived and/or modified CDS sequence (opt11) from Homo sapiens__NP_006264.2__HsCCL7
augaaagccuccgccgcccuccucugccuccuccucaccgccgccgccuucuccccccaaggccuagcccaacccgucggcaucaacaccuccaccaccugcugcuaccgauucaucaacaaaaaaauccccaaacaacgccucgaauccuaccgccgcaccaccuccucacacugcccccgcgaagccgucaucuucaaaaccaaacucgacaaagaaaucugcgccgaccccacccaaaaauggguccaagacuucaugaaacaccucgacaaaaaaacccaaacccccaaacucuaa

SEQ ID NO: 1126 - RNA, 3624 nt, Artificial Sequence
  derived and/or modified CDS sequence (opt11) from Homo sapiens__NP_001954.2__HsEGF
augcugcucacgcugaucaucuuauuaccggucgucaguaaauuuagcuuuguaucacugagcgcaccccaacacuggucaugcccagagggcacuuuggcagggaacggcaauucgacgugcguaggaccagccccauuccugaucuucagccacggaaauagcaucuuccgaaucgacacagaaggaacgaacuaugagcaacucguagucgacgcagggguaucgguuaucauggacuuccauuacaacgagaaaagaauauacugggucgaccuagaacgacagcuccugcaaaggguauuccugaacggcucgcggcaggaacggguaugcaacauagagaaaaacgucagcggcauggccauaaacuggaucaacgaagaagugaucugguccaaccaacaggaaggcaucauaaccgucacugacaugaaaggaaacaacagccacauccuccuaucagcgcuaaaguaccccgccaaugucgcggucgacccaguagaacgguucauuuucugguccuccgaaguagcugggagccuuuaccgcgcagaccuagacggcgucggaguaaaagcacuacuugaaacauccgagaaaauaacagcaguaucccuugacguccuagacaagcgccucuucuggauacaauacaaucgcgaagggucuaacagccucaucugcaguugugacuaugacggcgggagcguacacaucucaaaacacccaacacaacauaaucuauucgcgaugagccucuucggugacagaauauucuacucaaccuggaagaugaaaacaauauggauagccaacaaacacacaggcaaagacaugguccgcaucaaccuccacagcuccuucguaccccucggcgaacuaaaaguagugcacccccuagcccagcccaaagccgaagaugauacgugggaacccgaacaaaagcugugcaaacugcgcaaagggaacugcagcaguaccguuugcggucaagacuuacagucucaccucugcaugugcgcugagggguacgcccuuucgagagacagaaaauacugcgaggacgucaacgaaugcgccuuuuggaaccacggcugcacacuuggcugcaaaaauacaccgggaagcuacuacugcacaugucccguaggauucguccuucuacccgauggaaagcgcugccaccaacuggucucguguccucgcaacgucucggaaugcagccaugacugcguacuaaccuccgaagguccacuaugcuucugcccagaggguucaguucuagagcgggacggcaagacaugcaguggaugcucauccccagacaacggcggaugcucccaacuaugcgucccacugagcccggucucaugggaaugcgacugcuucccuggguacgaccuccagcuugaugaaaaaucaugcgcugccuccgggccccagcccuuccuacucuucgccaacucgcaagacauaagacauaugcacuucgacggcacagauuacgggacccugcugucccaacagaugggcaugguauacgcacucgaccacgacccaguggaaaauaaaaucuauuucgcccacacagcccuuaaguggaucgaacgcgccaacauggacggcagccaaagagaacggcucauagaagaggggguggacgugccagagggccucgcugucgacuggauagggcgccgguucuacuggacagaccggggcaaaagccucauaggcagaucagaccucaacgggaaaaggagcaagaucauaacgaaagagaauaucucgcaaccccgcggaaucgccguccacccaauggcaaaaagacuauucuggacagauacgggaauaaacccccggaucgagagcuccucccuacaagggcucgggcgguuaguaaucgccuccagcgaccuaauauggcccagcgggauuaccaucgacuuccuaacagacaaacucuacuggugcgacgcaaaacaauccgucaucgaaauggccaaucuagacgguagcaaacgacgccgacucacacaaaacgacguaggccaucccuuugcggucgccgucuucgaggacuacgucugguucucugauugggccaugcccucagucaugcgagucaacaagcgcacgggaaaggaucgagugaggcuccagggcucgauguugaaaccaagcagccuaguagucguccacccacuggcaaaaccaggcgcagacccaugccuauaccagaacgggggcugugagcacaucuguaaaaagagacuaggaaccgcauggugcucaugcagggaaggguucaugaaagcguccgacggcaaaaccugccuugccuuagacggacaccaacuccuagcaggaggcgaaguugaccuuaaaaaccaaguaacgccguuagauauccucagcaaaacaaggguaagcgaggauaacaucaccgagucacagcacaugcucguggcagaaauuauggugucagaccaagacgacugcgcacccguaggcugcucuauguacgcaagaugcauauccgaaggcgaagacgccacaugccagugccugaagggcuuugccggggacgguaaacugugcuccgacauagaugagugcgaaaugggaguacccgucuguccgcccgcaagcuccaaaugcauaaacacagaaggcggauacgugugccggugcucagaaggauaccaaggcgacggaauccacugccuggacaucgacgaaugccaguuaggugaacauucgugcggggaaaacgccuccugcacuaacaccgaaggaggcuacacaugcaugugcgccggacgucugagcgaacccgggcuaauaugccccgacuccacaccacccccacacuugcgcgaggacgaccaccauuacagcguacggaacagcgacagcgaaugcccccuaucacacgacggcuacugcuuacacgacggcgucugcauguacaucgaagcccuagacaaauacgcgugcaacugcgugguagguuacauaggugagcguugccaauaccgagaccuuaaauggugggaacuacgccacgccggacacggccaacagcagaaggucaucgucgucgcaguaugcgucguaguccucgucaugcuucuacuccuaucacuauggggcgcacacuacuacagaacucaaaaauuauuaagcaagaaccccaaaaauccguacgaggaauccagcagagauguccgcagccggagaccggcggacacggaggacggcauguccucgugcccgcaacccugguucgucgucaucaaagaacaccaagaccugaagaacggcggccaacccguagcaggagaagacggacaagccgccgacggaagcaugcaaccgaccucguggcgacaagaaccccagcuaugcggcaugggcacugagcagggcugcuggauuccaguaaguagugacaaagguagcugcccacaggucauggagcgauccuuccauaugccuucuuacggaacacaaacacuagaaggcgguguagaaaagccgcauucucuccuguccgcaaacccgcucuggcaacaacgagcacuagauccaccccaccaaauggaacucacccaauaa

SEQ ID NO: 1127 - RNA, 510 nt, Artificial Sequence
  derived and/or modified CDS sequence (opt11) from Homo sapiens__NP_001423.1__HsEREG
augaccgccggccgccgcauggaaaugcucugcgccggccgcguccccgcacuccuccucugccucggcuuccaccuccuucaagccguccucuccaccaccgucauccccuccugcauccccggcgaauccuccgacaacugcaccgcccuaguccaaaccgaagacaacccacgcgucgcccaagucuccaucacaaaaugcuccuccgacaugaacggcuacugccuccacggccaaugcaucuaccucgucgacaugucccaaaacuacugccgcugcgaagucggcuacaccggcguccgcugcgaacacuucuuccucaccguccaccaaccccucuccaaagaauacgucgcccucaccgucauccucaucauccucuuccucaucaccgucgucggcuccaccuacuacuucugccgcugguacagaaaccgcaaauccaaagaacccaaaaaagaauacgaacgcgucaccuccggcgaccccgaacucccccaagucuaa

SEQ ID NO: 1128 - RNA, 468 nt, Artificial Sequence
  derived and/or modified CDS sequence (opt11) from Homo sapiens__NP_000791.1__HsFGF1
auggccgaaggcgaaaucaccaccuucaccgcccucaccgaaaaauucaaccucccccccggcaacuacaaaaaacccaaacuccucuacugcuccaacggcggccacuuccuccgcauccuccccgacggcaccgucgacggcacccgcgaccgcucagaccaacacauccaacuccaacucuccgccgaauccgucggcgaaguauacauaaaauccaccgaaaccggccaauaccucgccauggacaccgacggccuccucuacggcucccaaacccccaacgaagaaugccucuuccucgaacgccucgaagaaaaccacuacaacaccuacaucuccaaaaaacacgccgaaaaaaacugguucguaggccucaaaaaaaacggcuccugcaaaagaggcccccgcacccacuacggccaaaaagccauccucuuccucccacuccccgucucaucagacuaa

SEQ ID NO: 1129 - RNA, 867 nt, Artificial Sequence
  derived and/or modified CDS sequence (opt11) from Homo sapiens__NP_001997.5__HsFGF2
augguggggguagggggaggggacguggaggacguaacgccgaggccgggagggugucagauaagcgggagaggggcgagagggugcaacggaauaccgggagcggcggcgugggaggcggcgcugccgaggaggaggccgaggaggcacccgagcguaaacccaagaagcagagcagcagggagcccgaggacgagggggagaaggacggaggagaggccgagugggagcaggcugggggaucgggggagggggagagcacugccgggagggcgacuagggggaagagggagggggagggcgccggagagggugggagggagggggagggggagggggacggcggcgccgagagcggcgccggcggcgagggggagcaggccgggaccggcggggacgauggcagcggggagcauaaccacguugccggcgcugccggaagauggagggaguggggcguucccaccggggcacuucaaggauccgaagagacuguauuguaagaauggaggguucuuucuaaggauacauccggaugggagaguggauggggugagggaaaagagugacccgcacauaaagcugcaguugcaggcggaggagagagggguaguaagcauaaagggggugugcgcaaauagguaucuggcgaugaaggaggaugggaggcuauuggcgagcaagugugugacggacgagugcuuuuucuuugaaaggcuagagagcaauaacuacaacacguacaggagcagaaaguauacgagcugguauguggcgcugaagagaacgggacaguacaaguuagggagcaagacagggccagggcagaaggcaauauuguuccugccaaugagugcaaagagcuag

SEQ ID NO: 1130 - RNA, 585 nt, Artificial Sequence
  derived and/or modified CDS sequence (opt11) from Homo sapiens__NP_002000.1__HsFGF7
augcacaaauggauccucaccuggauccuccccacccuccucuaccgcuccugcuuccacaucaucugccucgucggcaccaucucccucgccugcaacgacaugacccccgaacaaauggccacaaacgucaacugcuccucccccgaacgccacacccgcuccuacgacuacauggaaggcggcgacauccgcguccgccgacucuucugccgcacccaaugguaccuacgcaucgacaaacgcggcaaaguaaaaggcacccaagaaaugaaaaacaacuacaacaucauggaaauccgcacagucgccgucggcauagucgcaaucaaaggcgucgaauccgaauucuaccucgccaugaacaaagaaggcaaacucuacgccaaaaaagaaugcaacgaagacugcaacuucaaagaacucauccucgaaaaccacuacaacaccuacgccuccgccaaauggacccacaacggcggcgaaauguucgucgcccucaaccaaaaaggcauccccguccgcggcaaaaaaaccaaaaaagaacaaaaaaccgcccacuuccuccccauggccaucaccuaa

SEQ ID NO: 1131 - RNA, 627 nt, Artificial Sequence
  derived and/or modified CDS sequence (opt11) from Homo sapiens__NP_001936.1__HsHBEGF
augaaacuccuccccuccguaguccucaaacuauuccucgcagccguccuauccgcccucgucaccggcgaaucacucgaacgccuccgccgcggccucgccgcaggcacaagcaaccccgacccccccaccgucuccaccgaccaacuccucccccuaggcggcggccgagaccgcaaaguccgcgaccuccaagaagcagaccucgaccuccuccgcgucacccucuccuccaaaccccaagcccuagcaacccccaacaaagaagaacacggcaaacgaaaaaaaaaaggcaaaggacuaggcaaaaaacgcgaccccugccuccgcaaauacaaagacuucugcauccacggcgaaugcaaauacgucaaagaacuacgcgcccccuccugcauaugccaccccggcuaccacggcgaacgaugccacggccuaucccuccccguagaaaaccgacuauacaccuacgaccacaccaccauccucgccgucgucgccgucguccucucauccgucugccuacucguaaucguaggacuccucauguuccgcuaccaccgccgaggcggcuacgacgucgaaaacgaagaaaaagucaaacucggcaugaccaacucccacuaa

SEQ ID NO: 1132 - RNA, 2187 nt, Artificial Sequence
  derived and/or modified CDS sequence (opt11) from Homo sapiens__NP_000592.3__HsHGF
augugggucacuaaacuacuccccgcccuccuacugcaacacguucuccuccaccuauuacugcuccccauugcaaucccauacgccgaaggccagcgaaaacgccgcaacacgauccacgaauuuaagaaaagcgcaaaaacaacccuaaucaaaauagacccugcacuaaaaauaaaaaccaagaaagucaacacagcagaccaaugcgcuaacagaugcacccggaacaaaggccugccguucacaugcaaggcauucgucuucgacaaggcccgcaaacaaugccugugguucccauucaacucaaugagcucaggcgucaagaaagaguucggacacgaguucgaccucuacgaaaacaaagacuacauccgcaacuguaucaucggaaaaggaagauccuacaaaggcacaguaucaaucaccaaguccggcaucaaaugccaacccuggagcagcaugaucccccacgaacacuccuuccuccccagcucguaccgcggcaaagaccuccaagaaaacuacugccggaacccccgaggagaagaaggcggucccuggugcuucaccuccaaccccgaaguccgcuacgaagucugcgacaucccccaaugcagcgaaguagaaugcaugaccugcaacggcgaauccuacagaggccuaauggaucacaccgaauccggcaagauaugccaacgcugggaccaucaaaccccacaccgccacaaguuccuacccgaacgcuaccccgacaaaggauucgacgacaacuacugccgcaacccugacgggcaaccacgccccuggugcuacacccuagacccacacacacgaugggaauacugcgccaucaaaaccugcgccgauaacacaaugaacgacacugacgucccacuagaaaccaccgaaugcauacaaggacaaggcgaagguuacagaggaaccguaaacacuauauggaacggcauaccuugccaacgcugggacucccaauacccacacgaacacgacaugacucccgaaaacuucaaaugcaaagaccuccgcgaaaacuacugccgcaaucccgauggguccgaaagucccuggugcuucaccacagacccaaacauccgcgugggauacugcucccaaauucccaacugcgacaugucucacggucaagacugcuaccgaggcaacggcaagaacuacaugggaaaccugucacagaccagauccggucuaaccugcuccaugugggacaaaaacauggaagaccuccacaggcacauauucugggaacccgacgccuccaagcucaaugaaaacuacugcaggaaccccgacgacgacgcccacggccccugguguuacacaggaaacccccucauuccuugggacuacugcccaauaucacgcugcgaaggugacacuacacccacaauagucaaccucgaccaccccgucaucucuugcgccaaaacaaaacaacucaggguagucaacggaauccccaccaggacaaacauaggcuggauggucucccuacgguaccgcaacaaacacaucugcggaggcucacugaucaaagaauccuggguccucaccgcacgccaaugcuuccccagcagagaccucaaagacuacgaagccugguuagguauucacgacguccacggcagaggggacgaaaaaugcaagcaaguccucaacguaagccagcucgucuacggacccgaaggaucggaccucguacucaugaaacuggcccgccccgcaguacucgacgacuucgucucaacgauugaccugccaaacuacggaugcacgaucccagaaaagacgucauguagcgucuacgguuggggcuacacgggccucaucaacuacgacggccuccuccgagucgcacaccuuuauaucaugggcaacgaaaaaugcagccagcaccaccgaggcaaagucacacuuaacgaauccgaaaucugugcaggagccgagaaaauaggcucaggacccugcgaaggcgacuacggcggaccccuggucugcgaacaacacaaaaugcgcaugguccuuggcgucaucguacccggacgaggcugcgccauccccaaccgccccggcauauucgucagaguugcauacuaugcaaaauggauccauaaaaucauacuaacauacaaagucccccagucauaa

SEQ ID NO: 1133 - RNA, 1926 nt, Artificial Sequence
  derived and/or modified CDS sequence (opt11) from Homo sapiens__NP_005336.3 __HsHSPA1A
auggcaaaagcagcagcaauaggcaucgaccuaggaaccaccuacucaugcgucggagucuuccagcacggcaaaguagaaauaaucgcuaacgaccaaggaaacagaaccacgcccucguacgucgccuucaccgacaccgaacgacugauaggggacgcagcaaagaaccaggucgcacucaacccacaaaauacagucuucgacgcaaaaagacucauaggcagaaaauucggcgaccccguagugcaaagcgacaugaaacacuggccauuccaagugauaaacgacggggacaaaccaaaaguccaagucucauacaaaggcgaaacaaaggcauucuacccagaagaaaucuccagcauggucuuaaccaaaaugaaagaaauagccgaagcauaccucgguuacccaguaacgaacgcagucauuacaguacccgcauacuucaacgacagccaacggcaagccacgaaagacgcgggagucauagcagggcucaacguauuaagaauaaucaacgaaccaacagcagcagccaucgcauacggccuggaucgcacaggcaagggcgaaagaaacguacugaucuuugaccuaggcgggggcacguucgacguaagcauccugaccauagacgacgggauuuucgaggucaaagcaacagcaggggacacacaccugggcggggaagacuucgacaacagacucgugaaccacuucguagaagaguucaaacgcaaacacaagaaagacaucucgcagaacaaaagagcagugagaagacuacggaccgcgugcgagcgcgcaaaacgcacccuaagcucaagcacgcaggcgagccuggaaauagacagccucuucgaaggaaucgacuucuacacaucuauaacaagagcgagauucgaagaacugugcuccgaccucuuccgcuccacgcuggagccagucgaaaaagcgcuccgggaugcgaaacuggacaaagcacaaauccaugaccucguacuggucggaggcucgacccgcauuccaaaagugcaaaaacuccuccaggacuucuucaacggacgagaccucaacaaaucaaucaaccccgacgaagcagucgcguacggggccgcuguccaagccgcaauccugaugggggacaaaagcgagaaugugcaagaccuccuccuccucgacguggccccacucucgcuuggacucgagaccgcgggaggcguaaugacagcacucauaaaaagaaauucaacaaucccaacaaagcagacacagaucuucacaacguauagcgacaaucaaccgggcguacucauacaaguauacgagggcgaacgcgcaaugacgaaggacaacaaccuucuaggcagauucgagcucucaggcauaccaccagccccacgcgggguaccgcaaauagaagugacauucgacaucgacgcaaacggaaucuuaaacguaacagcgaccgauaaaucaaccggaaaggcgaacaaaaucacaaucacaaacgacaaaggacgccuuucaaaagaagagaucgagagaaugguacaggaggcagaaaaguacaaagcagaggacgagguccaacgcgaaagaguauccgccaaaaacgcccuggaaucauacgcauucaacaugaaguccgccgucgaagacgaaggucuaaagggaaagauauccgaagccgacaaaaagaaaguacuagauaaaugccaagaagucaucagcuggcucgacgcaaacaccuuggccgaaaaagacgaauuugaacacaaaagaaaagaacuugaacaaguaugcaaucccauaaucucaggccuguaccaaggcgcaggcgggccagggcccgggggcuuuggggcacaaggccccaaaggaggaagcggaagcgggccgacaauagaggaaguagacuaa

SEQ ID NO: 1134 - RNA, 1926 nt, Artificial Sequence
  derived and/or modified CDS sequence (opt11) from Homo sapiens__NP_005337.2 __HsHSPA1B
auggcgaaagcagcagcaaucggaaucgaccucgguaccacauacagcugcguaggcguauuccaacacgggaaaguagaaaucauagcaaacgaccaagggaaccggacaacccccuccuacgucgccuucaccgacacagaacgacuuaucggcgacgcagccaaaaaccaggucgccuuaaacccccaaaacaccgucuucgacgcaaaaagacucaucggaagaaaauucggggaccccgugguacaaagcgacaugaaacacuggcccuuccaaguaaucaacgacggagauaagcccaagguccaaguaucguacaaaggcgagaccaaagccuucuacccagaagaaauaucaagcaugguguuaaccaagaugaaggaaaucgccgaagccuaccucggcuacccagugacaaacgccguaauaaccgugcccgcguacuucaaugacucccaacgccaagccacgaaagacgccggcgucauagccggacuaaacguacuacgcauaauaaaugaaccgacagcagccgccaucgcauacggacucgaccgcacaggcaaaggcgaaagaaacguauugauauucgacuuaggcggaggcaccuucgacgucucgauacuaaccauagacgacggaauauucgaggucaaggccaccgccggagacacacaccuaggcggcgaagacuucgauaaucgucuagugaaccacuucguagaagaguucaagcgcaaacacaagaaagacaucucccaaaacaaacgugcagugcgaaggcuaagaaccgcaugcgaacgcgcaaaaagaacccucagcuccagcacacaagcgagccuagaaauagacagucucuucgaaggcaucgauuucuacaccucgauaacuagagcgcgcuucgaagaauuaugcagcgacuuauuccgaucgacauuagaaccuguagaaaaagcgcuccgggacgcgaaacuagacaaagcccaaauccacgacuugguccugguagggggcucuacaaggauaccgaaagugcaaaagcuauuacaagacuucuucaacggacgcgaucucaauaaauccaucaaccccgacgaggcaguagcauacggcgccgcgguccaggcagcgauacucaugggagacaaaucagaaaacgugcaagaccuccugcuccuugacguagcaccacucucgcucggacuagaaacggcgggaggggucaugaccgcacucaucaagagaaacaguaccaucccaaccaaacaaacccaaaucuucaccacauacucagacaaccaaccgggagugcuaauccaaguauacgaaggcgaacgcgcgaugaccaaagacaauaaccugcuaggaagauucgaacuaucaggcauacccccggcuccacgaggcgucccccaaaucgaaguaaccuucgacauagacgccaacggaauccucaacgugacagcgaccgacaaaagcaccgggaaagcaaacaaaaucacaaucacaaacgacaaaggacgauuaagcaaagaagagaucgagcgaaugguccaagaagccgaaaaguacaaagccgaagacgagguccaacgcgaacgaguaagcgccaaaaacgcauuagaauccuacgcguucaauaugaaaagcgcaguagaagacgaaggacugaaagggaaaauaagcgaagcagacaaaaagaaaguacucgacaaaugccaagaaguaaucuccuggcuagacgcaaauacccucgccgaaaaagacgaguucgaacacaaaagaaaagaacuggaacaagugugcaacccaauuaucucaggacuauaccagggggcaggcgggccaggacccggaggauucggcgcgcaaggaccaaaaggaggcagcggaagcggaccaacaaucgaggaaguagacuaa

SEQ ID NO: 1135 - RNA, 1926 nt, Artificial Sequence
  derived and/or modified CDS sequence (opt11) from Homo sapiens__NP_005518.3 __HsHSPA1L
auggcgacagcaaagggcauagcaauaggcaucgaccucggcaccacauacuccugcguaggcgucuuccaacacggcaaaguagaaaucaucgcaaacgaccaaggaaacaggacaacacccucauacgucgcauuuaccgacaccgaaagacuuaucggagacgcggccaaaaaccaggucgcaaugaacccccaaaauaccgucuucgacgcaaagcgacucauaggacgcaaauucaaugaccccgugguacaggcagacaugaaacuauggccguuccaaguuauaaacgaaggcggaaagccgaaaguccucguauccuacaaaggcgaaaacaaagccuucuaccccgaggaaaucucgagcaugguccuaaccaaacucaaagaaacagccgaagcauuccucgggcacccagucaccaacgcggucauaaccguaccagcauacuucaacgacucgcaaagacaggcaaccaaagacgccggagucaucgcaggacugaacguccuccgaaucaucaacgaaccaaccgccgcagccaucgccuacggacuagacaaaggcgggcaaggcgaacggcacguacuuaucuucgaccucgggggcggaaccuucgacgucuccauccugaccaucgacgaugggauauucgaagucaaagccacggccggagacacacaccucggaggcgaagacuucgacaaccgccuaguaagucacuucgucgaagaguucaaacgaaaacacaaaaaggacaucagccagaacaaacgagcaguacgccgccucaggacagcaugcgaacgcgccaaaaggacacuaagcuccuccacgcaagcaaaccucgaaauagacagccuauacgaaggaauagacuucuacacaagcaucacaagggccagauucgaagaacucugcgcagaccuauuccggggcacacucgaaccagucgaaaaagcgcugcgagacgccaagauggacaaagccaaaauccaugacauaguccucgucggaggcuccacccgaauccccaaaguacaacgacuucuacaggauuacuucaacggaagagaucucaauaaaucaaucaaccccgacgaggcggucgcauacggcgccgccgugcaggccgcaauacucaugggggacaaaagcgagaaaguacaagaccuguuacuacuggauguggcaccccuaagccucgggcuggaaaccgccggaggggucaugaccgcccucaucaaacgaaacuccacgauccccacaaaacaaacccaaauauucaccaccuacuccgacaaccagccaggaguacuaauccaaguauacgaaggagaacgcgccaugacaaaagacaacaaccuacuaggccgguucgaucuaacaggcauaccaccggcgccccgagggguaccccaaaucgaaguaacauucgacaucgacgccaacggcauacugaacgugaccgcaacggacaaaucgaccgggaaagugaacaaaauaacaaucacaaacgacaagggccgcuuaagcaaggaagaaaucgagcgcaugguccuagacgcagaaaaauacaaagccgaagacgaaguacaacgagagaaaaucgccgcgaagaacgcgcuggaaagcuacgcauucaacaugaaaagcguaguaucagacgagggacuaaaaggcaaaauaagcgaaagcgacaaaaacaaaauacucgacaaaugcaacgaacuacuaagcuggcuagaagucaaucaacucgccgaaaaagaugaguucgaccacaaacgcaaggaacucgaacaaaugugcaacccaauaaucaccaaacuuuaccaaggaggcugcacaggcccagcaugcggaacaggcuacguaccaggccgaccugccaccggccccaccauagaagaaguagacuag

SEQ ID NO: 1136 - RNA, 1920 nt, Artificial Sequence
  derived and/or modified CDS sequence (opt11) from Homo sapiens__NP_068814.2 __HsHSPA2
augagugcgcgcggacccgcaaucggaauagaccucggcaccaccuacucaugcgugggcguauuccagcacggaaaagucgaaauaaucgcaaacgaccaagggaacagaaccacaccauccuauguggccuuuacugacaccgaacgccuaaucggagacgcugccaagaaccagguagcaaugaaccccacaaacacaaucuucgacgcaaagaggcuaaucggacgcaaguucgaagacgcaacaguccaaagcgacaugaagcacuggcccuuccgcguaguauccgaaggaggcaaacccaagguccaagucgaauacaaaggcgagacaaagaccuuuuucccagaagagaucucaagcaugguacucaccaaaaugaaagaaauagcggaggcauaucuuggaggaaagguccacagcgcagugauaacaguccccgcauacuuuaacgacagccaaagacaagcaacaaaagacgcaggaaccauaacaggacuuaacguccuccgaauaaucaaugaaccaacagcagcagcaaucgcauacggccuagacaagaaaggcugcgccggaggcgagaaaaacguccuaauauucgaccuaggcgggggaacguucgacgucucaauacucaccauagaagacggcaucuucgaggucaaaagcacggccggagacacacaccucggcggggaagacuucgacaaccgcauggugagccaucucgccgaagaguucaaaagaaagcacaagaaagauauaggccccaacaaacgggcagugagaaggcucaggaccgcaugcgaacgggcgaaaagaacccucagcucaagcacacaagcaaguauugaaaucgacucccuauacgaagggguagacuucuacaccucaaucacacgggcccgcuuugaggaacuaaacgccgaucuguuccgcggaacacuagaaccagucgaaaaagcacuccgagacgcaaaauuagacaaaggccaaauucaagaaauaguccuggucggagguuccacccgcaucccaaaaauccaaaaacuacuacaagacuucuucaacgggaaagaacucaacaaaucaauuaaccccgaugaagcagucgccuacggagcagcaguacaagcagcgauacucaucggggacaaaagcgagaacguccaagaccuacuacugcuagacgugaccccacucucacucgggauagagacagcaggcggaguaaugaccccacugauaaaacgaaacacaaccauacccacaaaacagacccagaccuucacaaccuacagcgacaaccagucauccguacucguccagguguacgagggagaacgagcaaugacgaaagacaacaaccuauugggcaaguucgaccuaacgggcauaccgcccgcgccccgcgguguaccacaaaucgaagucacuuuugacauagacgccaacggaauccuaaacgugaccgcggccgacaaaagcacagggaaggaaaacaagaucacaauaacaaacgacaaagggagacugagcaaagacgacauugaccgaaugguccaagaagcagaacgcuacaaaucugaagaugaggcaaacagagaccgagucgcugcaaagaacgcacuggaaucuuacaccuacaacaucaagcagaccgucgaagacgaaaaacugcgaggaaaaauaagcgaacaagacaaaaacaaaauacuggacaaaugucaagaagucauaaacuggcucgaccgaaaccaaauggccgaaaaagacgaauacgaacacaaacaaaaagaacucgaacgaguaugcaaccccauaaucucaaaauuauaccaaggaggcccaggaggcgggagcggcggaggaggcuccggagcgagcggaggccccaccaucgaagaaguagauuaa

SEQ ID NO: 1137 - RNA, 2523 nt, Artificial Sequence
  derived and/or modified CDS sequence (opt11) from Homo sapiens__NP_002145.3 __HsHSPA4
augucggucguaggaaucgaucugggcuuucaaucaugcuacguugcaguggcgagagcaggaggaaucgaaaccauagccaacgaauacagcgauagguguacgccggcaugcaucagcuucggccccaaaaacagaucaauaggagcagccgccaaaucacaagucaucuccaacgcaaagaacaccguacaaggcuucaagcgauuccauggcagagccuuuucggacccguucgucgaagcugaaaaauccaacuuagcguacgacauaguucaacucccaacaggauuaaccggcaucaaagucaccuacauggaagaggagcgaaacuuuaccaccgaacagguaaccgcgaugcuccuaagcaagcuaaaggaaaccgcagaaagcguccucaaaaagcccgucguagauugcguggucuccgucccaugcuucuacacggacgcagaacgucgcagcguaauggacgccacacaaauagccggacucaacugccuacggcugaugaacgaaacgaccgcagucgcacuggccuacgggauauauaagcaagaccuaccagcgcuggaagaaaaaccacguaacguggucuucgucgacaugggacacuccgccuaccaagucuccgugugcgcguucaaccgcggcaaacucaaaguccucgcaacagcguucgauaccacauugggcggacgcaaguucgaugaaguacucguaaaccacuucugcgaggaguucggcaaaaaguacaaacucgacaucaaaucgaaaauacgagcacuacuccgccuuagccaagaaugugaaaaacuaaagaaacugaugucagcaaacgccagcgaccuaccacuaucaauagaaugcuucaugaacgacguagacguaagcggaacgaugaaucgcggaaaauuccuggaaaugugcaacgaccuccucgcccgaguugagccgccacuacggagcgugcucgaacaaaccaagcucaagaaagaagacauauacgccguagaaauagucgggggcgcaacccgcauccccgccgugaaagagaaaaucucaaaauucuucgggaaagaacucagcaccacacucaacgccgacgaagcggugacccgaggcugcgcgcuccaaugcgcaauccuaagccccgccuucaaaguacgagaguucuccauaaccgacguaguccccuaucccauaucccuuagguggaauagccccgcagaagaaggcagcagcgacugcgaaguauucagcaaaaaccacgccgcacccuucucaaaaguacugaccuucuaccgaaaagaaccauucacacucgaggcauacuacagcuccccacaggaccucccauacccagacccggccaucgcccaauucagcguacaaaaagucacaccacaaagcgacgguagcucgagcaaagucaagguaaaaguccgggucaacguucacggcauauucucaguaagcagcgcaagccucguagaaguacacaaauccgaggaaaacgaagaacccauggaaaccgaccaaaacgccaaagaagaagagaaaaugcaaguagaucaagaggaaccacacgucgaggaacaacagcaacagacccccgccgaaaacaaagcagaaagcgaagaaauggaaaccagccaagccggcuccaaagauaagaaaauggaccaaccaccacaagccaaaaaggccaaagucaaaacauccacagucgaucuccccauagaaaaccaacuacuauggcaaaucgaccgcgagaugcucaacuuauacauagagaaugaaggcaaaaugauaaugcaagacaaacucgaaaaagagagaaacgacgccaaaaacgcagucgaagaauacgucuacgaaaugcgagacaaacuaagcggcgaauacgagaaauucguaucggaagacgacagaaacagcuucacccuaaagcuggaggacaccgaaaacuggcuauacgaagacggagaagaccaacccaaacaaguauacguagacaaacucgcagaacucaaaaaccuaggccaacccaucaaaauacgauuccaagaauccgaggaacgccccaaauuauucgaagaacucggcaagcaaauccaacaguacaugaaaauaauaucgagcuucaaaaacaaagaagaccaauacgaucaccuggacgcagcagacaugacuaaaguagaaaaaucaacaaacgaagcaauggaauggaugaacaacaaacucaaccuucaaaacaagcaaagccuuaccauggacccaguagucaaaagcaaggaaaucgaagccaagaucaaagagcucacaucaaccuguuccccuaucauaucaaaacccaaaccaaaaguagaaccacccaaggaagaacagaaaaacgccgaacaaaacggccccgucgacggacaaggcgacaaccccggcccccaagccgccgaacaagggaccgacaccgcaguaccaagcgacagcgauaagaaacuucccgaaauggacaucgacuag

SEQ ID NO: 1138 - RNA, 2520 nt, Artificial Sequence
  derived and/or modified CDS sequence (opt11) from Homo sapiens__NP_055093.2 __HsHSPA4L
augucagucgucggcaucgaucucggguuccugaacugcuacauagcagucgcccggaguggagggaucgagacaauagcaaacgaauacucggaccgcugcacacccgcaugcauaagccucggcuccagaacgagagccaucgguaacgccgcuaagagccaaaucguaaccaacguacgcaacacaauccacggcuuuaagaaacuccacggcagaucguuugacgacccuauaguccagacagagcgcauacgacugcccuacgaacuacagaaaaugccaaacgggagcgcgggcgucaaaguccgauaccuagaagaggagcgcccauucgcaauugaacaaguaacuggaaugcugcuagcaaaauuaaaagaaacgagcgaaaacgcccuaaagaaacccguagccgauugcguuaucucaauaccgagcuuuuucacagacgcagagcggcgcucagucauggccgcagcccaagucgccggccucaacugccuccgccucaugaacgaaacaacugccguugcccuggccuacggcaucuacaaacaagaccuaccgccccuggacgagaaaccgcgaaacgucgucuuuaucgacaugggacacuccgcauaccaaguucuaguaugcgccuucaacaaaggcaagcucaaaguacuggcaaccacauucgaccccuaccucgguggacgaaacuucgaugaagcgcucgucgacuacuucugcgacgaguucaaaacgaaauacaaaaucaacgucaaggagaacucccgggcccugcuaagacucuaccaagagugcgaaaaacuaaagaaacuuaugucggcaaacgccucagaccugccccucaacauagaauguuucaugaaugaccucgacguaagcuccaaaaugaaccgcgcacaauucgagcaacuaugcgccagccugcuagccaggguagaaccuccacuaaaagcagucauggagcaggcuaaccuacaacgcgaggacauaagcagcaucgagaucgugggaggcgccacacgcauacccgcagucaaagaacaaaucaccaaauuuuuccuaaaagacaucucaaccacccucaacgccgacgaagcaguagcgcgcggcugcgcccuccaaugcgcgauacucagcccagccuucaagguacgcgaguucaguaucaccgaccucguccccuacucaauaacacuaagauggaaaaccucguucgaagacggcuccggagaaugcgaaguauucugcaagaaucacccggcaccguucucgaagguaaucaccuuccacaagaaagaacccuucgaacuugaagcauucuacacaaaucuucacgagguaccauacccggacgcacgcauaggcucauucaccauccaaaacgucuucccccaauccgacggcgacucaagcaaagugaaagugaaaguccgcguaaauauccacggaauauucuccguagcaagcgcaucaguaaucgagaaacaaaaccucgaaggcgaccacagcgacgcaccaauggagaccgaaaccagcuucaagaacgagaacaaggacaauauggacaaaaugcaaguagaccaggaagaaggacaccagaaaugccacgcagaacacacccccgaggaagaaaucgaccacacaggcgccaaaacaaaauccgccguaagcgacaaacaggaucgccuaaaccagacgcucaaaaaggggaaagugaaauccauagaccuacccauccaguccucacuuugccgccagcuaggccaggaccuucugaacucauacaucgaaaacgaggggaaaaugaucaugcaagacaaacucgaaaaggaaaggaaugacgccaaaaacgcagucgaagaauacguauacgacuuccgcgaccgacugggcacaguauacgaaaaauucauuacacccgaagaccucaguaagcuaagcgcggucuuggaggacaccgagaacuggcucuacgaagacggcgaggaccagcccaaacaaguauacguggacaaacuacaagaacucaaaaaguacggacaaccuauccaaaugaaguacauggaacacgaagaacgcccaaaagcucuaaacgaccuaggcaagaagauacagcucguaaugaaggucaucgaagccuaccgcaacaaagacgaaagauacgaccaccuagacccaaccgaaauggaaaaaguagaaaaaugcauaagcgaugcaaugagcuggcucaacucuaagaugaaugcacaaaacaaacucucccuuacccaagacccagucguaaaagucucagaaauugucgcgaaaagcaaagagcuagacaacuucugcaaucccaucaucuacaagcccaaacccaaagcagaaguacccgaagacaaacccaaagccaacuccgaacacaacggcccgauggacggccaaagcggaaccgaaacaaaguccgacaguaccaaagacagcucgcagcacaccaaguccuccggcgaaauggaagucgacuaa

SEQ ID NO: 1139 - RNA, 1965 nt, Artificial Sequence
  derived and/or modified CDS sequence (opt11) from Homo sapiens__NP_005338.1__HsHSPA5
augaaacuaagccuggucgcagcaaugcugcuacuacuaagcgcagcaagggcagaggaagaagacaagaaagaggacgucggcacaguagucggaauagaccuggggacgaccuacagcuguguaggggucuucaagaacggcagaguugaaaucaucgcaaacgaccaaggcaaccgaauaacaccgagcuacguagcguucacacccgaaggcgaaagacucaucggggacgcagccaaaaaccaacuaacaagcaacccggaaaacacaguguucgacgccaaaagacuaaucggcagaaccuggaacgaccccuccguccaacaagacauaaaauuccucccauucaaagugguagaaaagaaaacgaaacccuacauacaagucgacauagggggcgggcagacaaaaacauucgcgccagaagaaaucagcgcaaugguccuaaccaaaaugaaagaaacggcagaagcguaccugggaaagaaagucacccacgccgucgucacgguccccgccuacuucaacgacgcgcaacgacaagcaaccaaagacgcaggcacgaucgcgggacugaacguaaugaggauaaucaacgaaccaacagcagccgccaucgcauacggacuggacaagcgcgaaggagagaaaaacauacuggucuucgaccugggcggaggaacauucgacgucucgcuacugacaauagacaacggcguauucgaggucguggcuacgaacggagacacacaccuaggaggggaagacuucgaccaacgagucauggaacacuucauaaaacuauacaagaagaaaaccggaaaagacguaagaaaagacaacagagccguacaaaaacugaggcgcgaaguagaaaaagcgaaacgggcccugagcucgcaacaccaagcgagaauagaaauagaguccuucuacgaaggagaagacuucagcgaaacacuaacgcgcgccaaauucgaagaacucaacauggaccucuuccgcucaacuaugaagcccguccaaaaagugcucgaagacagcgaccugaaaaagagcgauaucgacgaaauaguacugguaggcggaagcacacggaucccaaaaauacagcaacucgugaaagaguucuucaacggaaaagaaccaucgcgagggaucaacccagaugaagcggucgcauacggugcagcgguccaggccgggguacuaagcggagaccaagacacaggagaucugguacuccuugacgugugcccacuaacccucgggauagagaccguaggcggcguuaugacaaaacugaucccccgcaacaccguaguacccacgaagaaaagccaaaucuucagcacggcaagcgacaaccaaccgaccguaaccauaaaaguguaugagggggaacgaccccucacgaaagacaaccaccuacucggcacauucgaccucacaggaauaccaccagccccgcgcggaguaccacaaaucgaaguaacguucgaaaucgacgugaacggaauccuacgcgucaccgccgaggacaaagggaccggcaacaagaacaaaaucaccaucacgaacgaccaaaaccgccucacaccggaggaaaucgaacguauggucaacgacgcggaaaaguucgcggaagaggacaagaaacucaaagaacgcauagacacgcgaaacgaacuggaaucauacgcauacucacugaaaaaccaaauaggagacaaggaaaagcuaggaggcaagcuaucgagcgaggacaaagaaacaauggaaaaggcagucgaggagaaaauagaauggcuagaaucccaccaagacgcagacauagaagacuucaaagcgaaaaagaaagaguuagaagaaaucguucaaccaaucaucagcaaacuauacgguagcgcaggcccaccgccuacaggcgaggaagauaccgcagaaaaagacgagcuguag

SEQ ID NO: 1140 - RNA, 1932 nt, Artificial Sequence
  derived and/or modified CDS sequence (opt11) from Homo sapiens__NP_002146.2__HsHSPA6
augcaagccccacgagagcuagcaguaggaauagaccucggaacuacauacucaugcguaggcguauuccaacaaggacgcguagaaauacucgcaaacgaccaaggcaaccgcaccacgccaagcuacgucgccuuuaccgacaccgagagacucguaggcgacgcagccaaaucgcaggccgcccucaauccccacaacaccgucuucgacgcgaaaagacuaaucggccgaaaauucgccgauaccacaguccaaagcgacaugaaacacuggcccuuucgcguagugucagaaggaggaaaaccaaaagucagggucugcuaccgaggagaagacaaaaccuucuacccagaagagauaucgaguaugguacuauccaaaaugaaggaaaccgcagaagccuaccuaggacaaccaguaaagcacgccgucauaacaguaccagcguacuucaacgacagccaaagacaagccaccaaggacgccggggccauagccggacuaaacguccuccgcauaaucaacgaaccgaccgcugccgcgaucgcauacggccucgaccgcaggggagcuggcgaaagaaacguccucaucuucgaccucggagggggaacauucgacgucucaguacuaaguauagacgccggcguauuugaaguaaaagccacagcaggcgacacccaccuaggaggagaagacuucgacaaccgacucgugaaccacuucauggaagaguuccgacgcaaacacggcaaagaccucuccggcaacaaacgggccuugagacgacucagaacagccugcgaaagagcaaaaagaacacucagcucaagcacacaagcgacauuagaaauagacucccuauucgagggcguagacuucuauaccucgaucacacgcgcaagauucgaggaacugugcucagaccucuucagaucaacccucgaaccggucgagaaagcucuaagagacgccaaacuagacaaagcacaaauccacgacgucgucuuaguaggcggaagcacccgaauaccaaaagugcaaaaacuccuacaagacuucuucaacggaaaggagcucaacaagucaauaaaccccgacgaagccgucgcauacggggccgcaguacaggccgcagugcucaugggcgauaaaugcgagaaaguccaagaccuucuacuacucgacguagccccacuuucccuagggcucgaaaccgcgggcgggguaaugaccacccucauccaacgaaacgcaacaauaccaacuaaacaaacccagaccuucacaacauacucagacaaucaaccgggaguauucauacaagucuacgaaggcgaacgagccaugacaaaagacaacaaccuucucggcagguuugaacucagcggcauacccccagccccacgcggcgucccacaaauagaagucaccuucgauauagacgccaacggcauacucagcguaacggcaaccgaccgcagcaccggaaaagcgaacaagauaaccaucacaaacgacaaagggcgccuaagcaaagaagaggucgagcgcaugguccaugaagcagaacaguauaaagcagaggacgaagcccaacgagacagaguagcagcgaaaaacagucucgaggcacacguguuccacgucaaaggcucacuacaagaagagagccuacgagacaaaauccccgaagaagacaggcggaaaaugcaagauaaaugccgcgaaguacucgcuuggcucgagcacaaccaacuggccgaaaaggaggaauacgaacaccaaaaacgagaacucgagcagauaugccgacccauauucucccgccucuacggcggccccggcguccccggaggaagcagcugcggcacgcaagccagacaaggagaccccucaaccggacccauaaucgaagaaguggacuaa

SEQ ID NO: 1141 - RNA, 1104 nt, Artificial Sequence
  derived and/or modified CDS sequence (opt11) from Homo sapiens__P48741__HsHSPA7
augcaagccccccgcgaacuagccguaggcaucgaccucggcacaaccuacagcugugucggcguauuccaacaaggcagaguagaaauccuagccaacgaccaaggcaacagaacgaccccaucauacgucgcguucaccgacacagaaaggcuaguaggagacgcagcaaaaucccaagcagcccuaaacccgcacaacacuguauucgacgccaaacgccuaaucggacgaaaauucgcagacacaaccguccaaucagacaugaaacacuggccauuccaagucgucuccgaagguggaaaacccaaaguacgaguaugcuaccgaggggaagacaaaacauucuacccagaagaaauaagcucaaugguacuaagcaaaaugaaagaaaccgcggaagccuaccuaggccaaccaguaaaacacgccguaaucacggucccgaccuacuucagcaacucccagagacaggccaccaaagacgcaggagcaaucgcaggccuaaaaguacucccaaucauaaacgaagccacagccgcagcaauagccuacggccuggaccgaagaggagccggcaaacgaaacguacucauauucgaccuaggaggaggaacauucgacguauccguacucucgaucgacgccggggucuucgaaguaaaagcuaccgccggcgacacccaccuaggaggcgaagacuucgacaaccgccuagucaaccacuucauggaagaauuccgcagaaaacacggcaaagaccuaagcggaaacaaacgagcccucagacgacuccgaacagccugcgaacgagccaaacgcaccccaucaagcagcacccaggccacacuagaaaucgacucccuauucgaaggcguagacuucuacaaaagcaucaccagagccagauucgaagaacucugcagcgaccuauuccgaagcacccuagaacccguggaaaaagcccuccgcgacgccaaacuagacaaagcacaaauccacgacuucguacuaggcggcgggcuccacagccacccacaaggcgcagaagucgccgcaggccuacuccaacgacaaggcgcagaacaagaacaccagccauaa

SEQ ID NO: 1142 - RNA, 1941 nt, Artificial Sequence
  derived and/or modified CDS sequence (opt11) from Homo sapiens__NP_006588.1 __HsHSPA8
augucaaaaggacccgcagugggaaucgaccuaggcaccaccuacucaugcguaggcgucuuccaacacggaaaagucgagauaaucgccaacgaccaaggaaacaggacgacaccaucauauguagccuucaccgacaccgagcgccuaauaggagacgccgccaaaaaccaggucgcaaugaacccaacgaacaccguauucgacgccaaacgacuaaucggccgccgauucgacgaugcagucguccagagcgacaugaaacacuggcccuucaugguaguaaacgacgccggccgaccaaagguacaagucgaauacaaaggcgaaaccaaauccuucuaccccgaagagguguccagcaugguccucaccaaaaugaaagaaauagcagaagcguaccuggggaaaacagucaccaacgcaguagucaccguccccgcauacuucaacgacagccagagacaagcaacaaaagacgcaggcaccaucgccgggcuaaacguccuacgcauaaucaacgaacccacagcagcugcaaucgcauacggucucgacaagaaaguuggugccgaacgcaacguccuaaucuucgaccucgggggcggcaccuucgacguaucaauccucacaauagaagacggaauauucgaagucaaaagcaccgcaggcgacacccaccuaggcggcgaggacuucgacaacagaaugguaaaccacuucaucgcagaguucaaacggaaacacaagaaagacaucuccgaaaacaaacgcgcaguacgacgccuacggacagcaugcgaacgcgccaaacgcacccucuccuccuccacccaagcaagcauagaaaucgacagccuauacgaaggaauagauuucuacacauccaucacaagggcgcgcuucgaagaacuaaacgcagaccucuuccgagguacccucgacccagucgaaaaagcauuaagagacgcaaaacuagacaaaagccaaauccacgacauaguccuggugggcggaucaacccguaucccuaaaauccaaaaacuacuacaggacuucuucaacggaaaagaacuaaacaaguccaucaacccagacgaagcuguggcauacggcgcggccguacaagccgccauccuaagcggcgacaaaucggaaaacgugcaggaccugcuacuccuagacgucacaccccucucacuaggcauagaaaccgcgggcggcguaaugaccguccuaauaaaacgaaacacaaccauaccaaccaaacaaacgcaaaccuucacaacauacagcgacaaccaaccagggguacucauccaaguauacgaaggcgaacgcgcaaugaccaaagacaacaaccuccuaggcaaauucgaacuuacaggaaucccacccgcaccccgagggguaccccaaauagaaguaacauuugacauagacgccaacggcauccuaaaugucagcgccgucgacaaaagcaccggaaaagaaaacaaaauaacgauaaccaacgacaaaggccgacugagcaaagaagacaucgagcgaaugguacaagaagccgaaaaauacaaagcagaggaugaaaaacagcgcgacaaaguaucaagcaaaaacagucuggaaagcuacgccuucaacaugaaagcaacaguggaagacgaaaaacuccaaggcaagaucaaugacgaagacaagcagaaaauccucgacaaaugcaacgaaaucaucaacuggcucgacaagaaccaaacagcagaaaaggaagaguucgaacaccaacagaaagaacucgaaaaagucugcaaccccauaaucacaaaacuguaccaauccgcaggcggaaugcccggcggcaugcccggaggauucccaggcggcggggcaccacccaguggcggagccagcucaggaccgacaaucgaagaaguagacuaa

SEQ ID NO: 1143 - RNA, 2040 nt, Artificial Sequence
  derived and/or modified CDS sequence (opt11) from Homo sapiens__NP_004125.3 __HsHSPA9
augauaagcgccucaagagcagcagccgccagacugguaggagccgcagcaucaaggggcccgacagcagccagacaccaagacucauggaacggccuaagccaugaagcauuccgccucguaagccgacgcgacuacgcgagcgaagcaauaaaaggagccguggucggcauagaccuaggaaccacgaacucgugcguggccguaauggagggaaaacaagcaaaaguacucgaaaacgccgaaggggcaagaacaacgcccucaguaguagcguucacugcggacggcgaaaggcuaguaggcaugccagcaaaacgacaagcggugacaaacccaaacaacacguucuacgcaacaaaacgacucauaggacgacgauacgacgacccggaaguacaaaaagacaucaaaaacgucccguucaaaauagugcgcgccaguaacggagacgccugggucgaagcccacggcaaacucuacagcccaucccagaucggcgccuucguccuaaugaagaugaaagagaccgccgaaaacuaccucggacacacagcuaaaaacgcagucaucacugugccagcguauuucaacgacagccaaaggcaagccacgaaagacgccgggcaaauaaguggacuaaacguccuaagggucaucaacgaaccgacugcagcggcccuggcauacggccuagacaagagcgaagacaaaguaauagccguauacgaccuaggaggcgggacauucgacauaagcauccuagaaauacagaaaggaguauucgagguaaaaagcacgaauggggacacguuccuggguggcgaagacuucgaccaagcacugcuacgccacaucgugaaggaguucaaacgagaaacaggggucgaccucacaaaagacaacauggcgcuccaacgaguccgcgaagcagcggaaaaagcaaaaugcgaacuaagcagcagcguacaaaccgacauaaaccuacccuaccuaacaauggacaguagcgggccaaaacaucucaacaugaaauuaacaagagcucaauucgaaggcaucguaacggaccuaauacgacgaaccaucgccccgugccaaaaagccaugcaagacgcagaaguaagcaagagcgacauaggagaaguaauacugguaggcggcaugacaagaaugccgaaaguacaacaaaccguacaagaccuauucggacgagcaccaagcaaagccgucaacccggaugaagcaguggccauuggcgcagcaauccagggaggcgugcuagcgggcgauguaacagacguacuccuacuagacguaaccccgcuaagccuaggaauagaaacccuaggcggaguauucacaaagcugauaaacagaaacacaacaaucccaaccaagaaaagccaaguauucagcaccgcggcagacgggcaaacccaaguggagaucaaagucugucaaggagaacgagagauggccggcgauaacaaacugcucggccaauucacccugaucggcauaccacccgcgccgagaggaguaccccaaaucgaggucacguucgauaucgacgccaacggcauaguccauguaagcgccaaagacaaaggaaccggacgcgaacaacaaauagucauccaaucaagcggaggccuaagcaaagacgacaucgagaacauggucaaaaacgcggaaaaauacgcagaggaagaccgaagaaagaaagaaagagucgaagcaguaaacauggccgaaggaauaauacacgacaccgaaaccaaaauggaagaguucaaagaccaacuaccagcugacgaaugcaacaaacucaaagaagaaauaaguaaaaugcgagagcuacuagcgcgcaaagacagcgaaacgggagaaaauauacgccaggcagcgagcagccugcaacaagcuagccuaaaacuguucgaaauggccuacaagaaaauggcauccgaaagggaaggaagcggaagcagcggcaccggcgaacagaaagaagaccaaaaagaagagaaacaguaa

SEQ ID NO: 1144 - RNA, 2028 nt, Artificial Sequence
  derived and/or modified CDS sequence (opt11) from Homo sapiens__NP_079291.2__HsHSPA12A
auggcagauaaagaagcaggcggauccgacgggccacgagaaaccgccccaacauccgcauacagcucgccagcccgaucacuaggagacaccgguauaacgccccuuucccccucccacaucgucaacgacaccgacucaaacguauccgaacaacaauccuucuuaguugucguggccgucgacuucggaacaacaucauccggcuaugccuauucauucaccaaagaaccggagugcauccacgucaugcgucgcugggaaggaggagaccccgggguuucaaaccagaaaacccccaccaccauccuucucacccccgaacggaaauuccacuccuucggcuacgccgcccgggacuucuaccacgaucuagacccgaacgaagcaaagcaauggcucuaccuagaaaaauucaaaaugaaacuucacaccaccggcgaccucacaauggauacagaccuuacagccgcaaacggcaagaaagucaaagcgcucgaaaucuucgccuacgcacuccaauacuucaaagaacaagcccucaaagagcuauccgaccaagccggcucagaguucgaaaacucagacguccgcugggucauaacaguaccugcgauauggaaacaacccgccaaacaguuuaugagacaagcagccuaccaggcuggacuggcauccccugaaaacucagaacaacucauaaucgcgcuagaacccgaagcugcaagcauauacugccgaaaacuccgccuccaccagaugaucgaacugagcuccaaagcagccguaaacggauacagcggcuccgacacugucggcgcaggauucacccaagcuaaagaacacauccgacgaaaccgccagucacgcacuuuccuagucgaaaacgucauaggagaaaucuggagcgaacuagaagaaggagacaaauacgucguggucgauucaggcggcggcaccgucgaccuaacaguccaccaaaucaggcuaccagagggccaccucaaagagcuauacaaagcaaccggcggccccuacggaucccucgguguagacuaugaguucgagaaacugcucuacaaaauauuuggcgaggacuuuaucgagcaauucaaaaucaaacgccccgccgccugggucgacuugaugaucgccuucgaaagccgaaaacgcgccgccgcccccgacagaacaaacccacuaaacaucaccuuacccuucucguucaucgacuacuacaagaaauuucgcggccacuccgucgagcacgcccuacgaaaaagcaacgucgacuucgucaaauggucaucgcaaggaaugcuccguaugucccccgacgccaugaaugcccuauucaaacccacaauagacuccaucaucgaacaccuccgcgaccucuuucaaaagccagaaguaucaaccgucaaauuucucuuccuagucggcggcuucgcagaagcaccccuacuccaacaagccguucaagccgcuuucggcgaccaaugcagaaucauaaucccacaagacguaggacucaccauucucaaaggcgccguacuuuucggccucgacccagccgucauuaaagugcgaagauccccucugacauacggcgucggaguccuaaaccgcuacgucgaaggaaaacacccacccgaaaaacuucuagucaaagacggcacccgauggugcaccgacguauucgauaaauucauaucagcagaccaaagcgucgcccucggcgagcuagucaaaagauccuacacacccgccaaaccaagccaacucgucaucguuaucaacauauacuccagcgaacacgacaacguaucguucauaaccgaccccgggguaaagaaaugcggcacccuccgccucgaccuaacaggcaccucaggcaccgccgucccagcacgcagagaaauacaaacccucaugcaguucggugacaccgaaaucaaagccaccgccaucgacauagcaaccaguaaaucggucaaaguaggcauagacuuucuaaacuacuaa

SEQ ID NO: 1145 - RNA, 2061 nt, Artificial Sequence
  derived and/or modified CDS sequence (opt11) from Homo sapiens__NP_443202.3 __HsHSPA12B
augcuagccgucccagaaaugggcuuacaaggacuuuacaucggaagcuccccagaacgaucacccguacccagcccacccggaucaccccgcacccaggaaucaugcggaaucgcgccccugacacccagccaaagcccaaaacccgaaguacgggccccgcaacaagccuccuucagcguagucguggccauagacuucggaacgaccagcaguggcuacgcauucucauucgcaagcgauccagaggccauacacaugaugcgaaaaugggaaggcggcgacccaggaguagcacaccagaaaaccccaacaugccuacuccuaacccccgaaggcgccuuccacucauucggcuacacugcaagagauuacuaccacgaccucgacccggaagaagcccgcgacuggcucuacuucgagaaauucaagaugaaaauccacagcgccacagaccuaacacugaaaacccaacucgaggcggugaacggcaagacaaugccagcacucgaaguauucgcacacgcccuccgauucuuccgcgaacacgcacuacaagaacuacgcgaacaaagccccagucugcccgagaaggacaccguccgguggguguuaaccguacccgcaaucuggaaacaaccagcaaaacaauucaugcgcgaagccgccuacuuagccggacuuguaagcagagagaacgcagaacaacuccucauagcccuggaacccgaagccgccuccguauacugccgaaaacuacgacuacaccaacuacuagaccugucgggccgcgcccccggcggcggccgccuaggcgaaagacgaagcauagacuccuccuuccgccaagcccgagaacaacuaagaagauccagacacucacgaaccuuccuaguagaauccggagucggagaacuaugggccgaaaugcaagccggcgaccgcuacguagucgccgacugcggagggggcacugucgaccuuaccguacaccaacuagaacaaccacauggcacccuaaaagaacuauacaaagccucgggaggucccuacggggcugucggcguagaccucgcauucgagcaacuccuaugccgcaucuucggagaagacuucaucgcaacauucaaacgccaaaggcccgccgcaugggucgaccucacuaucgccuucgaagcacgaaaacgaacagcaggaccccaucgcgcaggcgcccucaacaucucacuacccuuuuccuucauagacuuuuacagaaaacaaagagggcacaacguagagacagcacucagacgauccagcgugaacuucguaaaauggucaucccaagggaugcugcgaaugucaugcgaagcaaugaacgagcuauuccaaccaacaguaucaggcauaauccaacacaucgaagcacugcucgcccgaccagaaguacaaggcguaaagcuccucuuccuagucggcggauucgccgaaagcgcaguccuccaacaugccguccaagccgcccugggcgcacgcggacuacgagucgucguaccacacgacgucggacucacgauacucaaaggagccguacuauucggacaagccccaggaguaguccgcguccgccguucgccgcucaccuacggcgucggcguccucaacagauucguaccaggacgccaucccccagaaaaacugcugguccgcgacggccgcagaugguguacagacgucuucgaacgcuucguagcagccgagcaauccgucgcgcuaggagaggaaguccgccguucauacugucccgccagacccggccaacgaagaguacucaucaaccuauacugcugcgcagcagaagacgcacgcuucauaacugacccaggcguccggaaaugcggcgcccucucacuagaacucgaacccgccgacugcggacaggacaccgcaggagccccacccggacgacgcgaaauucgggccgccaugcaauucggcgacaccgaaaucaaggugacagccguggacgucagcacgaaccgcagcguuagagcaagcauagacuuccucucaaacuaa

SEQ ID NO: 1146 - RNA, 1416 nt, Artificial Sequence
  derived and/or modified CDS sequence (opt11) from Homo sapiens__NP_008879.3__HsHSPA13
auggcccgcgaaaugaccauccucggcucagccguccuuacccuacuacuagcgggauaccuagcccaacaauaccuuccacuacccacccccaaagucauagguauagaccucggaaccaccuacugcuccgucggcgucuucuuucccggaaccggaaaagucaaagucaucccagacgaaaacggacacaucucuauccccucgauggucagcuucacagacaacgacguauacgucggcuacgaauccgucgagcuagccgacagcaacccacaaaacacaaucuacgacgccaaacgcuucaucggcaaaaucuucaccgccgaagaacucgaagccgaaaucggacgcuaccccuucaaaguacucaacaaaaacggcauggucgaguucucaguaaccagcaacgaaaccauaaccguaucccccgaauacgucggcucacgcuuacuacuaaaacucaaagagauggcagaggcuuaccucggcaugccggucgccaacgcugucauaagcguccccgcggaguucgaccucaaacaacgcaacuccaccauugaagcagcgaaccuggcaggacuaaaaauccuccggguaauaaacgaacccacagcagcagccauggccuacggacuccauaaagccgacgucuuucacguucuagucaucgacuuaggcggaggcacccucgacgucucccuccucaacaaacagggcggaauguuccuaacacgcgccaugucaggcaacaacaaacucggcggccaggacuucaaccaacgccuacuucaauaccucuacaaacagaucuaccagaccuauggauucguacccucucggaaagaagaaauccaccgccuccgccaagccguagaaaugguuaaacucaaccucacccuacaccagucagcgcaacuauccguccuccucacggucgaagaacaagaccgcaaagaaccccacucaucagacaccgaacuccccaaagacaaacucuccucagccgacgaccaccgcgugaacucaggcuucggccgcggccuauccgacaagaaauccggcgaaucucaaguacucuucgagacagaaauaagccgcaaacucuucgacacccuaaacgaagaccucuuccagaaaauacucguacccauccaacaaguccuaaaagaaggccaccuugagaaaaccgaaaucgacgaagucguucucgucggcggcuccacccgcaucccccguauucgacaagucauacaagaauuuuucggaaaagaucccaacacuagcgucgaccccgaccuugcaguagucacagggguagccauccaagccggaauagacggcggauccuggccccuucaagucuccgcacucgaaauccccaacaaacaccuucagaaaaccaacuucaacuag

SEQ ID NO: 1147 - RNA, 1530 nt, Artificial Sequence
  derived and/or modified CDS sequence (opt11) from Homo sapiens__NP_057383.2__HsHSPA14
auggccgccaucggaguccaccucggcugcacauccgccugcguggccgucuacaaagacggacgcgcaggcguagucgccaacgacgccggagaccgcgucacccccgccguagucgccuacagcgaaaacgaggaaauagucggacucgccgccaaacaaucccgaauacgcaacauauccaacacaguaaugaaagucaaacaaauccucggacgaagcagcagcgacccacaagcccaaaaauacaucgccgaauccaaaugccuugucaucgagaaaaacggaaaacuacgauacgaaaucgacacaggggaagaaaccaaguucgucaacccagaggacgucgcacgccucaucuucagcaaaaugaaggagaccgcacauagcguacuaggguccgacgccaacgacgucguaauaaccgucccauuugacuucggcgaaaaacaaaagaacgcacuaggcgaagccgcccgcgccgcuggcuucaacguccugcgacuaauacacgaaccaucagcagcacuacuagccuacggcaucggacaagacucaccaacaggcaaaucaaacauacucguauucaaacucggaggcacuagccuaucacuauccguaauggaggugaacagcggcaucuaccgcguacucaguaccaacacagaugacaacauaggcggcgcccacuucacagaaacccuagcgcaauaccuagcgucggaauuucaacgcagcuucaaacacgacgucagaggaaacgcccgcgcgaugaugaaacuaaccaacagcgcggaagucgcaaaacacucccucucaacccucggcuccgccaacugcuuccucgacucacucuacgaaggccaggacuucgacugcaacgucucaagagcccgcuucgaacuccugugcuccccacuauuuaacaaauguaucgaagcaauacgcggacuccuagaccaaaacggcuucacagccgacgacaucaacaaagucguccucugcggcggcagcucgcgcauccccaaacuccaacaacuaaucaaagaccucuucccagccgucgaacuacucaacucgaucccacccgaugaaguuauucccauuggagccgccaucgaagccggcauccuaaucggcaaagaaaaccuacugguagaagacucacuaaugaucgaaugcucagcccgcgacauccucgucaaaggagucgacgaaagcggagccucccgauucaccguacuauucccuuccggaacgccgcucccagcccgccgacaacacacccuccaagcccccggcuccaucuccuccgucugccucgaacucuacgaaagugauggcaaaaacucagccaaagaagaaaccaaauucgcgcaaguaguacuacaagaccucgacaagaaagaaaacggacuacgcgacauccuagccguacucaccaugaaacgcgacggaucacuccacguaaccugcacagaccaagaaacaggcaaaugcgaagcuaucuccauagaaaucgccucauga

SEQ ID NO: 1148 - RNA, 2577 nt, Artificial Sequence
  derived and/or modified CDS sequence (opt11) from Homo sapiens__NP_006635.2 __HsHSPH1
auguccgugguaggacucgacgucgggagccaaagcugcuacauagcgguagccagggcaggcgggauagagacgaucgccaacgaguucuccgaucgcugcacacccagcgucaucagcuuugguucuaaaaacaggacuauaggaguggccgccaaaaaccaacaaauaacccaugcaaacaacaccgucagcaacuucaaacgauuccacggacgugccuucaacgaccccuuuauacaaaaagaaaaagaaaaccuauccuacgaccuagucccccucaagaauggaggcgugggcaucaaaguuauguauaugggagaagaacaccuguucucaguagaacagauaaccgccaugcuacuaacaaaacugaaggaaaccgcagagaacagucugaagaaaccugucaccgacugcguaaucuccguacccuccuucuucaccgacgcagaacggagauccguacuagacgcagcccaaauaguaggccuaaacugccuccgccugaugaacgauaugacggccguagcacucaacuaugggauuuacaaacaagaccucccaagccucgacgaaaaaccccgcauaguagucuucgucgacaugggacacucagcauuccagguaagcgcaugcgccuucaacaaaggaaaacucaaaguccuaggcacggcuuucgaccccuuccuaggcgggaaaaauuucgacgagaaacucgucgaacacuucugcgccgaguucaaaaccaaauacaaacucgacgcaaagagcaaaauccgagcccuccuacgccuauaccaggaaugcgaaaagcuaaagaaacugauguccuccaacuccaccgaccuaccccuaaacaucgaauguuucaugaacgacaaggacgucagcggaaagaugaacagaucccaguucgaggagcucugcgccgagcuacuccaaaagauagaagucccccucuacagccuucucgaacagacccaccucaaaguagaagacguuucagccgucgaaaucgucggcggagcaacacgcauccccgcggucaaagaacgcaucgccaaauucuucgggaaggacauauccaccacccuaaacgcagacgaagcaguggcacgcgggugugcccuccagugcgccauccuaagccccgcauucaaaguacgagaguucucaguaaccgaugccgucccguucccaauaagccugauauggaaccacgacagcgaggacaccgaagguguccacgaagucuucagucgaaaccacgcggccccauucucaaaaguauuaacguuccuccgacgcggacccuucgaacucgaagcauucuacagcgacccgcaaggcguaccguacccugaggcaaagauuggcagguucguaguccagaacgucuccgcacagaaagauggcgagaaaagccgcguaaaggucaaaguccgagucaacacacacggaaucuucaccauuuccaccgccucaaugguagaaaaaguccccacagaagaaaacgagaugagcucugaagccgacauggagugccucaaccaacgcccacccgaaaaccccgacaccgacaagaacguccaacaagacaacagcgaagcaggaacccagccccaaguccaaaccgacgcacaacagaccagccagagcccacccucccccgagcucacaucagaagaaaauaagaucccagacgcagacaaggccaacgaaaagaaagucgaccagcccccggaggccaagaaacccaaaaucaaaguggucaacguagaacuccccaucgaagcaaaccuggucuggcagcuagguaaagacuuacuaaacauguacaucgaaaccgaaggcaaaaugauaaugcaagauaaacucgaaaaagaacgcaacgacgccaaaaacgcagucgaagaauacguauacgaguuccgggacaaacuaugcggcccauacgaaaaauucaucugugaacaagaccaccaaaacuuucuacgucuauuaaccgaaaccgaagacuggcucuacgaagaaggcgaagaccaagcaaaacaggcuuacgucgauaaacuggaagaacuaaugaaaaucggaacgccggucaaagugcgguuccaagaagcagaagaacgucccaaaauguucgaggaacucggacaaagacuccaacacuacgcgaaaaucgccgccgacuuccgcaacaaagacgagaaguacaaccacaucgacgaaucagaaaugaagaaaguagaaaagucggucaacgaaguaauggaauggaugaacaacguaaugaacgcccaagccaaaaagucccucgaccaagacccagucguccgagcacaagaaaucaaaaccaaaauuaaggaacugaacaauaccugcgagcccgucguaacgcaaccgaaaccaaaaauagaaucccccaaacucgaacgaacccccaacgggccgaacaucgacaagaaagaagaagaccucgaggacaaaaacaacuucggagcagaaccaccacaccaaaacggcgaaugcuacccaaacgagaaaaacagcgucaacauggaccucgauuaa

SEQ ID NO: 1149 - RNA, 3000 nt, Artificial Sequence
  derived and/or modified CDS sequence (opt11) from Homo sapiens__NP_006380.1 __HsHYOU1
auggcagacaaggucaggcggcaacgaccacggaggcgcguauguugggcgcuagucgcaguccuacuugcggaccuacuggcacuaagcgacacgcuggcaguuauguccguagaccucggaagcgaaucgaugaaagucgcgaucgucaaacccggcgucccaauggaaauaguccuaaacaaggaaagccgcaggaagaccccggugauagugacacucaaagagaacgaacgcuucuucggagacucggccgcgagcauggccauaaagaaccccaaagcaacgcuaagauacuuccaacaccuccucgggaaacaagcagacaacccacacguggcacucuaccaggcaagguucccagaacacgagcugacauucgacccgcaacgccaaacgguacacuuccaaauaucaucacaacugcaauuuucacccgaagaaguccuaggaauggugcucaacuacuccagaucauuagccgaagauuucgccgaacaaccaauaaaagacgcagucauaacaguacccgucuucuucaaccaggcagaacgccgagcaguccuacaagccgcgaggauggcaggccuuaaaguccuccaacugaucaacgacaacaccgcaacagcacugagcuauggcgucuucagacggaaggacauaaacaccaccgcacagaauauaauguuuuacgacaugggaagcggauccacagugugcaccauaguaaccuaccaaauggugaaaacgaaggaggccggcaugcaaccucagcuccaaauccgagggguaggauucgaccggacacucggcgggcuagaaauggaacuacggcuaagagaaagauuagcgggacuguucaacgaacagcgaaaaggacaacgagcgaaagacgucagggaaaacccccgcgcgauggcaaagcuccuucgagaggcaaaccgccugaaaacagugcugucagcgaacgcggaccacauggcucaaauagaaggacucauggacgacgucgacuucaaagcaaagguaacacgagucgaauuugaagaacuaugcgcggaucuauucgaaagagugcccggacccguacagcaagcacugcaguccgccgaaaugucccuagaugaaauagaacaaguuauccuagucggcggcgccaccagaguaccacgagugcaggaaguacuacucaaagccguaggcaaggaggaacuagggaaaaacauaaacgccgacgaagcagcagcgaugggggcaguuuaccaagccgccgcacucagcaaggcauucaaagucaaacccuucgucguacgagacgccgucguauacccgauacugguagaguucacacgcgaaguggaggaggaaccaggaauacauagccugaaacacaacaagcgaguucucuucagccgaaugggccccuacccccaaagaaaagugaucaccuucaaccgguacagccacgacuucaacuuccacauaaacuacggcgaccucggauucuuggggcccgaagaccucaggguauucgggagccaaaaccugacaacagucaaacucaaaggcguaggcgacagcuucaaaaaguacccagauuacgaaaguaaaggcauaaaagcacacuucaaucuugacgaaagcggagugcucucgcucgaccgcguggagagcgucuuugaaacccuaguagaggacagcgccgaagaagaaagcacgcuaacaaagcugggaaacaccauauccucacuauucggagggggaacgacaccagacgcaaaagagaacggaaccgacaccguccaagaagaggaagagagcccagcugaaggguccaaagacgagccaggagaacaaguugaacuuaaagaagaagcggaggccccuguugaggacggaagccaaccgcccccacccgaacccaaaggcgacgccacaccagaaggcgaaaaggcaaccgagaaggaaaacggagacaaauccgaagcccaaaaaccaagcgaaaaagcagaggccggcccagaaggggucgcgcccgcaccggaaggggagaagaagcaaaaacccgcacgaaaacgcagaaugguggaagaaaucggaguagagcuagucguacuagaccuaccagaucugccggaagacaaacuagcacaaucaguucagaaacuucaagacuugacccuacgggaccuggaaaaacaagaaagagaaaaagcagccaacagucucgaagccuucaucuucgagacacaagacaaacuguaccaacccgaguaccaggaaguaagcacagaagaacagagagaagaaaucaguggaaaacugagcgcugcgucaacauggcuagaagacgaagggguaggugcaacaaccgucaugcuuaaagaaaagcucgccgaacugcgcaaacucugccaagggcuauucuuccgaguagaagagaggaagaaauggccagaaaggcuauccgcacuagacaaccuacugaaccacucgagcauguuccuaaagggagcaagacucauaccagagauggaccaaauauucaccgagguggaaaugacaacacucgaaaagguaauaaacgaaacgugggccuggaaaaacgccacacuagcagagcaagccaaacugccagcaacagagaaaccaguacugcuaucaaaggacaucgaagcaaaaaugauggcacuggacagagaggugcaauaccuccucaacaaagcaaaauucacaaaacccagaccacgaccaaaagauaagaacggaacacgcgcagagccaccccuaaaugcuucggcgagcgaucaaggggagaaaguaauacccccagccgggcaaaccgaggacgccgagccgaucuccgaacccgaaaaggucgaaacaggcucagaacccggggauacagaaccacuugaacucggcggacccggagccgagccagaacagaaggaacaaaguacagggcaaaaacgcccccugaaaaacgacgaacuauag

SEQ ID NO: 1150 - RNA, 2199 nt, Artificial Sequence
  derived and/or modified CDS sequence (opt11) from Homo sapiens__NP_005339.3 __HsHSP90AA1
augccagaagaaacccaaacacaagaucaaccaauggaagaagaagaaguggaaaccuucgcguuccaggcggaaauagcccaacuaaugucccucaucaucaacaccuucuacagcaacaaggaaaucuuccugcgagaacuuaucagcaacagcagcgacgcccucgauaagaucagauacgaaagccuaacugacccaagcaaacuagauagcgggaaagaacuccacaucaaccuaauacccaacaaacaagaccggacccucacaauaguagacaccggaaucggaaugacaaaggcggaccuuauaaacaaucugggaaccaucgcgaaaagcgggacaaaggcauucauggaagcgcuccaggcaggggcagacauaucaaugaucggccaauucggagucggcuucuacucagcguaccuaguagccgagaaaguaaccgucauaaccaaacacaacgacgaugagcaguacgcgugggagagcagcgcgggaggaucguucacagugagaaccgacacaggggaaccgaugggacgcggaacgaaaguaauacuacaccucaaagaagaccagaccgaauaccucgaagaaaggcgaauaaaagaaauagugaagaaacacucccaguucaucggauacccgauaacacuauucguggagaaagagcgcgacaaagaggucagcgacgacgaagcagaagaaaaagaagacaaagaagaggaaaaggaaaaagaagaaaaagaaagcgaagacaaaccagagaucgaagacgugggaagcgacgaagaagaagaaaagaaagauggagacaagaagaaaaagaagaaaaucaaagagaaauacauagaccaagaagaacuaaacaaaacgaaaccaaucuggacccggaacccagacgacauaaccaaugaagaauacggcgaguucuacaaaucacucacaaacgacugggaagaccaccucgccguaaaacacuucucgguagagggacaacuagaguuccgagcgcuccuguucgugccaaggcgagccccauuugaccuguucgagaauagaaagaagaaaaacaacauaaaacucuacguccgccgggucuucaucauggacaacugugaagaacuaauuccggaauaccugaacuucauccgcggcguaguggacagcgaagaccugccgcucaacaucucgagagaaauguuacaacaaagcaaaauccucaaaguaauaaggaagaaccucgugaagaaaugccuggaauuauucacagaacuagccgaagacaaagaaaacuacaagaaauucuacgagcaauucagcaaaaacauaaaacugggcauccacgaagacagccaaaaccgcaagaaacuauccgagcuccuacgcuacuacaccuccgcauccggggaugagauggugucacuaaaagacuacugcaccagaaugaaagaaaaccaaaaacacaucuacuacaucacgggcgaaacaaaagaccaaguagcgaacucagccuucgucgagcgccuacgaaaacacgggcuagaagucauauacaugaucgaaccaauagacgaauacugcguccaacaacucaaagaguucgaaggaaaaacccucgucagcguuaccaaagaaggcuuggagcuccccgaagacgaagaagagaaaaagaaacaagaagaaaagaaaaccaaauucgaaaaccugugcaaaaucaugaaggacauacuggaaaagaaaguagagaaggucguaguaucaaacaggcucgugaccagccccugcugcauagucacaucuaccuacggauggacggccaacauggaaagaauaaugaaggcccaagcacuccgcgacaacucgacaaugggcuacauggcggccaagaaacaccucgagaucaaccccgaccacuccaucaucgaaacgcucaggcagaaagccgaagcagacaaaaacgauaaauccgugaaggaccucguaauacuccuauaugaaacggcccuucuaagcagcggguucagccucgaagacccgcaaacgcacgcgaacaggaucuaccgaaugaucaaacucggccuugggaucgacgaagacgacccaacagcagacgacacgagcgcggccguaacggaagaaaugccaccacuagaaggcgacgacgacacgagcaggauggaggaaguggacuag

SEQ ID NO: 1151 - RNA, 339 nt, Artificial Sequence
  derived and/or modified CDS sequence (opt11) from Homo sapiens__NG_005218__HsHSP90AA3P
auggacagcucaaaacuggacucgggcaagggccugcacauaaaccuggucccgaacaagcaaaaccaaacacucacgaucguggacacgcgcauaggcaugaccaagaccgaccucauaaacaaccucgggaccgugaccaagagcgggaccaaggccuucauggaggcccugcaagcggacgcggacauaagcaugaucggacacuucggcgugggcuucuacucggccuaccucguggccaagaaagugaccgugaucucaaaacacaacaacgacgagcaauacaccugggaaucgagcgcgggcgggagcuucaccgugcgcacggacgaguaa

SEQ ID NO: 1152 - RNA, 2175 nt, Artificial Sequence
  derived and/or modified CDS sequence (opt11) from Homo sapiens__NP_031381.2__HsHSP90AB1
augcccgaagaagugcaccacggggaagaggaagucgaaaccuucgccuuccaggccgagauagcccaacucaugagcuuaaucauaaacaccuucuacuccaacaaagaaaucuuccucagagaguugauaucaaacgcaagcgacgcccuggacaagauaagauacgaaagccuaacagacccaucaaaacuggacucaggaaaggaguuaaaaauagacaucaucccaaacccacaagaacgcacgcucacccucguggacaccggaauaggaaugacaaaagccgaccucauaaacaaucucggcacgauagccaagagcgggacaaaagccuucauggaggcccuacaagcaggagccgacauaagcaugaucggacaauucggcguaggcuucuacagcgcauaccucgucgccgaaaaggugguaguaaucacaaaacacaacgacgacgaacaauacgccugggaaagcagcgccggcgggagcuucacagucagagcagaccacggcgaaccuauaggacgcgggacuaaaguaauccuccaccuaaaggaagaccaaaccgaauacuuagaagagcgcagggucaaggaagucgucaaaaaacacagccaguucaucggcuaccccauaacccucuaccuggaaaaagagagggaaaaggaaauaagugacgacgaggccgaggaagaaaaaggagaaaaagaagaagaagacaaagacgacgaagaaaagcccaagaucgaagacguaggaagcgacgaagaagacgacucaggaaaggacaagaaaaaaaaaacgaaaaaaaucaaagagaaauacaucgaccaagaagagcugaacaaaacaaaaccaaucuggaccaggaaccccgaugacaucacacaagaagaauacggggaauucuacaaaucgcuaacaaacgacugggaggaccaccucgcgguaaagcacuucagcguggaaggacaacucgaauucagagcacuacuauucaucccaaggagagcgccauucgaccuguucgaaaacaagaaaaaaaaaaacaacauaaagcuauacguccgacgagucuucauaauggacucaugcgacgaacugaucccagaauaccuaaacuucauccggggcguaguagacuccgaagaccucccacucaacaucagccgagaaaugcuacaacagagcaagauacugaaagugaucagaaaaaacaucguaaaaaagugccuagaacuauucagcgaauuagcagaggauaaagaaaacuacaagaaauucuacgaagccuucagcaagaaccuaaaacugggcauacacgaagacagcaccaaucgaaggcgccuaagcgaacuacuaagauaccacacaagucagagcggcgacgagaugacgagccuauccgaauacguuagccggaugaaagaaacgcaaaagucaauauacuacaucaccggagagagcaaggaacaaguagcgaacucggcauucgucgaacgcgugcgaaagcgcggauucgaagucguauacaugacggagcccaucgacgaguacuguguacaacagcucaaagaauucgacggcaaaagccuagucucaguaaccaaagaaggacuagaauugcccgaagacgaagaagagaagaaaaaaauggaagaaucaaaagccaaauucgagaacuugugcaagcugaugaaagagauccuagacaaaaagguagaaaaggucacgaucucaaaccggcuggugagcucgcccugcugcaucgucacgagcacauacggcuggacagcaaacauggaacgaauaaugaaagcacaagcccucagagacaacucaaccaugggguacaugauggccaagaaacaccucgaaauaaaccccgaccacccuauaguagaaacgcucaggcaaaaggccgaagcagacaaaaacgacaaagccguaaaagaccucgugguccugcucuucgaaacagcccuacucucaagcggauuuucacuggaggacccacaaacccacagcaacagaaucuaccgaaugauuaagcucggacuggguauugacgaggacgaaguagccgcggaagagcccaacgcggcaguccccgacgaaaucccgccccuggaaggggacgaggacgcaucaagaauggaagaggucgacuag

SEQ ID NO: 1153 - RNA, 2412 nt, Artificial Sequence
  derived and/or modified CDS sequence (opt11) from Homo sapiens__NP_003290.1__HsHSP90B1
augagagcccuaugggugcucgggcucugcugcguacuacucacguucggaucaguccgagcagacgacgaggucgacgucgacggaacggucgaagaagaccuaggaaaaagccgcgaaggcagccggacagacgacgaggucguccagcgagaggaagaggcaauacaacucgacggucuaaacgccagccagauacgcgagcuccgggagaaaagugaaaaauucgccuuccaagcagaggucaacagaaugaugaaacucauaauuaacucccuauacaaaaacaaagaaauauuccugcgggaacuaaucuccaacgccagcgacgccuuagacaaaauacgacucaucagccugacagacgaaaacgccuugagcgggaacgaggaacuaaccgugaaaauaaaaugcgacaaagagaagaaccugcuacacguaacggauacgggaguaggcaugacacgagaagaacucgucaaaaaccucggaaccauagccaagagcggcacaagcgaguuccucaacaaaaugacagaagcccaggaggacggccaaucaacgagugagcuuauaggccaauucgggguaggguucuacagcgcguuccuaguagcggacaaaguaauagucacaagcaaacacaauaacgauacacagcacauaugggaaucagacagcaacgaauuuagcgugaucgcggacccgcggggaaacacgcuuggcagaggaaccaccaucacucuaguacucaaggaagaggcuucagacuaucuagaacuggacacaaucaaaaaccucguaaagaaauacagccaauucauaaacuucccgauauacgucuggagcucgaaaacagaaacaguagaggagccgauggaggaggaagaggcagccaaagaagaaaaagaagaaucggacgacgaagcggcagucgaagaagaagaggaagagaaaaagcccaaaaccaagaaaguagagaaaaccguaugggacugggaacucaugaacgacauaaaacccauauggcagcgcccgagcaaagaagucgaggaagacgaauacaaagccuucuacaagagcuucagcaaagaaagcgacgacccgauggccuauauacacuucacagccgaaggagaggugacguucaaaagcauccucuucgucccgacgagcgcccccaggggacucuucgacgaauacgggaguaagaaaagcgacuacaucaaacuauacguccgacggguguucauaaccgacgacuuccacgacaugaugcccaaguaccugaacuucgucaaaggagugguagauucagaugaccugccacucaacguaagcagagagacgcuccaacagcacaaacugcucaagguaauacgcaagaagcuagucaggaaaacgcucgacaugaucaaaaagauugcggacgauaaguacaacgacacguucuggaaggaguucggaacgaacauaaaacuaggcguaaucgaagaccacagcaaccgaacaagacucgcaaaacuccucagauuccagagcagccaucaccccacagacauaacaagccuggaccaauauguggaacgaaugaaagaaaaacaggacaaaaucuacuucauggcgggauccagccgcaaagaggcagaaagcagccccuucguagaacgacuccuaaagaaaggcuacgaagucaucuacuugaccgaaccaguagacgaauacugcauccaggcccuucccgaguucgacggcaagagauuccaaaacgucgcgaaggaaggcguaaaauucgacgaaagcgagaagacgaaagaaucgagggaagcagucgagaaagaguucgaaccacugcucaacuggaugaaagacaaagcgcuaaaagacaagauagaaaaagcgguaguaucgcaacggcugaccgaaagcccaugcgcccuagucgcgagccaauacggcuggagcgggaacauggaaagaauuaugaaagcgcaagccuaccagacaggaaaggacaucagcaccaacuacuacgccagccaaaagaagacguucgaaaucaacccaagacacccgcuaauaagagacaugcuacgaaggaucaaggaagacgaggacgacaagaccgugcucgaccucgcggucgugcuauucgaaacggccacgcuuagaagcggauaccugcuacccgacacgaaagccuacggcgaccgaaucgaacgcaugcuaaggcucagucuaaacauagaccccgacgcgaaaguggaagaggaaccagaggaggaaccagaagaaacggcagaggacaccaccgaggacacagaacaggacgaggacgaggagauggacgucggaacggacgaagaggaagaaaccgcaaaggaaucgaccgcagaaaaggacgagcuauaa

SEQ ID NO: 1154 - RNA, 2115 nt, Artificial Sequence
  derived and/or modified CDS sequence (opt11) from Homo sapiens__NP_057376.2__HsTRAP1
auggcccgcgaauuacgagcccuacuacuauggggucgccgacuccgcccacuacuccgagcccccgcacucgccgcagucccuggaggaaaacccauacucugcccccgaagaacaacagcucaacucggcccccgucgcaacccagccuggucgcuccaggccggccgacucuucuccacacaaaccgccgaagacaaagaagaaccccuccacagcauaaucagcagcaccgaguccguacaaggaagcaccuccaaacacgaguuccaggccgaaaccaagaaacuucucgacaucguagcccgaagucuauacuccgaaaaagaagucuucauccgagaacuuaucucuaacgcauccgacgcacucgaaaaacuacgacacaaacucguaucagacggucaagcacuacccgaaauggaaauacaucuacaaaccaacgcagaaaaagguaccauaacaauucaagacacgggaauaggaaugacgcaggaggaacucgucucaaaccuaggcacuauagcccgaagcggcagcaaagccuuccucgacgcccuccaaaaccaagccgaagccuccuccaaaaucaucggucaguucggcguaggcuucuauuccgccuucaugguagcagaccgagucgaaguauauucucgcucagcagcccccggcucccuaggcuaccaauggcuauccgacggcagcggcguguucgaaauagcagaagccucgggcguccguacaggcaccaaaaucaucauacaccuaaaaagcgacugcaaagaauuuagcucagaagcccgcguccgagacgucgucaccaaauauucaaauuucgucucauuuccacucuaucuaaacggcagacgcaugaacacgcuccaagccaucuggaugauggacccaaaagacguccgcgaauggcagcaugaagaguucuaccgcuacguagcacaagcgcacgacaaaccacgcuacacccuccacuacaaaacggacgccccacuaaacauccgcuccaucuucuacguaccggacaugaaacccagcauguucgacguaucccgcgaacucggcucaucgguagcacucuacucuaggaaaguccucauacaaacaaaagccaccgacauccuaccaaaauggcuucgauucaucagaggcgucgucgacagugaagacaucccccucaaccucucacgagaacuccuacaagaauccgccuuaauccgaaaacuccgcgacguacuucaacagcgucucauaaaauucuucaucgaucaauccaagaaagaugcagaaaaauacgccaaauucuucgaagacuacggccucuucaugcgggaaggcaucguaacagcaaccgagcaagaggucaaagaggacauagcaaaacuccucagauacgaguccagcgcccuucccucgggccaacuaacuagccuaagcgaauacgccucacguaugagagcaggcacccgcaacaucuacuaccucugcgccccaaaccgacaccucgcagaacacucacccuacuacgaggccaugaaaaagaaagacaccgaaguccuguucugcuuugaacaauucgacgaacugacccuacuacaccucagagaguucgacaaaaagaaacucaucagcgucgagacggacaucgucguagaccacuacaaagaagaaaaauucgaggaccgcagcccagccgcagaaugccuaucggaaaaagaaaccgaagaacucauggccuggaugcggaacguccuaggcuccagaguaaccaacguaaaagucacacucagacuagacacccaccccgccauggucaccguacuagaaaugggagcugcccgacacuuccuacgaaugcaacaacuagcaaaaacacaggaggaacgcgcccaacuccuucaaccaacccucgaaauaaacccccgacacgcccuaauaaagaaacuaaaucaacugagggccuccgagcccggacucgcccaacuucuagucgaccagaucuacgaaaacgccaugaucgcggcaggccuaguagacgacccccgcgccauggugggacgacuaaaugaacuacuugucaaagcacuagagcgacauuaa

SEQ ID NO: 1155 - RNA, 462 nt, Artificial Sequence
  derived and/or modified CDS sequence (opt11) from Homo sapiens__NP_000609.1__HsIGF1
augggcaaaaucuccucccuccccacccaacucuucaaaugcugcuucugcgacuuccuaaaagucaaaaugcacaccauguccuccucccaccucuucuaccuagcccucugccuccuuaccuucaccuccuccgccaccgccggccccgaaacccucugcggcgccgaacucgucgacgcccuccaauuugucugcggcgaccgcggauucuacuucaacaaacccaccggcuacggcuccuccucccgccgcgcaccccaaaccggcaucgucgacgaaugcugcuuccgcuccugcgaccuccgccgccucgaaauguacugcgcaccccucaaacccgccaaauccgcccgcuccguccgcgcccaacgccacaccgacaugcccaaaacccaaaaagaaguccaccucaaaaacgccucccgcggcuccgccggcaacaaaaacuaccgcauguaa

SEQ ID NO: 1156 - RNA, 543 nt, Artificial Sequence
  derived and/or modified CDS sequence (opt11) from Homo sapiens__NP_000603.1__HsIGF2
augggcauccccaugggcaaauccaugcucguccuccuaaccuuccucgccuucgccuccugcugcaucgccgccuaccgacccuccgaaacacucugcggcggcgaacucgucgacacccuccaauucgucugcggcgaccgcggcuucuacuucucccgccccgccucccgcgucucacgccgcucccgcggcaucgucgaagaaugcugcuuccgcucuugcgaccucgcccuccucgaaaccuacugcgccacccccgcaaaauccgaacgcgacgucuccaccccccccacaguacuccccgacaacuucccccguuaccccgucggcaaauucuuccaauacgacaccuggaaacaauccacccaacgccuccgccgcggacuacccgcccuacuccgcgcccgccgcggccacguccuagcaaaagaacucgaagccuuccgagaagccaaacgccaccgcccccucaucgcccuccccacccaagaccccgcccacggaggcgccccccccgaaauggccuccaaccgcaaauaa

SEQ ID NO: 1157 - RNA, 639 nt, Artificial Sequence
  derived and/or modified CDS sequence (opt11) from Homo sapiens__NP_000591.1__HsIL6
augaacuccuucuccaccuccgccuucggccccgucgccuucucccucggccuccuacucguacuccccgccgccuucccagcccccguccccccaggcgaagacuccaaagacgucgccgccccccaccgccaaccucucaccucauccgaacgcaucgacaaacaaauacgcuacauccucgacggcaucuccgcccuccgcaaagaaaccugcaacaaaucaaacaugugcgaauccucaaaagaagcccucgccgaaaacaaccuaaaccuccccaaaauggccgaaaaagacggcugcuuccaauccggcuucaacgaagaaacaugccucgucaaaauaaucaccggacuccucgaauucgaagucuaccucgaauaccuacaaaaccgcuucgaaucauccgaagaacaagcccgcgccguccaaaugucaaccaaaguccucauccaauuccuccaaaaaaaagccaaaaaccucgacgccaucacaacccccgaccccaccaccaacgccucccuacucaccaaacuccaagcccaaaaccaauggcuccaagacaugaccacccaccucauccuccgcuccuucaaagaauuccuccaauccucccuccgcgcccuccgacaaauguag

SEQ ID NO: 1158 - RNA, 1281 nt, Artificial Sequence
  derived and/or modified CDS sequence (opt11) from Homo sapiens__NP_002183.1__HsINHBA
augccacuccuguggcuccgcggauuccuccuagcaagcugcuggauaauaguacgaagcuccccaacaccaggcagcgagggccacagcgccgcacccgacugcccauccugcgcacucgccgcccucccaaaagacgucccgaacagccaacccgaaauggucgaagcggucaagaaacacauacucaacaugcuacaccuaaagaaacgcccagacguaacacagccaguccccaaagccgcacuacuaaacgcgauccgaaaacuacacguaggcaaagugggagaaaauggcuacgucgaaaucgaagacgacauaggcagacgagcagaaaugaacgaacuaauggaacaaacaagugaaauaaucacauucgccgagagcggcacagcccggaaaacccuacacuucgaaaucucaaaagaaggauccgaccucagcgucguagaacgagccgaaguguggcuauuccucaaaguccccaaagccaacagaaccagaaccaaagucacaaucagacucuuccaacagcaaaaacacccgcaaggaagccucgacacaggcgaagaagcagaggaagucggacucaaaggugaacgcagcgaacuccuccuguccgaaaaagucgucgacgcccgaaaaagcacauggcacguauucccaguaagcagcuccauccaacgccugcuagaccaagggaaaucaagccuggacguccgcauagcaugcgaacaaugccaagaaagcggcgcaagccuaguacuacuagggaaaaagaaaaagaaagaggaagaaggagaaggaaagaagaaaggaggcggagaagguggagcaggcgccgacgaagaaaaagaacaaagccaccggccauuccucaugcuacaagccagacaaagcgaagaccacccacaccgacgacgccgacgaggccucgaaugcgacggaaaagucaauauaugcugcaagaaacaauucuucgucagcuucaaagacauaggguggaacgacuggaucauagccccaagcggcuaccacgccaacuacugcgaaggagaaugcccaagccacaucgccggaacauccgggagcagccugagcuuccacagcacgguaauaaaccacuaccgcaugcgcggccacagcccauucgccaaccucaaaagcugcugcguacccaccaaacuacgcccaauguccaugcucuacuacgacgacgggcagaacaucauaaagaaagacauacagaacaugaucgucgaagagugcggcugcuccuaa

SEQ ID NO: 1159 - RNA, 1224 nt, Artificial Sequence
  derived and/or modified CDS sequence (opt11) from Homo sapiens__NP_002184.2__HsINHBB
auggacggccuaccaggacgagcccucggcgccgcaugccuccuucuccucgccgccggaugguuaggccccgaagcauggggcucacccaccccaccacccaccccagccgcacccccacccccacccccaccaggauccccaggaggcagccaagacacaugcaccucgugcggaggcuucagacgcccugaagaacuaggccgagucgacggcgacuuccucgaagccgugaaacgccauauacucucccgacuccaaaugcgcggccgacccaacauaacccacgccguacccaaagcagcuaugguaaccgcccuccgcaaacuccaugccggcaaaguccgagaagacggccgagucgaaaucccccaccucgacggacacgccucccccggcgccgacggccaagaacgaguaucagaaaucaucuccuucgcugaaaccgacggccuggcauccucccgaguccgccucuacuucuuuauauccaacgaagguaaccaaaaccucuucgucguccaagccucacuauggcucuaccuaaaacuacuccccuacguacucgaaaaaggcagccgccgcaaaguccgcguaaaagucuauuuccaagaacaaggccacggcgaccgcuggaacaugguagaaaaacgugucgaccucaaaagaucaggcuggcacaccuucccccuaaccgaagcuauccaagcacucuucgaacgaggagaacgaagacucaaccucgacguacaaugcgacucuugccaagaacucgcgguagucccaguauucgucgaccccggcgaagaaucccacagacccuuuguaguaguacaagcgcgacucggcgacucucgacaccgaauccgcaaacgcggccuagaaugcgacggacgcacaaaccucugcugccgccaacaauucuucauagacuuccgccuaaucggcuggaacgacuggaucauagcccccaccggcuacuacggcaauuacugcgaaggcucaugccccgcauaccucgccggcguccccggcucagcauccucuuuccacaccgccgucguaaaccaauacaggaugcgcggacuuaacccaggaacagucaauuccugcugcauacccaccaaacucagcaccauguccaugcucuacuucgacgacgaauacaacaucgucaaacgcgacguccccaacaugaucgucgaagaaugcggaugcgcauaa

SEQ ID NO: 1160 - RNA, 3459 nt, Artificial Sequence
  derived and/or modified CDS sequence (opt11) from Homo sapiens__NP_000623.2__HsITGAM
auggcccuccguguuuuacugcucacagcacucacacugugucacggauucaaccuagacaccgaaaaugcaaugaccuuccaagaaaacgcacgcggcuucggacaaucgguaguccaacuacaagguucgcgcguagucgucggcgccccucaagagauagucgcugcaaaccaacgaggcucacucuaccaaugcgacuacucaaccgggucaugcgaaccaaucagacuccaagucccagucgaagcagucaacaugagccugggucucagccucgccgccacaaccucacccccacaacucuuagcaugcggaccaaccguccaucagaccugcucggaaaacaccuacguaaaaggccuaugcuuucucuuuggguccaaccuacgacagcagccccaaaaauuccccgaagcccuccgaggauguccgcaagaagacagcgacauagccuuucucauugacggcuccggauccauaauaccacacgacuuccgccggaugaaggaauuugucucaacaguuauggaacaacucaagaaauccaaaacacucuucucccugaugcaauacagcgaggaguucagaauccacuucaccuucaaagaguuccagaacaaccccaacccccgcucacugguaaaaccaauaacucaacuccucggcaggacacacacggccacgggcaucaggaaggucgugcgcgaacucuucaacauaacaaauggugcacgcaaaaacgccuucaaaauccuuguggucauaaccgacggcgaaaaauucggggacccauuaggauacgaagacguaauccccgaagcggacagagagggaguaauccgauacgucaucggcguuggggacgccuuccguagcgaaaaaucccgccaggaacucaacacaauugccuccaaaccgccccgagaccacgucuuccaagucaacaacuucgaagcccucaaaaccauccaaaaccaacuccgagagaaaauauucgccauagaaggaacccaaaccggcagcuccagcuccuucgaacaugaaaugucccaagaaggcuucagcgccgcgaucaccuccaacggcccucuacucucuaccgucggaucauacgacugggcuggcggcgucuuccuuuacaccuccaaggaaaaaucgacauucaucaacaugaccagagucgauucugacaugaacgacgcauaucucggcuacgccgcugcuaucauucuacgcaacagagugcaaucucuaguauuaggagccccucguuaccaacacaucggccuaguggcaauguuccgucaaaacaccgggaugugggaaagcaacgcgaacgucaagggcacccaaaucggcgcauacuucggagcuucucucugcucuguggacgucgacucaaacggaagcacugaucucguucuuaucggagcaccccacuacuaugagcagacucgaggaggccaaguaucagucuguccacucccccguggccgagcccgcuggcaaugcgacgcgguucuauauggcgaacaaggucaacccuggggcagguucggugccgcgcucaccguccuuggagacgucaacggcgacaaacucaccgacguagcaaucggcgcaccuggcgaggaagacaaccgcggcgcaguguaccucuuccacggcaccuccggcagcggcaucucacccucccacucacaacgcauagccggcucuaaacugucccccagacugcaauacuucgggcaaagccuauccgguggacaagaccucacgauggacggccuaguagaucugacgguuggcgcgcaagggcauguacuucuacuacgaucccaaccaguacuacgugucaaggcaaucauggaguucaauccacgggaagucgcacgaaacgucuucgaaugcaacgaccaaguugucaagggcaaagaagccggcgaagucagagugugucugcacguacaaaagagcacacgugaucgacugcgagaaggacaaauccaguccguggucaccuacgaccuagcccuagacuccggaagaccccacagccgugccgucuucaacgaaaccaaaaauucaacccgccggcaaacccaggugcuaggccuuacccaaacuugcgagacgcucaaacuacaacugcccaacuguaucgaagacccagucucaccaaucguacuacgccuuaauuuuucccuagucggcacaccccucucagcauucggaaaccuccgacccguccucgccgaagacgcccaacgacuuuucaccgcccuauuccccuucgaaaagaacugcggcaacgacaacauaugucaagacgaccucagcaucaccuucucuuucaugucgcucgacugccuagugguaggcggaccccgagaauuuaacgucacagucaccguaagaaacgacggagaggauuccuacagaacgcaaguuacauucuucuucccgcucgaccucucguaccgcaaagucucgacccuucaaaaccaacgaucucaacgaucuuggaggcucgcaugugaaucagccucgucaacagaaguaaguggcgcccucaaaucgaccuccuguuccauaaaccacccaaucuuccccgagaacagcgaagucacauucaacauaacauucgacguugacucuaaagcaucacucggcaacaaacucuuacugaaagccaacgucaccagcgaaaacaacaugccaagaacaaacaaaacagaguuccaacucgaacucccagucaaguaugccguauacauggucgucaccagccacggaguauccacaaaauaccucaacuuuaccgccagcgaaaacacguccagaguaaugcaacaccaauaccagguauccaaccuuggucaacgcagucuacccaucucccuaguguuccucguucccgucagacuaaaccagacaguaauaugggaccguccacaaguaacauucucugaaaaccucuccuccacaugucacacuaaagaacgacucccuagccauuccgacuuucuugcagagcuucgcaaagccccuguugugaacugcucaaucgcgguaugccagcgcauacagugcgacauaccauucuuugggauacaggaagaguucaacgcgacucucaaagguaaccucagcuucgacugguauaucaagaccucacauaaccaccuccuaauaguauccacagccgaaauccucuucaacgacagcgucuucacauugcugcccggccaaggagcuuucguacgaucgcagacagaaacuaaaguagaaccuuucgaagucccgaacccgcucccgcuaaucgucggauccuccguuggcgggcuacuccuucuugcccucaucacagcagcacuguauaagcucggcuucuucaagcgccaauacaaagauaugauguccgaaggcggcccgcccggggccgaaccccaguaa

SEQ ID NO: 1161 - RNA, 1404 nt, Artificial Sequence
  derived and/or modified CDS sequence (opt11) from Homo sapiens__NP_002415.1__HsMMP8
auguucucccucaaaaccuuaccguuccuccuacuacuacacguccaaaucuccaaagccuucccugucuccagcaaagagaaaaacacuaaaaccguacaggacuaccucgaaaaauucuaccaacuacccucaaaccaguaccaguccacccgcaaaaacggcacaaacgugaucgucgaaaagcuaaaagaaaugcaacgcuucuucggccuaaacgucacaggcaaacccaacgaagaaacccucgacaugaugaagaaaccccgaugcggcguccccgacuccggcggcuucaugcucacacccgguaaccccaaaugggaacgaaccaaccuaaccuaccgcauacgaaacuacacaccccaacucucagaagccgaagucgaacgagcuaucaaagacgcauuugaacucugguccgucgcaucaccccucaucuucacccgcaucucucaaggcgaagccgacauaaauaucgccuucuaucaaagagaccacggcgacaacucccccuucgacggcccgaacgguauccucgcacacgccuuccaaccaggccaaggaaucggcggcgaugcccacuucgacgcagaagaaaccuggacaaacaccucagccaacuacaaccucuuccucgucgccgcgcacgaguucggacauucccucggccuagcccacuccuccgaccccggugcacucauguacccaaacuacgccuuccgcgaaaccagcaacuacucacucccccaagacgacauagacggcauccaagccauauacggacuaucauccaaccccauccagccaaccggacccucaacccccaaacccugcgauccaucccucaccuucgacgccaucaccacccuacguggagagauccucuucuucaaagaucgauauuucuggcgccgacacccccaacugcaacggguugaaaugaacuucaucagccucuucuggccuucacuacccaccggaauccaagccgccuaugaagacuuugaccgcgaccucaucuuccucuucaaaggaaaccaauacugggcccucucggguuacgacauccuucaaggcuacccuaaagacauaucaaacuacggauucccaucguccguccaagccaucgaugccgcaguuuucuaccgcuccaaaaccuacuucuucgucaacgaccaauucuggcgcuaugacaaccaacgccaauucauggaaccaggauaccccaaauccaucuccggcgccuuccccggcaucgaaagcaaagucgacgcagucuuccaacaagaacacuucuuccacguuuucucaggcccucgcuacuacgccuucgaccuaaucgcccaacgagucacccgagucgcccgaggaaacaaauggcuuaacugccgcuacggauag

SEQ ID NO: 1162 - RNA, 2124 nt, Artificial Sequence
  derived and/or modified CDS sequence (opt11) from Homo sapiens__NP_004985.2__HsMMP9
augucccucuggcaaccucucguauuaguacuccuaguccuuggaugcugcuuugccgcuccucgacaacgccaauccacacucguccuuuucccaggggaucuaagaaccaaccuuaccgaccggcaacuagcagaggaauaccuauaccgcuauggauacacaagagucgccgaaaugagaggagaaucgaaaagccucggaccagcccuccuacuacuacaaaaacaacucucccugcccgaaacuggcgaacucgacucugccacucuaaaagcaaugaggaccccacgaugcggcguccccgaccuaggcagauuccaaaccuucgaaggcgaucuaaaauggcaccaccacaacauaaccuacuggauccaaaacuacucagaagaccucccccgagccguaauagacgaugccuucgcaagagcuuucgcccucuggucggcagucacuccccucaccuuuaccagaguauacucccgagacgccgacauagucauccaauucggcgucgccgaacacggcgacggcuaccccuucgacggaaaagauggacuccucgcucacgcguucccaccaggcccagguauccaaggcgaugcucacuucgacgacgacgaacuauggucucucggaaaaggggucgucguccccacccgauucggaaacgcagacggcgccgcuugccacuuccccuucaucuucgaaggacguuccuacagcgccugcacgaccgacggaagauccgauggacuaccauggugcucaacgaccgccaacuacgacacagacgacagauucggauucugucccucagaacgucucuacacacaagacggcaacgccgauggcaaacccugccaauuccccuucauauuccaaggccaauccuacuccgccugcacaaccgacggacgcucugacggcuaccgauggugcgcuacaacagcaaacuaugaucgagacaaguuauuuggauucugccccacccgcgccgauuccaccguaaugggugggaacuccgcaggagaacucugcgucuuccccuucaccuuccucggaaaagaguacagcacaugcaccuccgaaggccgaggcgacggccgccuauggugcgccaccaccuccaacuuugacucagacaagaaaugggguuucugccccgaccaagguuacagccucuuccucgucgccgcacaugaauuuggacacgcauuaggccuagaccacucgucaguccccgaagcccucauguaccccauguacagauucacugaaggcccaccccuccacaaagacgacgucaacggaauccgccaucucuacggcccccgaccagaaccugaaccacgcccacccacaaccaccacaccccaacccaccgccccacccacugucugccccaccggcccacccaccguccaucccagcgagagacccaccgcgggcccaaccggcccacccuccgcaggccccacuggacccccaaccgcaggacccuccaccgcuacuaccguuccacuauccccagucgacgacgcuugcaacgucaacaucuucgacgccauagcugagauaggaaaccagcucuaccuauucaaagacggaaaauacuggcgauucuccgagggacgcggcucccgcccccaaggaccauuucuaauagcagacaaguggcccgcacucccacgcaaacuugacuccguuuucgaggaaagacucuccaagaaacuauucuucuuuuccggccgacaagucuggguuuacacaggcgccuccguacucgguccucgccgccuugacaaacuagggcucggcgcagacgucgcccagguaacaggagcucuccgaagcggaaggggcaaaauguuacucuucuccggccgucgacucuggcgauucgacguaaaagcccaaaugguagaucccagaagcgccagcgaagucgaccgcauguucccaggagucccccuugauacccacgacgucuuccaauaccgcgaaaaagccuacuuuugccaagaccgcuucuacuggcgcgucucuagcagaucagaacuuaaccaaguagaccaaguaggcuacgucaccuacgacauccuacagugcccagaagacuaa

SEQ ID NO: 1163 - RNA, 1416 nt, Artificial Sequence
  derived and/or modified CDS sequence (opt11) from Homo sapiens__NP_002418.1__HsMMP13
augcaccccggcguacucgcagccuuccuauuccuauccuggacccacugccgcgcauuaccccuccccucaggaggcgaugaagacgaccuuuccgaagaagaccugcaauucgccgaacgcuaccuccgauccuacuaccaccccaccaaccucgccggcauacucaaagaaaacgcagccucauccaugacagaacgccuccgcgaaaugcaauccuucuuuggccucgaagucaccggaaaacuugacgacaacacgcuagacgucaugaaaaaacccagaugcggaguccccgacgucggcgaauacaacgucuuccccagaacccuaaaauggucaaaaaugaaccucaccuacagaauagucaacuacaccccugacaugacccacuccgaaguagaaaaagccuucaaaaaagccuucaaagucuggucugacguuaccccccucaacuucacccgacuccacgacggcaucgccgacauaaugaucuccuucggaaucaaagaacacggcgacuucuaccccuucgacggaccaucaggccuacucgcccacgccuucccaccaggacccaacuacggaggcgacgcccacuucgaugacgacgaaaccuggaccuccuccuccaaaggcuacaaccucuuccuaguagccgcacacgaauucggccacucacuaggacuagaccacuccaaagaccccggcgcucuuauguuccccaucuacaccuacacugggaaaucccacuucaugcuccccgacgacgacguacaaggcauccaaagccucuacggcccgggcgacgaagaucccaaccccaaacaccccaaaacaccagacaaaugcgaccccucacuaucacuagacgcaaucaccucccuccguggcgaaacuaugaucuucaaagaccgauucuucuggcgcuuacacccccaacaagucgacgccgaacucuuccuuaccaaaucauucuggcccgaacuccccaaccgcaucgacgccgccuacgaacaccccagccaugaccucaucuuuaucuuccgcgggagaaaauucugggcacuaaacggauacgacauacucgaaggcuacccaaaaaaaaucuccgaacuaggccucccaaaggaagucaaaaagaucuccgcagcaguacacuucgaagacaccggcaaaacccuccuauucucagguaaccaaguauggcgcuacgacgacaccaaccacaucauggacaaagacuacccccgccucaucgaagaagacuuccccggcauaggcgacaaagucgacgccgucuaugaaaaaaacggcuacauauacuucuuuaacggccccauccaauuugaauacuccauaugguccaaccgcaucguacgcguuaugccagccaacuccauccucuggugcuaa

SEQ ID NO: 1164 - RNA, 1068 nt, Artificial Sequence
  derived and/or modified CDS sequence (opt11) from Homo sapiens__NP_001286.1__HsCCR1
auggaaaccccgaacaccaccgaagauuacgacaccacaaccgaguucgacuacggcgacgccacccccugccaaaaagucaacgaacgcgccuucggcgcccaacuccucccaccccuuuacucccucgucuucgucaucggccucgucggcaauauccucguaguccucguccucguccaauacaaacgacucaaaaacaugaccuccaucuaccuacucaaccuugccaucuccgaccuccucuuccucuucacccuccccuucuggauagacuacaaacucaaagacgacugggucuucggcgacgccaugugcaaaauccucucgggcuucuacuacacaggacucuacuccgaaaucuucuucaucauccuccuaacuaucgaccgcuaccuagccaucguccacgccgucuucgcacuacgcgcccgcaccguaaccuucggcgucaucaccucaaucaucaucugggcccucgccauccucgccuccaugcccggccucuacuucucaaaaacccaaugggaguucacacaccacacaugcucacuccacuucccccacgaaucccuacgcgaauggaaacucuuccaagcccucaaacucaaccuauucggccuaguccucccacuacucgucaugaucaucugcuacacaggcaucaucaaaauacuccuccgccgccccaacgaaaagaaauccaaagcaguccgccucaucuuugucauaaugauaaucuucuuccuauucuggacccccuacaaccucaccauccucaucucaguauuccaagacuuccucuucacccaugaaugcgaacaaucacgccacuuagaccucgccguccaagucaccgaggucauugccuacacccacugcugcgucaacccaguaaucuacgccuucgucggcgaacgcuuccgcaaauaccuccgucaacuauuccaccgacgcgucgccguacaccucgucaaauggcuccccuuccuaucugucgaccgacuagaacgcgucuccuccacaagcccaagcaccggcgaacacgaacucuccgccggcuucuag

SEQ ID NO: 1165 - RNA, 636 nt, Artificial Sequence
  derived and/or modified CDS sequence (opt11) from Homo sapiens__NP_002598.4__HsPDGFA
augcgcacacucgccugccuccuacuccucggcugcggcuaccucgcacacguccucgccgaagaagccgaaaucccccgagaagucaucgaacgacucgcccgcucccaaauccacuccauccgcgaccuccaacgccuccucgaaaucgacuccgucggcuccgaagacucccucgacaccucacuccgcgcccacggaguccacgccaccaaacacguacccgaaaaacgaccccuccccauccgccgaaaacgcuccauagaagaagccguccccgccgucugcaaaacccgcaccgucaucuacgaaaucccccgcucccaagucgaccccacauccgccaacuuccucaucuggccccccugcguagaagucaaacgcugcaccggcugcugcaacacauccuccguaaaaugccaacccucccgcguacaccaccgcuccgucaaagucgccaaagucgaauacguccgcaaaaaacccaaacuaaaagaaguccagguccgccucgaagaacaccucgaaugcgccugcgccaccaccucccucaacccagacuaccgcgaagaagacaccggccgcccccgcgaauccggcaaaaaacgcaaacgcaaacgccugaaacccaccuaa

SEQ ID NO: 1166 - RNA, 726 nt, Artificial Sequence
  derived and/or modified CDS sequence (opt11) from Homo sapiens__NP_002599.1__HsPDGFB
augaaccgaugcugggcccucuuccucagccucugcugcuaccuacgacuuguaucagccgaaggcgacccaaucccagaagaacuauacgaaaugcuguccgaccacuccauccgcuccuucgacgaccuccaacgccuccuccacggugaccccggcgaagaagacggcgccgaacuagaccuuaauaugacccgcucccacuccggcggagaacucgaaucacucgcccgcggacgccgcucccuaggcucccucaccaucgccgaaccagccaugaucgccgaaugcaaaacacgcaccgaaguauucgaaaucucacgccgacucaucgaccgcaccaacgccaacuuccuugucuggcccccaugcgucgaaguccaacgcugcuccggcugcugcaacaaccgcaacguacaaugccgacccacacaaguacaacuccgcccaguccaaguacgcaaaaucgaaaucguccgcaaaaaaccaaucuucaaaaaagccacagucacccucgaagaccaccucgccugcaaaugcgaaaccguagccgccgcacgccccgucacccgcucacccggcggaucacaagaacaacgugcaaaaaccccccaaacccgcgucacaauccgcaccguccgcguccgccgcccccccaaaggaaaacaccgcaaauucaaacacacacacgacaaaaccgcccucaaagaaacccuaggcgccuaa

SEQ ID NO: 1167 - RNA, 1038 nt, Artificial Sequence
  derived and/or modified CDS sequence (opt11) from Homo sapiens__NP_057289.1__HsPDGFC
augagccucuucggccuccuccuccucaccuccgcccuggccggccagcgccaaggcacccaggccgaauccaaccucuccuccaaauuccaauucuccuccaacaaagaacaaaacggcguccaagacccccaacacgaacgaaucaucaccgucucaacaaacggcucaauacacucaccacgcuucccccacaccuacccaagaaacaccguccucgucuggcgccuagucgccgucgaagaaaacguauggauccaacucaccuucgacgaacgcuucggccucgaagacccagaagacgacaucugcaaauacgacuucguagaagucgaagaaccuagcgacggcaccauacucggacguuggugcggcuccggcaccguccccggcaaacaaaucuccaaaggcaaccaaauccgaauacgcuucguauccgacgaauacuucccauccgaacccggcuucugcauccacuacaacaucgucaugccccaauucaccgaagccgucucccccuccguacuaccccccuccgcccucccccucgaucuucucaacaacgccaucacggccuucuccacccucgaagaccuaauacgcuaccuggaacccgaaagauggcaacucgaucucgaagaucuauaccgccccacauggcaacuccucggcaaagccuucgucuucggcagaaaaucccgggucguagaccucaaccuccucaccgaagaaguacgccuauacuccugcacaccacgcaacuucuccguauccauccgagaagaacucaaacgcaccgacacuaucuucuggcccggcugccuccucgucaaaagaugcggcggaaacugcgccugcugucuccacaacugcaacgaaugccaaugcguccccuccaaaguaaccaaaaaauaccacgaaguccuacaacuucgcccaaaaaccggcguaagaggccuccacaaaucccucaccgacgucgcacuagaacaccacgaagaaugcgacugcgucugccgcggcuccaccggaggauaa

SEQ ID NO: 1168 - RNA, 1095 nt, Artificial Sequence
  derived and/or modified CDS sequence (opt11) from Homo sapiens__NP_149126.1__HsPDGFD
augcaccgccuaaucuucgucuacacccuaaucugcgccaacuucugcuccugccgagacaccuccgccaccccacaauccgccuccauaaaagcacuccggaaugccaacuuacgccgggacgaccuauaccgucgagacgaaacaauccaaguaaaaggaaacggcuacgugcaaucgccccgauucccaaacuccuacccacgcaaccuccuccucaccuggcgacuacacucccaagaaaacacucgcauccaacucgucuucgacaaccaguucggccuggaagaagccgaaaacgacaucugccgcuacgacuucgucgaagucgaagacauaucagaaaccuccaccaucauacgcggccgcuggugcggccacaaagagguacccccccgcaucaaaucccgcacaaaccaaaucaaaauaaccuucaaaucagacgacuacuucguagcuaaacccggauucaaaaucuacuacucccuccuagaagacuuccaacccgccgcagcauccgagaccaacugggaauccguaaccuccuccauauccggcguauccuacaacagccccuccgucacagaccccacccuuauagccgacgcccucgacaaaaaaaucgccgaauucgacaccgucgaagaucuccuaaaauacuucaaccccgaaucauggcaagaagaccucgaaaacauguaccuagacaccccacgauaccgcggacgcucauaccacgaccgaaaauccaaagucgaccucgaccgacucaacgacgacgccaaacgcuacagcugcacaccacgcaacuacuccgucaacauccgcgaagagcuaaaacucgccaacguagucuucuucccccgcugccuucucguccaaagaugcggcggcaacugcggcuguggaaccguaaacuggcgcagcugcaccugcaacucaggcaaaaccgucaaaaaauaccacgaaguccuccaauucgaaccaggccacaucaaacgccgcggccgagccaaaacaauggcccucgucgacauccagcucgaccaccacgaacgcugcgacugcauaugcuccagccgccccccucgcuaa

SEQ ID NO: 1169 - RNA, 678 nt, Artificial Sequence
  derived and/or modified CDS sequence (opt11) from Homo sapiens__NP_003946.3__HsSOCS3
auggucacccacuccaaauucccugccgcaggcaugucccgaccccucgacaccucccuccgacucaaaaccuucuccucaaaguccgaauaccaacucgucgucaacgccguccguaaacuccaagaauccggcuucuacugguccgccgucaccgguggugaagcaaaccuccuccucuccgcagaacccgccggcaccuuccucauccgcgacuccucagaccaacgccacuucuucacccucucagucaaaacccaauccggcaccaaaaaccuccgcauccaaugcgaaggcggcuccuucucccuccaauccgacccacgcuccacacaaccugucccacgcuucgacugcguccucaaacucguccaccacuacaugccaccccccggcgcccccuccuucccauccccccccaccgaacccuccucagaaguccccgaacaacccucagcccaaccccuccccggcucccccccccgccgcgcauacuacaucuacuccggcggcgaaaaaaucccacucguacucucccgcccccucuccuccaacgucgccacccuacaacaccucugccgcaaaaccgucaacggccaccucgacuccuacgaaaaagucacccaacuacccggccccauccgcgaauuccucgaccaauacgaugcaccccuauaa

SEQ ID NO: 1170 - RNA, 483 nt, Artificial Sequence
  derived and/or modified CDS sequence (opt11) from Homo sapiens__NP_003227.1__HsTGFA
augguccccuccgccggccaacucgcccuauucgcccucggaaucguccucgcagccugccaagcccucgaaaacuccaccuccccccucuccgccgacccccccgucgccgccgccgucgucucccacuucaacgacugccccgacucccacacccaauucugcuuccacggcaccugccgcuuccucguccaagaagacaaacccgccugcgucugccacuccggcuacgucggcgcccgcugcgaacacgccgaccuccucgccgucgucgccgccucccaaaaaaaacaagccaucaccgcccucgucgucgucuccaucgucgcccucgccguccucaucaucaccugcguccuaauccacugcugccaaguccgcaaacacugcgaauggugccgcgcccucaucugccgccacgaaaaacccuccgcccuccucaaaggccgcaccgccugcugccacuccgaaacagucguuuaa

SEQ ID NO: 1171 - RNA, 1173 nt, Artificial Sequence
  derived and/or modified CDS sequence (opt11) from Homo sapiens__NP_000651.3__HsTGFB1
augccucccucuggccuucgacugcucccccuccuccucccccuccuauggcuccuaguccuaacacccggccgcccagccgcaggccucuccacaugcaaaacaauagacauggaacucgucaaacgaaaacgcaucgaagcaauccgcggccaaauacucucuaaacuucgccucgccucaccacccucccaaggcgaagucccaccaggaccccuccccgaagccguauuagcucucuacaacuccacacgcgaccgcgucgcaggcgagagcgccgaacccgaacccgaaccugaagcugacuacuacgccaaagaaguaacacgcguccucaugguugaaacccacaacgaaaucuaugacaaauucaaacaauccacccacucaaucuacauguucuuuaacacaucagaacuccgcgaagccguccccgaaccaguccuccuuucccgugccgaacuccgccuacugcgccucaaacuaaaaguagaacaacacguugaacucuaccaaaaauacucaaacaauuccuggcgauaccucuccaaccgccuccucgcccccuccgacagccccgaauggcucucuuuugacgucacaggcgucguacgccaauggcucucaagaggcggcgaaaucgaaggcuuccgccucucagcccauugcucuugcgacucucgcgacaacacccuccaagucgacaucaacggcuucaccaccggccgacgcggcgaccucgccaccauccacggcaugaaccguccuuuccuacuucuaauggccacaccccucgaacgcgcccaacaccuccaaucaucacgccacagacgcgcccucgacaccaacuacugcuucuccuccaccgaaaagaacugcugcguacgccaacucuacaucgacuuccguaaagaccucggcuggaaauggauccacgaacccaaaggcuaccacgccaacuucugucuuggcccaugccccuacaucuggucccuagacacucaauacuccaaaguccuagcccuuuacaaccaacacaaccccggcgcaucagccgcccccugcugcguaccccaagcccucgaaccacuccccauagucuacuacguaggccgaaaacccaaagucgagcaacuauccaacaugaucguccggucgugcaaaugcuccuaa

SEQ ID NO: 1172 - RNA, 1245 nt, Artificial Sequence
  derived and/or modified CDS sequence (opt11) from Homo sapiens__NP_003229.1__HsTGFB2
augcacuacugcguccucuccgccuuccucauauuacaccucgucaccguugcccuaucccucucgacuugcuccacccucgacauggaccaauucaugcgcaaaagaaucgaagcaauccgaggccaaauccucucaaaacucaaacuuacaucccccccugaagacuauccagaacccgaggaaguccccccugaagucauauccauauacaacagcacccgcgaccuacuccaagaaaaagccucgcgacgagccgcagccugcgaacgcgaacgcagcgacgaagaauacuacgccaaggaagucuacaaaaucgacaugccgcccuucuucccaucagagaaugcuaucccccccaccuucuaccgaccauacuuccgcaucguccgcuucgacgucuccgcaauggaaaaaaacgccuccaaccucgucaaagccgaauuccgcgucuuccgccugcaaaaccccaaagcccgcguucccgaacaacgcaucgaacucuaccaaauacucaaauccaaagaccucaccucucccacccaacguuacaucgacucuaaaguagucaaaacacgcgccgaaggcgaauggcucuccuucgacguaaccgacgccguacacgaauggcuccaccacaaagacagaaaccucggauucaaaaucucccuacacugccccugcugcacuuucguccccuccaacaacuacauaauucccaacaaauccgaagagcuugaagcccgcuucgccggcaucgacggaaccucgaccuacacuucaggcgaccagaaaaccauuaaauccacccgcaaaaaaaacucgggcaaaacaccccaccuccuacucaugcuccucccauccuaccggcuagaaucccaacaaaccaaccgacgcaaaaaacgagcccucgacgcagccuacugcuuccguaacguccaagacaauugcugccuacgcccacucuacaucgauuucaaacgugaccucggauggaaauggauccaugaacccaaaggcuacaacgccaacuucugcgcaggcgcaugccccuaccucuggagcuccgacacccaacacucccgcguccuaagccuuuacaacaccaucaaccccgaagccucagccucccccugcugcgucucccaagaccucgaaccacuaacaauccucuacuacaucggcaaaacccccaaaauagaacaacucuccaacaugaucgucaaauccugcaaaugcuccuaa

SEQ ID NO: 1173 - RNA, 1239 nt, Artificial Sequence
  derived and/or modified CDS sequence (opt11) from Homo sapiens__NP_003230.1__HsTGFB3
augaaaaugcaccuccaacgagcccuagucguccucgcacuacucaacuucgcaaccgucucccuaagccuuuccacaugcaccacccuggacuucggccacaucaaaaagaaacgugucgaagccauucgaggccaaauacucagcaaacuccgccucacaucacccccagaacccacaguuaugacccacguccccuaccagguccuagcccuauacaacagcacccgcgaacuccucgaagaaaugcacggcgaacgcgaagaaggcugcacccaagaaaauacagaguccgaauauuaugcaaaagaaauccacaaauucgacaugauccagggccucgccgaacacaacgagcucgccgucugucccaaaggcaucaccuccaaaguauucagauucaacgugucauccgucgagaaaaaccgcaccaaccucuuccgcgccgaguuccguguccuccgcgucccaaaccccuccagcaaacgaaacgaacaacgaauagaacuauuccagauccuccgccccgacgaacacaucgccaaacaacgcuacauugggggcaaaaaccuccccacccgcggaacagccgaauggcuauccuucgacgucaccgacaccguccgcgaauggcuacuaagaagagaauccaaccucggccucgaaaucuccauacacugccccugccacaccuuccaacccaacggagacauacucgaaaacauccacgaaguaauggaaaucaaguucaaaggagucgacaacgaagacgaccacggccgcggcgaccuaggccgccucaaaaagcagaaagaccaccacaacccccaccuaauacuaaugaugauacccccucaccgccucgacaaccccggccaaggcggacaacgcaaaaagcgcgcccucgacacuaacuacugcuuccgcaaccucgaagaaaacugcugcguccgcccccucuacaucgacuuccgccaagaccucggguggaaauggguacacgaacccaaaggcuacuacgccaacuucugcagcggaccaugcccauaccucagaagcgcagacacaacacacuccaccguccucggccucuacaacacccuaaaccccgaagccucagccucccccugcugcguaccacaagaccuugaaccacucaccauccucuauuacguaggccgcacccccaaagucgaacaacucucaaacauggucguaaaaucaugcaaaugcuccuaa

SEQ ID NO: 1174 - RNA, 1386 nt, Artificial Sequence
  derived and/or modified CDS sequence (opt11) from Homo sapiens__NP_001057.1__HsTNFRSF1B
auggcaccagucgcagucugggccgcccucgccguaggccuugaacucugggcagccgcccacgcccucccagcacaagucgcauucacucccuacgcacccgaacccggcuccaccugccgccuacgcgaauacuaugaccaaacagcacaaaugugcugcuccaaaugcucucccggccaacacgcuaaaguauucugcacaaaaaccucugacaccguaugcgacucaugcgaagacuccacauauacccaacucuggaacuggguccccgaaugccucuccugcggcucccgcugcagcucagaccaaguagaaacccaagcuugcacccgcgagcaaaaccgcaucugcacaugccgccccggcugguacugcgcucucuccaaacaagaaggcugcagacuuugugcaccucugaggaaaugccgaccaggcuuugguguagcaagacccgguaccgaaaccucagacgucgucugcaaaccgugugcacccggcaccuucucaaacaccaccuccucuaccgacaucugccgaccacaucaaaucugcaacguagucgccaucccaggcaacgccuccauggacgccguaugcaccucgaccucccccacccgcuccauggcccccggcgccguacaccuaccccaacccgucuccacccgaucccagcacacccaacccaccccagaacccagcaccgccccgucaaccucauuccuacucccaaugggccccuccccacccgcagaaggcuccacaggcgauuucgcccuccccguaggacuaauaguuggcgucaccgcccuaggccuccuuaucaucggcguagucaacugcgucaucaugacccaagucaaaaaaaaaccccucugccuccaacgcgaagccaaagucccacaccucccagccgacaaagcccgcggaacccaaggccccgaacaacaacaccugcucaucaccgcccccucaucaagcuccuccucacucgaaucauccgccuccgcccucgaucgacgcgcccccacacgcaaccaaccacaagccccaggcguagaagcguccggcgccggcgaagcccgcgccuccaccggcucguccgacuccucaccaggaggucacggcacccaaguaaaugucaccugcaucgugaacguuuguuccuccucagaucacagcucccaaugcucuucccaagccuccuccacaaugggcgacaccgauuccagccccucagaaucccccaaagacgaacaagucccauucucaaaagaagagugugccuuccgaucccagcucgaaacaccagaaacccuacucgguucaaccgaagaaaaaccccucccccucggcgucccagacgcaggcaugaaacccuccuaa

SEQ ID NO: 1175 - RNA, 513 nt, Artificial Sequence
  derived and/or modified CDS sequence (opt11) from Homo sapiens__NP_002623.2__HsPGF
augccggucaugcgccuguucccgugcuuucuccagcuacuggccgggcucgcgcucccggccgugcccccgcaacaaugggcgcucucggccggaaacgggagcucggaaguggaaguggucccguuccaggaagugugggggcgcucguacugucgagcgcucgagcgcuuggucgaugucgugagcgaguacccgagcgaggucgagcacauguucucgcccucgugcgugagcuugcuaaggugcacgggauguugcggggacgagaacuugcacuguguaccggucgagaccgcgaacgugaccaugcaauugcucaagaucaggagcggggacaggcccucguacguggaauugaccuuuagccagcacgugcgcugugaaugucgcccgcucagggaaaagaugaagccagagcgcaggcgcccgaaagggcgagggaaaaggcgcagggaaaagcaaagacccacggacugucacuugugcggggacgcggucccgaggcgcuga

SEQ ID NO: 1176 - RNA, 1239 nt, Artificial Sequence
  derived and/or modified CDS sequence (opt11) from Homo sapiens__NP_001020537.2__HsVEGFA
augaccgauagacagaccgacacagcgcccucacccucguaccaucucuugccggggaggaggagaacgguagacgcggcggcaucgcgcgggcaagggccggaaccagcgccagggggaggagucgaaggagugggagcgagaggggucgcgcuaaaacucuucguccaacugcugggaugcagcagguucgggggagcagugguaagagcaggagaggcagagccaucgggcgcggcaaggagcgcaagcucgggaagggaggaaccacagccagaagaaggggaagaggaagaggaaaaggaagaagaaaggggaccacaauggagacuaggcgcgagaaagccagggagcuggacaggggaggcggccgugugcgcggacucggcaccagccgcaagagcgccgcaggcacuagcaagggccucgggaaggggaggaaggguggcaagacgaggagccgaggaaucaggaccaccacacagcccaagcaggcgagggagcgcgagcagggcagggcccgggagagcaagcgagacaaugaacuuucucuugagcuggguacauuggucgcuagcgcuccuacuguaucugcaccacgcgaaauggagccaggcagcgccaauggcagagggaggagggcagaaccaccacgaagucgugaaauucauggauguauaccaaaggagcuacugccacccaauagaaacgcuaguagacauauuccaggaauauccagaugaaauugaauacauauucaaaccgagcugcguaccacucaugagguguggcggaugcuguaacgaugaagggcuagagugcgugccaacagaagagagcaacauaacaaugcaaauaaugcgaauaaaaccacaccaaggacagcacauaggagagaugagcuuccuacaacacaacaagugcgagugcaggccaaagaaagacagagcgcgccaagaaaagaaaagcguaaggggaaaggggaagggacagaaaaggaaaaggaaaaagaguagauacaaaaguuggagcguauacguaggagcgagaugcugcuugaugccguggucacuaccgggaccacacccgugugggcccugcagcgagagacgaaaacaccuauucgugcaggacccgcagacgugcaagugcucguguaagaacacggacucgaggugcaaagcgagacagcuagagcugaaugaaaggaccugccgaugugacaagcccagaagguag

SEQ ID NO: 1177 - RNA, 699 nt, Artificial Sequence
  derived and/or modified CDS sequence (opt11) from Homo sapiens__NP_001165094.1__HsVEGFA
augaacuuccuccuaagcuggguccacuggucccucgcccuacuccucuaccuacaccacgccaaauggucccaagccgcacccauggccgaaggcggcggccaaaaccaccacgaagucgucaaauucauggacgucuaccaacgcucauacugccaccccaucgaaacccucgucgacaucuuccaagaauaccccgacgaaauagaauacaucuucaaacccucaugcgucccccucaugcgcugcggcggcugcugcaacgacgaaggacucgaaugcguacccaccgaagaaucaaacaucacaaugcaaaucaugcgcaucaaaccccaccaaggccaacacaucggcgaaauguccuuccuccaacacaacaaaugcgaaugccgccccaaaaaagaccgagcacgacaagaaaaaaaauccguccgaggcaaaggcaaaggccaaaaacgaaaaagaaaaaaaucccgcuacaaauccugguccguauacgucggcgcccgaugcugccucaugccauggucccuccccggcccccacccaugcggccccugcuccgaacgccgcaaacaccucuucguccaagacccccaaaccugcaaaugcuccugcaaaaacaccgacuccagaugcaaagcccgccaacucgaacucaacgaacgcaccugccgcugcgacaaaccccgacgcuaa

SEQ ID NO: 1178 - RNA, 624 nt, Artificial Sequence
  derived and/or modified CDS sequence (opt11) from Homo sapiens__NP_003368.1__HsVEGFB
auguccccccuccuccgccgccuccuccucgcagcccuacuccaacuagcccccgcacaagcccccgucucccaacccgacgcccccggccaccaacgcaaaguagucuccuggauagacgucuacacccgcgccaccugccaaccccgcgaagucguagucccccucacagucgaacucaugggcacagucgccaaacaacucguacccucaugcgucaccguccaaagaugcggcggcugcugccccgacgacggccucgaaugcguccccaccggccaacaccaaguccgcaugcaaauacucaugauccgauacccaucaucccaacuaggagaaaugucacucgaagaacacucucaaugcgaaugcagacccaaaaaaaaagacucagccguaaaaccagaccgcgccgcaacaccccaccaccgcccccaaccacgaucaguccccggcugggacuccgcccccggcgcccccucccccgccgacaucacccaccccacccccgcccccggcccauccgcccacgccgcccccuccaccaccucugcccuaacccccggccccgccgccgccgccgcagacgccgccgccucauccgucgccaaaggcggcgccuaa

SEQ ID NO: 1179 - RNA, 1260 nt, Artificial Sequence
  derived and/or modified CDS sequence (opt11) from Homo sapiens__NP_005420.1__HsVEGFC
augcaccuccuaggcuucuucagcguugccugcucccuacuggccgccgcccuccucccuggcccccgcgaagcucccgcagccgcagcagccuuugaaucaggucucgaccuuagcgacgcagaacccgacgccggagaagcuaccgccuacgcgagcaaagaccucgaagaacaacugcgauccgucuccuccgucgacgaacucaugacuguacucuaccccgaauacuggaaaauguacaaaugccaacuccggaaaggaggcuggcaacacaacagagaacaagccaaccucaacucccgaaccgaagaaacuaucaaauucgccgcagcccacuacaacaccgaaauacucaaaucaaucgacaacgaauggagaaaaacccaaugcaugccccgagaagucugcaucgacgucggcaaagaguucggagucgccaccaacacauucuucaaaccaccuuguguauccgucuaccgaugcggagguugcugcaacuccgaaggccuacaaugcaugaacaccuccaccucauaccucucaaaaacacucuucgaaaucaccgucccccuaagccaaggcccgaaaccagucaccauuuccuucgcaaaccauacaucaugccgauguaugucaaaacucgacgucuaccgccaaguccacuccauaauccgacgcucacucccagccacccucccccaaugccaagcagcaaacaaaaccugcccaaccaacuacauguggaacaaccacaucugccgcugccucgcacaagaagacuucauguucagcuccgacgccggcgacgacuccaccgacggcuuccacgacaucugcggccccaacaaagaacucgacgaagaaacaugccaaugcguuugucgcgccggccuccgcccagccuccugcggaccacacaaagaacucgacagaaacuccugccaaugcguuugcaaaaacaaacuauucccaucccaaugcggagccaaccgcgaguucgacgaaaauaccugccaaugcguaugcaaacgaaccugcccccgaaaccaaccccuaaaccccggcaaaugcgcuugcgaaugcaccgaauccccgcaaaaaugccuccucaaaggaaagaaauuccaccaccaaaccugcuccugcuaccgccgacccugcaccaaccgucaaaaagcgugcgaacccggauucuccuacuccgaagaagucugccgcugcguccccagcuacuggaaacgcccccaaauguccuaa

SEQ ID NO: 1180 - RNA, 1065 nt, Artificial Sequence
  derived and/or modified CDS sequence (opt11) from Homo sapiens__NP_004460.1__HsVEGFD
auguaccgagaaugggucgucgucaacguauucaugaugcucuacguacaacucguccaaggcagcagcaacgaacacggccccgucaagagauccagccaaagcacccuagaacgauccgaacaacaaauacgcgcagccucaagccucgaagaguuacuacgaaucacccacucagaagacuggaagcucuggcgaugccgccuccgccucaaguccuucaccuccauggacagcagaucagccucccaccgcucaacccguuucgccgccaccuucuacgacaucgaaacccucaaagucaucgacgaggaauggcaacgaacacaaugcucucccagagaaaccugcguagaagucgccuccgaacuugguaaaucaaccaacacuuucuucaaaccacccugcgucaacgucuuccgcugcggaggcugcugcaacgaagagucccucauaugcaugaacacauccaccuccuacaucuccaaacaacucuucgaaauauccguaccccuaaccuccgucccagaacuuguacccgucaaagucgccaaccacaccggcugcaaaugccuccccacagcaccccgccaccccuacuccauaauccgccgaucgauacaaauaccggaagaagaccgcugcucacacucaaagaaacucugccccauagacaugcucugggacuccaacaaaugcaaaugcguccuccaggaagaaaacccccuagccggcacagaagaccacucccaccuccaagaaccagcccucugcggcccccauaugauguucgacgaagaccgcugcgaaugcguaugcaaaacccccugccccaaagaccucauccaacaccccaaaaacugcucaugcuucgaaugcaaagaaucacucgaaaccugcugccaaaaacacaaacucuuccaccccgacacaugcucaugcgaagaccgaugccccuuccacacccgccccugcgccuccggcaaaaccgccugcgccaaacacugccgauucccaaaagaaaaacgcgccgcccaaggcccccacucacgcaaaaauccauaa

SEQ ID NO: 1181 - RNA, 72 nt, Artificial Sequence; identical to SEQ ID NO: 696
  derived and/or modified CDS sequence (opt12) from Homo sapiens__AAA59606.1__signal peptide-HLA-A2-SP

SEQ ID NO: 1182 - RNA, 69 nt, Artificial Sequence
  derived and/or modified CDS sequence (opt12) from Homo sapiens__AAA61213.1__signal peptide-HsPLAT
auggaugcuaugaaaagagguuuauguuguguuuuauuauuauguggagcuguauuuguaucuccaucu

SEQ ID NO: 1183 - RNA, 81 nt, Artificial Sequence; identical to SEQ ID NO: 698
  derived and/or modified CDS sequence (opt12) from Homo sapiens__NP_000790.2__signal peptide-HsEPO

SEQ ID NO: 1184 - RNA, 54 nt, Artificial Sequence; identical to SEQ ID NO: 699
  derived and/or modified CDS sequence (opt12) from Homo sapiens__NP_000468.1__signal peptide-HsALB

SEQ ID NO: 1185 - RNA, 18 nt, Artificial Sequence
  derived and/or modified CDS sequence (opt12) from Artificial____cleavage site-Furin
aggagaagaaggaaaaga

SEQ ID NO: 1186 - RNA, 630 nt, Artificial Sequence
  derived and/or modified CDS sequence (opt12) from Homo sapiens__NP_061986.1__HsFGF21
auggauuccgacgaaaccggcuuugaacacucaggauuauggguaucaguauuagcaggacuacuacuaggagcaugccaagcacacccaauaccagacucaucaccauuauuacaauucggaggacaaguaagacaaagauaccuauacacagacgacgcucaacaaacagaagcacauuuagaaauaagagaagacggaacaguaggaggcgcagccgaccaaucaccagaaucuuuacuacaauuaaaagcacuaaaaccaggcguaauacaaauauuaggaguaaaaacaucaagauucuuaugccaaagaccagauggagcacuauacggaucacuacacuuugacccagaagcaugcucauucagagaauuacuauuagaagacggauauaacguauaccaaucagaagcacauggacuaccccuacaccuaccaggaaacaaaucaccacaucgagacccagccccaagaggccccgcaagauuccuaccacuaccaggacuaccaccagcacuaccagaaccaccaggaauauuagcaccacaaccaccagauguaggauccuccgacccauuaucaaugguaggaccaucacaaggaagaucuccaucauacgcaucauaa

SEQ ID NO: 1187 - RNA, 1410 nt, Artificial Sequence
  derived and/or modified CDS sequence (opt12) from Homo sapiens__NP_002412.1__HsMMP1
augcauucauucccaccucuauuacuacuauuauuuugggguguuguaucccacucauuuccagcuacauuagaaacacaagaacaagacguagaucuaguccaaaaauaucuagaaaaauacuacaaccuaaaaaacgacggacgccaaguagaaaaaagaagaaacaguggaccaguaguagaaaaacuaaaacaaaugcaagaauuuuuuggacuaaaagucacaggaaaaccugaugccgaaacuuuaaaaguaaugaaacaaccaagaugcggcguaccugacguagcacaauucgucuuaacagaaggaaacccaagaugggaacaaacgcacuuaacauaucgaaucgaaaauuacacaccagaccuaccaagagcagacguagaucacgcaauagaaaaagccuuccaacuauggucaaauguaacaccccuaacauucacaaaaguaucagaaggacaagcagauauaaugaucucauucguaagaggggaucacagagauaacucacccuucgauggcccaggaggaaaccuagcacacgcauuccaaccuggaccaggaauagguggugaugcacauuucgacgaagacgaaagauggacaaacaacuucagagaauauaaccuacacagaguagcagcucacgaacuaggucauucauuaggacuaagucauucaacagauauaggagcacuaauguacccaucauacacuuuuagcggagacguacaacuagcacaagacgacauagauggaauacaagcaauauacggaagaucacaaaaccccguacaaccaauaggaccacaaacaccaaaagcaugugacucaaaacucaccuucgacgcaauaacaaccauaagaggagaaguuauguucuuuaaagacagauucuacaugagaacaaaucccuuuuacccagaaguagaauuaaacuucaucucaguauuuuggccccaacuaccaaauggucuagaagcagccuacgaauuugcugauagagaugaaguaagauucuucaaaggaaacaaauauugggccguccaaggacaaaacguauuacacggauauccaaaagauaucuacuccucauucggcuuuccaagaacaguaaaacauauugaugcagcacuauccgaagaaaacacaggaaaaacauacuucuuuguagccaacaaauacuggagauaugaugaauacaaaagaucgauggacccaggauaccccaaaaugauagcacacgacuuuccaggaauaggacacaaaguagaugcaguauucaugaaagacggauucuucuacuucuuccacggcaccagacaauacaaauuugaccccaaaacaaaacgcauccuaacauuacaaaaagcaaauucaugguuuaacuguagaaaaaacuaa

SEQ ID NO: 1188 - RNA, 1170 nt, Artificial Sequence
  derived and/or modified CDS sequence (opt12) from Homo sapiens__NP_002412.1__HsMMP1(1-19,100-469)
augcacucauucccaccacuauuauuacuacuauucuggggaguaguaucacacuccuucguauuaacugaaggaaauccucgaugggaacaaacccaccucacauauagaauagaaaacuacacaccagaccuaccuagagcagacguagaccacgcaauagaaaaagccuuccaauuaugguccaacgucacaccauuaacuuucacuaaagucucagaaggacaagcagauauaaugauauccuuugucagaggagaucacagagacaacucaccauuugacggaccaggaggaaaucuagcacacgcauuccaacccggacccggaauagguggagacgcacacuucgaugaagaugaaagauggacaaacaauuucagagaauacaauuuacacagaguagcagcacacgaacucggacacuccuuaggacucucccauucaaccgacauaggagcauuaauguacccaucauacacauucucaggagacguccaacuagcacaagacgauaucgacggcauacaagcuauauacggaagaucacaaaacccaguacaaccaaucggaccacaaacaccaaaagccugugacucaaaauuaacuuuugaugcaaucacaacuauacgaggcgaaguaauguuuuucaaagacagauucuacaugagaacaaaccccuuuuacccugaaguagaacuaaacuucauaucuguuuucuggccacaacuaccaaacggauuagaagcagcauacgaauuugccgacagagacgaaguuagauucuucaaaggaaacaaauacugggcaguucaaggacaaaacgucuuacacggauauccaaaagauauauacuccucauucggauucccaagaaccguaaaacacaucgaugccgcauuaucagaagaaaauacaggcaaaacauacuucuuuguugcaaacaaauauuggagauacgacgaauacaaacgcucuauggacccaggcuauccaaaaaugauugcacacgauuucccaggaauaggacacaaaguagaugcaguauucaugaaagacggauucuuuuauuucuuccacggaacaagacaauacaaauucgauccaaaaacaaaaagaauccuaaccuuacaaaaagccaacucaugguucaauugcagaaaaaauuaa

SEQ ID NO: 1189 - RNA, 3357 nt, Artificial Sequence
  derived and/or modified CDS sequence (opt12) from Clostridium histolyticum__BAA77453.1__ColG
augaagaaaaacauacugaaaaucuuaauggacuccuacuccaaagaaucaaaaauccaaacaguaagacguguaacaucaguaucacuccuggcaguauaccuuacaaugaacacuucuuccuuaguauuagccaaaccaauagagaauacuaaugacacaucaaucaaaaauguagaaaaauuacgaaaugcacccaacgaagaaaacagcaagaaaguagaagauuccaaaaacgacaaaguagaacauguuaaaaacauagaagaagcuaaaguagaacaaguugcuccggaagugaaaucaaaaucaacguugagaagugcaaguauagcaaacaccaacuccgaaaaauaugacuucgaauacuuaaauggacuaucguacacagaauuaacaaauuuaauuaaaaacauaaaauggaaucaaauaaauggucuguucaacuauaguaccggcucccaaaaauucuucggagauaaaaaucguguucaagcuauaauaaaugcacuacaagaaucugguagaacauauaccgcuaacgauaugaaaggaauagagacuuuuacggaaguccuaagagccggauucuacuuaggauacuauaacgaugguuuaaguuauuuaaaugacagaaauuuucaagacaaaugcauaccggcaaugauagcaauacagaaaaacccuaacuuuaagcuaggaacagcuguccaagacgaaguaauuacaucacuagguaaacuuaucggaaaugcaagcgcaaacgcagaagucguaaauaauugugucccaguacuaaaacaauuuagagaaaauuuaaaccaauaugcuccagacuauguaaaaggaacagcaguaaaugaacuuauaaaagguauagaguucgacuucucaggagcagcauaugaaaaagacguaaaaacaaugccaugguauggaaaaaucgauccauuuauaaaugaauugaaggcauuaggccuauauggaaauauaaccagcgcgacagaaugggcaucagacgucggaauuuacuaccuuaguaaauucggacuauauagcacaaauagaaaugacauaguacaaagccucgaaaaagcgguagauauguacaaauauggaaaaauagcuuucguagccauggaacgaauaacaugggacuaugaugguauagguucaaacggaaagaaagucgaccacgauaaauuccuagacgaugcugaaaaacacuacuuaccaaaaaccuacacguucgauaauggaacuuuuauaauacgugcuggagacaaaguuucagaagagaaaaucaaaagauuauauugggcuucgcgagaaguaaaaucucaauuccaccgaguaguaggaaacgauaaagcauuagaaguuggaaaugcggacgauguauuaacaaugaaaauuuucaacucacccgaagaauauaaauuuaauacuaacauuaacgguguaagcacagauaacggagguuuauacauagaaccucgaggaacauuuuauacguaugaacgaacaccacaacaaagcauauuuucguuagaagaacuauuuagacaugaauauacacauuaccuacaagcacgauacuuaguagauggauuauggggucaaggacccuuuuacgaaaagaaucgccucacaugguucgaugaaggcaccgcugaguucuuugcuggcucgacgagaacaaguggagugcucccaagaaaaaguaucuuaggauaccuugcaaaagauaagguugaccaucguuauucacuaaagaaaacuuuaaauucagguuacgacgacagugauuggauguuuuacaauuacggauuugcaguagcacauuaucucuacgaaaaagacaugcccaccuuuauaaaaaugaauaaagcaauuuuaaacaccgauguaaaauccuacgaugaaauaauuaagaaacugagugaugacgccaacaaaaauaccgaauaucaaaaucacauccaagaauuagccgacaaauaccaaggagcagguauaccgcuagugagugaugacuaucucaaagaccacggcuauaagaaagcaucugaaguuuacuccgaaauuagcaaagcggcaucacucaccaauacuagcgucaccgcagaaaaaucccaauacuuuaauacauuuacucuucgaggcacauacacaggagaaacgagcaaaggagaauuuaaagacugggacgaaaugaguaagaaacucgauggaacauuagaaucauuagccaaaaacuccuggaguggcuacaaaacacuuacugcauacuucacaaauuauagaguaacaagugauaauaaaguacaauaugauguagucuuucacgguguauuaacagauaaugcagauauaucaaacaacaaagcaccaauagcaaaaguaacuggaccaucaacaggggcugucgggagaaauauugaguucucaggcaaagauucaaaagacgaagaugguaaaauuguuucguacgauugggauuuuggcgacggagcaacaagucgugguaaaaacaguguacaugccuacaagaaagccggaaccuacaauguaacauuaaaaguaaccgacgacaaaggagcaaccgccacagaaaguuuuacuauagaaauuaaaaaugaagacacaacaacccccauaacuaaagaaauggaaccaaacgacgacauaaaagaagcaaauggaccgaucguagaaggaguuaccguuaaaggagacuuaaacggcucagaugacgcagauacuuuuuacuucgaugucaaagaagacggagaugucacaauagaauuacccuacaguggaucuucaaacuuuaccuggcuagucuauaaagaaggagaugaccaaaaucauauagcaagcggaauagauaaaaacaacagcaaaguaggcacauucaaaaguacaaaaggcaggcauuacguauuuauauacaaacacgauucugccucaaacauuucuuacaguuuaaauauuaaaggucuaggaaaugaaaaacuaaaagaaaaagaaaacaacgacucaucugacaaagcaacaguaauaccuaacuucaacacaacaaugcaaggaucauuacuaggagaugacaguagagauuacuauucauuugaaguaaaagaagaaggugaaguaaauaucgagcuagauaagaaagacgaauuuggagugacauggacccuucacccagaaucaaauauaaacgaucgaauaacauauggacaagucgauggcaacaaaguaucaaauaaaguuaaauuaagaccaggaaaauauuaucuccuuguauacaaguauucaggcaguggaaacuaugaauugagaguaaacaaauga

SEQ ID NO: 1190 - RNA, 3081 nt, Artificial Sequence
  derived and/or modified CDS sequence (opt12) from Clostridium histolyticum__BAA77453.1__HsALB(1-18)_ColG(111-1118)
augaaaugggucacauuuauuucacuacuguuuuuauucucaucagcauauaguauagcaaauacaaacagugaaaaauacgauuucgaauaucucaacggauugucauauacagaacuuaccaaccuuauuaaaaauauaaaauggaaccaaauaaauggucuauuuaauuacaguacggguucgcagaaauucuuuggagauaaaaaccguguacaggccauaauaaacgcacuacaggaauccggacgcaccuauacggcuaaugauaugaaaggaauagaaacuuuuacugaaguacuaagagccggauuuuaucucggauauuacaaugauggauugaguuaccuaaacgauaggaacuuucaagacaaauguauuccagcaaugauagcaauacagaaaaaccccaacuucaaauuaggcacagccguacaagacgaaguuauaacuucauuaggaaaauuaaucgguaacgcaagcgcaaacgccgaaguaguaaauaauuguguaccaguacuaaaacaauucagagaaaaccucaaccaauacgcacccgauuacguaaaagggacagcaguaaaugaauuaauaaaagguaucgaauuugacuucuccggagcagcuuaugaaaaagacguuaaaacuaugcccugguacggaaaaauagauccuuuuauaaaugaacucaaagcauuaggacucuaugggaauauaacaucggcuacugaaugggccagcgacguaggaauauauuauuuaucaaaauuugggcuauacucaacgaacaggaaugauauaguacaaucgcuagaaaaagccguagacauguauaaauaugguaaaauugcauucgucgcaauggaaagaauuacaugggauuaugacggaauaggguccaacggcaagaaaguagaucacgauaaauuuuuagacgacgcugaaaaacauuauuuaccaaaaacauauacuuuugacaacgguacauucaucauuagggcaggagauaaaguuuccgaagagaaaauaaaaagauuauacugggcaagucgagaaguaaaaucacaauuccacagaguaguaggcaacgauaaagccuuagaagucgguaaugcugacgauguauuaaccaugaaaauauucaacaguccugaagaauacaaauuuaauaccaauauaaauggaguaaguaccgauaauggcggacuauacauagaaccucgaggaaccuucuacacguacgaacgaacuccgcaacaaucaauauuuagucuagaagaacuauuucggcaugaauauacgcacuacuuacaagcuagauaucuuguagacggauuaugggggcaaggacccuucuaugaaaagaaucgauuaacaugguuugacgaaggaacugcugaauuuuucgcagguucaacaagaacgucaggaguacuaccaaggaaaaguauacuaggcuaccuugcaaaagauaaaguugaucaucgauauucacuaaagaaaacacuaaauagugguuaugacgacucagauuggauguucuauaacuaugguuuugcaguggcacauuaucuauaugaaaaagauaugccaaccuucauaaaaaugaacaaagccauauuaaauacugacgucaaaucauacgacgaaauaauuaagaaauuaucagacgaugcaaacaaaaauacagaauaucaaaaccauauacaagaauuagcagauaaauaucaaggugcagguauuccauuaguaucggaugauuauuuaaaagaucauggauacaagaaagccagcgaaguauacucugaaauuagcaaagcagcgucacucacgaauacaucuguuacugcagaaaaaucacaauauuuuaauacauuuacacugcguggaaccuauaccggagaaacaucaaaaggugaauuuaaagacugggacgaaaugucaaagaaacuagauggaacccucgaaaguuuagccaaaaauucauggaguggauauaaaacucuuacugcauacuucacuaauuacagaguaacaucagacaacaaaguacaauacgacguaguauuucauggcgucuugacagauaaugccgacauuucaaauaacaaagccccaauagcuaaagugacaggaccaucaacaggcgcagucggaagaaauauugaguucucagggaaagauaguaaagacgaagauggaaaaauaguuagcuaugacugggacuucggagauggagcaacaucucgagguaaaaacuccguacacgcauauaagaaagcuggaaccuauaacguuacauuaaaaguaacugaugauaaaggagcaacugcaacagaaaguuuuacuauagaaaucaaaaacgaagauaccacaacaccaauaacaaaagaaauggaaccaaacgacgacauaaaagaagcgaauggacccauaguagaaggagucacuguuaaaggagacuuaaaugggagcgacgaugccgacacuuuuuauuucgacguuaaagaagauggagacguaacuauagaauuacccuacucuggaaguaguaauuuuaccuggcuaguauacaaagaaggcgaugaucaaaaccauauagcgucaggaauagauaaaaauaauucaaaagugggcacuuucaaaagcacaaaaggaagacauuacguauucauuuauaaacacgauucagcaucaaacauaucauacucgcuuaauauaaaaggacuaggaaacgaaaaacuuaaagaaaaagaaaacaaugacucaucagacaaagccacaguaauuccaaauuuuaacacuacuaugcaaggaagccuuuuaggagaugauaguagagauuauuauucauucgaaguaaaagaagaaggagaaguuaauaucgaacuagauaagaaagaugaguucgguguaacguggacauuacacccugaauccaauauuaacgacagaaucaccuauggacaaguugacggaaauaaagucagcaacaaaguuaaauuaagacccggaaaauauuaccuccuaguuuauaaauauagcggaucaggaaacuacgaauuacgaguaaauaaauga

SEQ ID NO: 1191 - RNA, 3429 nt, Artificial Sequence
  derived and/or modified CDS sequence (opt12) from Clostridium histolyticum__BAA77453.1__HsALB(1-18)_ColG(1-110)_CS-F_ColG(111-1 118)
augaaauggguaacauucauaucauuacuuuuccuauuuucaucagcauacaguaugaagaaaaauauauuaaaaauauuaauggacagcuauagcaaagaaucaaaaauacaaacaguuagaagaguaacuagcguuagcuuauuagccguauacuuaacaaugaauacaaguagccuaguauuagcaaaaccgauagaaaauacaaacgacacgagcaucaaaaacguugaaaaacuaagaaaugcccccaacgaagaaaacaguaagaaagucgaagacaguaaaaaugauaaaguagaacaugugaaaaacauagaagaagccaaaguagaacaaguagccccugaaguuaaaagcaaaucaacgcuacgcagcgccaguaggagaagaagaaaaagaauagcaaauacuaacucagaaaaauaugacuucgaauacuuaaauggacuaaguuacacagaacuuaccaaucuuaucaaaaacauaaaauggaaucaaauaaauggacuauucaauuauuccacugggucacaaaaauuuuucggagauaaaaauagagugcaggcuauaauuaacgcacuacaagaaucaggaagaaccuacacagcaaacgauaugaaagggauagaaacuuucacugaaguacugcgagcgggauucuauuugggguacuauaacgacgguuuaucauacuuaaacgacagaaauuuucaagacaaauguauaccagcaaugauagcaauacagaaaaauccuaauuuuaaacuagggaccgcaguacaagacgaagugauaacaucacucgguaaacucauaggaaaugcuucagcuaaugcggaaguaguaaauaauugcguaccaguuuuaaaacaauucagagaaaaccucaaccaauaugcacccgacuauguaaaaggaacugcaguuaacgaacuuaucaaaggaaucgaauuugauuuuagcggagccgcguacgaaaaagacgugaaaacaaugccuugguauggaaaaauagacccauucauuaacgaauuaaaagccuuaggccuguacgguaauauaacuucagccacagaaugggcaagugacguuggcauauacuauuugucgaaauuuggauuguauucaacaaaccguaacgacauaguucaaagccuggaaaaagcaguagauauguacaaauauggaaaaauagccuuuguagcaauggaaaggauuacaugggauuaugacggaauaggcucaaaugguaagaaaguagaucaugauaaguuucuagacgaugcagaaaaacacuaucuuccaaagacauacaccuucgacaauggaacuuuuauuauaagggcaggcgacaaaguauccgaagagaaaauaaaacguuuauacugggcaucacgggaaguaaaaagccaauuucauagaguaguaggaaacgacaaagcauuagaaguaggaaacgcagaugacguacucacaaugaaaauauucaauucuccugaagaauauaaauucaauacaaauauaaauggagucaguacagacaauggaggacuauacauagaaccuagagggacauuuuauacuuacgaaagaacaccccaacaauccauauuuucccuagaagaauuguuccgacaugaauacacacauuauuuacaagcccgauacuuaguagacggauuauggggacaagguccauucuacgagaaaaacagauugacaugguucgacgaaggaacagcagaauuuuucgccggaucaacuagaaccuccgguguauuaccaagaaaauccauccuuggguacuuagcaaaagauaaaguagaucaucguuauucguuaaagaaaacauuaaauagcggcuacgaugauucagauuggauguuuuauaauuauggcuuugcuguagcacauuaucuauacgaaaaagauaugccaacuuucaucaaaaugaacaaagcgaucuuaaauacagacguuaaaucauaugacgaaaucauaaagaaauuaucagaugaugcaaauaaaaacacagaauaucaaaaccacauacaagaacuagcugauaaauaucagggugcaggaaucccacucguaucggacgauuaccuaaaagaccauggauauaagaaagcaagcgaaguauacucagaaauuaguaaagcugcaucucuuacaaauacaagcguaacggcagagaaaagccaauauuucaacacguucacacuacgcggaacauauacuggagaaacaaguaaaggagaguucaaagauugggacgaaaugucaaagaaauuagaugguacuuuagaaucauuagccaaaaauagcugguccggguacaaaacacuuaccgcauacuuuacaaauuauagagucacaagcgauaauaaaguucaauacgaugucgucuuucacggaguacuaacagacaacgcggauauaagcaauaauaaagcaccaauagcaaaaguaacaggaccaucaaccggagcuguuggaagaaacauugaguucucaggaaaagacucaaaagacgaagauggcaaaauaguaagcuaugauugggauuuuggagacggcgcaacauccagaggcaaaaauagcguccaugccuauaagaaagcaggaacauacaacguaacauuaaaaguaacagacgacaaaggagccaccgccacugaaaguuuuacuaucgaaaucaaaaaugaagauacaaccaccccaauaaccaaagaaauggaaccuaaugaugacauaaaagaagcuaaugggccaauuguagaaggagucacagucaaaggcgacuuaaacgggagcgacgacgcugauaccuucuacuuugacguaaaagaagauggagauguaacaauagaacuaccauauucagguucauccaauuuuacauggcuaguguacaaagaaggugacgaccaaaaccauauagccaguggaauugacaaaaacaauucuaaaguggggacuuuuaaaagcacaaaagguagacauuauguauuuauauacaaacaugauagugcaagcaacauaucauacucucuaaauaucaaaggcuuaggaaacgaaaagcuaaaggaaaaggaaaauaacgauuccucagauaaagcaacugugaucccaaauuucaacacuacuaugcaaggcagccuucucggugaugauagccgagauuacuacuccuuugaagucaaagaagaaggugaagucaacauagaauuggauaagaaagaugaguucggcgucacauggacacugcauccagaaucaaacauaaacgauagaaucaccuacggacaagucgacggaaauaaaguaagcaauaaagucaaauuaagaccaggaaaauacuaccuucuaguauauaaauacucuggaaguggaaauuacgaauuacgaguuaauaaauaa

SEQ ID NO: 1192 - RNA, 3105 nt, Artificial Sequence
  derived and/or modified CDS sequence (opt12) from Clostridium histolyticum__BAA34542.1__ColH
augaacuuuuugaagauaauacuaaauagaggaaaaacaaugaaaagaaaaugccuauccaaacgauuaaugcuggccauaacuauggcaacaauauuuacaguaaacaguacauuaccuauauaugcagcuguagauaaaaacaacgcuacagcugccguccagaacgaaucuaaaagguacaccguaucuuaucuaaaaacucuaaacuacuaugacuuaguagauuugcuaguaaaaacagaaauagagaaucuaccagacuuauuucaauauucaagcgaugccaaagaguucuauggaaauaaaaccagaaugaguuuuauaauggaugaaauagguagacgagcaccacaauacacagaaaucgaccauaagggaauaccgacacuuguagaagugguaagagcaggauucuauuuaggauuccauaauaaagaauuaaacgagauaaacaaacgauccuuuaaagaaagagucauaccaagcauauuagcaauccagaaaaauccaaauuucaagcuaggaacagaaguacaagauaaaauuguaagcgcaacaggauuacucgcagggaacgaaacagcacccccagaagucgugaacaacuucaccccaauacuccaagacuguaucaaaaauauagauagauacgcacuagaugaccuaaaaaguaaagcccuuuucaacguacuugcagcaccaaccuaugauauaacugaauaccuacgagcaacaaaagagaaaccagaaaacacacccugguacgggaaaauagacggcuuuauaaaugaguuaaagaaauuagccuuauaugguaaaauaaaugauaauaauucauggauaauagacaacggcauuuaucauaucgcaccucugggaaaauuacacaguaauaacaaaauagguauugaaacacuaacagaaguaaugaaaguuuauccauaucuaagcaugcaacaccuccaaucagcagaucaaauaaaacgacacuacgacucuaaggacgcagaagggaacaaaauaccacuagacaaauucaagaaagaaggaaaagaaaaauacugcccaaaaacauauacauucgacgauggcaaaguaauuaucaaagcuggcgcaaggguagaggaagaaaaaguaaaacgucuauauugggcuucaaaagaaguaaauucacaauucuuucgaguuuacggaauugauaaaccauuagaagaaggaaacccagaugacauucuaacuaugguuauauauaauucaccagaagaauauaaacuaaacucaguauuauacggauaugauaccaacaacggugggauguacauagaacccgaaggaacauucuuuacuuaugaacgcgaagcacaagaaagcacuuacacguuagaagaacuauuccgacacgaauauacacauuacuuacaaggacgcuaugcaguuccaggacaauggggacgaacaaaauuauaugauaacgacagacuaacaugguacgaagaaggaggagcagaauuauuugcugguaguacucgaacaaguggaauacuacccagaaaaagcauuguaagcaacauacauaauacaacacgcaacaacagauauaaacuaucagauacuguacauuccaaauauggcgccagcuuugaguucuacaacuacgcaugcauguucauggacuacauguacaauaaagacauggguauacucaacaaacuaaacgaucucgccaaaaauaacgacguugacggauaugauaauuacauuagagaccucaguucaaauuaugcauuaaaugacaaauaccaagaucacaugcaagaaagaauagauaacuaugaaaacuuaacaguaccauucguugcagacgauuacuuaguaagacacgcauauaaaaacccuaacgaaauauauucggaaauuucagaaguugcaaaauuaaaagaugcaaaaucugaaguaaagaaaagucaauauuuuucgaccuucacauuacguggaagcuauacaggaggugcauccaaaggaaaacucgaagaucaaaaagcaaugaacaaauuuauagacgacucuuuaaagaaacuagacacauauucguggagcggguacaaaacauuaacggcauacuucacgaauuauaaaguugacaguucaaauagagucacauaugauguagucuuucacggauaccuaccuaacgaaggagacaguaaaaauagucuccccuaugggaaaauaaauggcacauacaaagguaccgagaaagagaaaauaaaauuuuccucggaaggcucauucgacccugauggaaaaauaguaucauacgaaugggacuucggagauggaaauaaaaguaacgaagaaaauccagaacacucauacgauaaaguagggaccuauaccguaaaacucaaaguaacagaugacaaaggcgaaagcucaguuucaacaacaacugcagaaauuaaagauuuaucagaaaauaaauuaccaguaauauauaugcauguaccaaaaaguggggcacuaaaucaaaaaguaguguucuaugggaaaggaacauaugauccagacggaucaauugcagguuaccaaugggauuuuggagaugguucagauuucucaagugaacaaaauccaucccacguuuauacaaagaaaggagaauacacaguaacuuuacgaguaauggacaguucagggcaaaugucggagaaaacaaugaaaauuaaaauaacagauccaguauacccaauaggaacagaaaaagaaccuaauaauucaaaagaaacugcaucagggccaauaguacccggaauacccguauccgguacuauagaaaacacaucagaucaagacuacuucuauuuugauguuauaacgccaggagaaguaaaaauagauaucaacaagcuaggauauggaggagcaacguggguaguguaugaugaaaauaauaacgcaguuucauaugcaacugacgauggacaaaaccucuccggaaaauucaaagcagauaaaccaggaagguauuacauacaccuguacauguucaauggcucuuauaugccguaucguauaaauaucgaagggucaguaggaagauaa

SEQ ID NO: 1193 - RNA, 3066 nt, Artificial Sequence
  derived and/or modified CDS sequence (opt12) from Clostridium histolyticum__BAA34542.1__ColH
augaaacgaaaaugcuuaucaaaaagauuaauguuagcaauaacaauggccacuauauucacugucaauucaacccuuccaauauacgccgcaguagacaagaacaaugcuacagcagcaguacaaaaugaaaguaagagauacacaguaucguaucuaaaaacucuaaacuauuaugaccucguggaccugcuaguaaaaacagaaauagaaaauuuaccugauuuauuccaguauucaucagaugcaaaagaguucuauggcaauaagacaagaauguccuucauaauggaugaaauaggcagacgagcaccacaauacacugaaauugaccacaagggaauaccaacccuagucgaaguagucagagcaggauucuaccuaggcuuccauaauaaggaacuaaacgaaauaaacaaaagaaguuucaaagaaagagugauaccaucaauauuagcaauacagaaaaaucccaacuuuaaacuuggaacagaaguacaagacaaaauugugagcgcaaccggauuacuagcagggaacgaaacagcaccucccgaaguagugaauaauuuuacgccaauauuacaagauugcauuaaaaacauagacagauaugcacuagaugauuuaaaaucuaaagcauuauuuaacguacuagcagcucccacauaugauauaacagaauaccucagagccaccaaagaaaaaccugaaaauacaccaugguauggaaaaaucgacggcuuuaucaaugaacuuaaaaagcuagcacuauauggaaaaaucaacgauaacaacucauggaucauagauaauggaauauaccauauagcacccuuaggcaaacuucacucaaacaauaaaaucggcauagaaacauuaacggaaguaaugaaaguauacccuuaucuaucuaugcaacauuuacaaucagcagaucaaauaaaacgccacuacgauaguaaagaugcagaaggaaacaaaauaccccucgacaaguucaagaaagaaggaaaagaaaaauauuguccaaaaacauauacguucgacgauggaaaaguaauaauaaaagcaggagcaagaguagaagaggaaaaaguaaaaagauuauacugggcgucaaaagaaguaaacucacaauucuucagaguuuauggaauagacaaaccauuagaggaaggaaaucccgaugacauucuuaccauggugaucuacaacaguccugaagaauauaaacuaaauucuguccucuacggauaugauacaaacaacggaggcauguauaucgaaccagaaggaaccuuuuucacauaugagagagaagcucaagaaucaaccuacacccucgaggaacuauucagacacgaauauacgcacuaucuacaaggcagguacgcaguacccggacaauggggccguacaaaacuauaugacaacgacagacuaacuugguacgaagaaggaggggcugaauuauuugccggaucaacaagaaccucagggauucuuccacgaaaaucgauaguuucgaauauacacaauacaaccagaaacaauagauauaaauuaucagauacagugcauuccaaauauggggcuucauucgaguuuuacaauuaugcuugcauguucauggauuauauguauaacaaagacaugggaauacucaacaaacuaaaugaccucgcuaaaaacaaugacguagauggauacgacaauuacauacgcgauuuaagcuccaacuaugcauuaaacgacaaauaucaagaucauaugcaagaaagaauagauaauuaugagaaucuaacaguaccguucgucgcagaugauuacuuagugcggcacgcauauaaaaacccuaaugaaauuuauagcgaaauaagugaaguugcaaaauuaaaagacgcaaaaagugaaguaaagaaaucacaauacuuuagcacauucacauuaagaggaaguuauacuggaggagccuccaaagguaaacuagaagaccaaaaagcuaugaacaaauuuauagaugauagucuuaagaaacuugacaccuauucauggaguggauauaaaacauuaacagcuuauuucacuaacuauaaaguagauucaucaaaucgcguaacuuaugaugucguuuuccacgguuauuuacccaacgaaggagacaguaaaaacucacuaccauacgguaaaauaaauggcacuuacaaaggaacagaaaaagagaaaauaaaauucaguucugaaggaucauucgacccagauggaaaaauagugagcuaugaaugggacuucggagaugguaauaaaagcaaugaagaaaauccagaacacaguuaugacaaaguagguacauacacuguuaaauuaaaagucacagacgauaaaggcgaaaguucaguaucaacaacaacagccgaaauaaaagaucuaagcgaaaacaaacuacccgucauauauaugcacguaccuaaaaguggagcccuuaaccaaaaagugguauucuacggaaaaggaacauacgacccugacggaagcauagcaggauaucaaugggacuucggugacgguucggacuucucuucugaacaaaauccaagccacguauacacaaagaaaggagaauacaccguaacacuuagaguuauggacagcucaggacaaaugucagagaaaacaaugaaaaucaaaauuaccgacccuguauauccaauaggaacugaaaaagaaccaaauaacaguaaagaaacagcuaguggaccgaucguuccagguauuccuguaaguggaacaaucgaaaacacaucagaccaggacuauuuuuauuucgauguaauaacaccaggagaagucaaaaucgauauaaauaaacuaggauauggaggggcuacauggguaguauacgaugaaaacaacaaugcaguauccuacgcgacagaugacggacagaaccuuucaggaaaauucaaagcggacaaaccaggcagguacuacauacaccuauacauguucaacggauccuauaugccuuaucgaauuaauauagaaggauccguaggccguuaa

SEQ ID NO: 1194 - RNA, 3000 nt, Artificial Sequence
  derived and/or modified CDS sequence (opt12) from Clostridium histolyticum__BAA34542.1__HsALB(1-18)_ColH(41-1021)
augaaaugggugacauucauaucucuacuuuuccuauucuccucagcauacucaguacaaaacgaaucaaaaagauacacagugaguuacuuaaaaacguuaaacuacuaugaccuaguagaccuucuaguaaaaaccgaaauagaaaaucuaccagaccuauuccaauacucuucagaugccaaagaauuuuauggaaauaaaaccagaaugaguuucaucauggaugaaaucggaaggagagcaccacaauacacggaaauagaucacaaagguauacccacuuuaguagaagucguaagagcaggauucuacuuaggauuccauaacaaagaacucaaugaaauuaauaaaagaucuuucaaagaaaggguaauacccagcauacucgccauacagaaaaaccccaacuucaaacuaggaacagaaguacaagauaaaauaguaucagcaacugguuuacucgcuggaaaugaaaccgcaccaccagaaguaguaaacaacuucaccccuauucuacaagacugcauuaaaaauauagacagauacgcccuagacgacuuaaaaucgaaggcccucuuuaacguacuagccgccccaacauaugauauaacagaauacuuaagagcaaccaaagaaaaaccagaaaauacacccugguacggaaaaauagacggauuuauaaaugaauuaaagaaauuagcguuauaugggaaaauaaacgacaauaauaguuggauaauagacaacggaauauaccacauagcaccauuaggcaaacuacacuccaauaacaaaauagggauagaaaccuuaacagaaguaaugaaaguauauccauaucuaucaaugcaacauuugcaaucagcagaccaaauaaaacgacauuaugauaguaaagacgcagaaggaaauaaaauaccacuagauaaauucaagaaagaaggaaaagaaaaauauuguccaaaaacauacacauucgaugacggaaaaguaauaauuaaagccggugcccggguagaagaagaaaaaguaaaacgacuguauugggcuucuaaagaagucaauucacaauucuuuaggguauacggaauugauaaaccucuagaagaagguaacccagacgacauccuaacaauggucauauacaauagcccggaagaauacaaauuaaacucgguauuauacggguaugacacaaauaacggcggcauguacauugaacccgaaggaacguucuucacauaugaaagagaagcacaagaaucaacauacacacucgaagaacuauuuagacacgaauauacacauuauuuacaagggagauacgccguacccggacaauggggucgaaccaaacuuuacgacaacgacaggcuaacaugguacgaagaagggggagcagaauuauucgcaggaucaacaagaaccucaggaauacuaccuagaaaaaguauaguaucaaauauacauaauacaaccaggaauaacagauauaaauuaagugacacaguccauucaaaauauggagccuccuuugaguucuauaacuacgcauguauguucauggauuacauguacaacaaagauaugggaauccuaaacaaacuaaacgaccuagcuaaaaauaacgauguugacggauacgauaacuacauaagagaccucagcucaaacuaugcacuuaacgacaaauaucaagaucauaugcaagaaagaauagacaacuacgaaaaucucacaguaccauucguagcagacgauuauuuaguaagacacgcauacaagaacccuaacgaaaucuauuccgaaauuagcgaaguagcgaaacuuaaagacgcaaaaagugaaguaaagaaaagucaauacuucagcacauucacacuacgaggauccuacacaggcggcgcaagcaaaggcaaacuagaagaucaaaaagcaaugaacaaauucauagacgauucacucaagaaauuagauacauauagcuggaguggauacaaaacacuaacugcauauuucacaaacuacaaaguugacagcucaaauagagucacauaugauguaguauuccacggauaucuacccaaugaaggugacagcaaaaacuccuuaccauacggaaaaauuaacgggacauacaaaggaacagaaaaagagaaaauaaaauucucauccgaagguagcuuugaccccgauggaaaaauuguaucauaugaaugggacuucggagacggaaauaaaucaaacgaagaaaauccugaacacagcuaugauaaaguuggcaccuauaccgugaaacuaaaagugacagaugacaaaggugaaucauccguauccacaacgacagcagaaauuaaagacuuaagcgaaaacaaacuaccaguaauauacaugcauguaccaaaauccggcgcauuaaaucaaaaagucguauuuuauggaaaagggacuuaugaccccgaugggucaaucgcaggcuaucaaugggacuucggcgauggcucagacuucucaucagaacagaacccaucucauguuuacacaaagaaaggagaauacacaguaacauuacgagucauggauucaucaggucaaaugucagagaaaacaaugaaaauaaaaauaacagauccgguuuacccaauaggaacagaaaaagaacccaacaauucaaaagaaacagcaaguggcccuauaguuccagguauuccuguaucagguacaaucgaaaacacaucagaccaggauuacuuuuacuucgacgugauuacgccaggagaaguuaaaaucgauauuaauaaauuaggauaugguggagccacguggguaguauacgaugaaaauaauaaugcaguaucauaugccacagaugacggacaaaaucuuucagggaaauuuaaagcugauaaaccaggaagauauuauauacaccuuuacauguucaacgguucauacaugccuuacagaauaaauauagaaggauccguagguagauaa

SEQ ID NO: 1195 - RNA, 3138 nt, Artificial Sequence
  derived and/or modified CDS sequence (opt12) from Clostridium histolyticum__BAA34542.1__HsALB(1-18)_ColH(1-40)_CS-F_ColH(41-102 1)
augaaaugggugacauucaucucacuauuauuucuauucaguagcgcauauucuaugaaacgaaaaugcuuauccaaaagacuaaugcuagcaauaacaauggcaacaaucuucaccguaaauucaacauuaccaaucuacgcagccguagauaaaaacaaugcaacagcagcucgaaggagaaggaaaaggguacaaaacgaaagcaaaagauauaccgucagcuaccuuaaaaccuuaaauuacuacgacuuaguagaucucuuaguaaaaacagaaauagaaaacuuacccgauuuguuucaauauucauccgacgcaaaagaguucuacggaaauaaaacaagaaugagcuucauaauggacgaaauaggucggagagcuccccaauauaccgaaauagaucauaaaggaauaccaaccuuaguagaaguaguaagagccggauuuuaccuuggcuuccauaacaaagaacuaaacgaaauaaacaaacgauccuucaaagagcgcguaauaccaaguauacuggccauccagaaaaacccaaacuuuaaauuaggaacggaaguucaagacaaaauaguaagugcaacagggcuccuagcaggaaacgaaacagcucccccugaaguuguaaauaacuucacaccaauacuucaagacuguauuaaaaacauagacagauacgcauuagacgaccuuaaaagcaaagcguuauuuaacguacuagcugcacccacuuaugacauaacugaauacuuaagagcaacaaaagaaaaaccagaaaacacaccuugguauggcaaaauagauggauuuauaaaugaacuaaagaaacuggcacuauauggcaaaaucaacgauaauaacaguuggauaauagacaacgguauauaucauauagcaccacuagguaaauugcauucaaacaauaaaauugguauagaaacguuaacagaggugaugaaaguauacccauaccuaucuaugcaacauuuacaaucagcggaucaaauuaaaaggcacuaugauucaaaagaugcggaagguaacaaaauaccacuagacaaauucaagaaagaaggaaaagaaaaauauugucccaaaacauacacauuugaugaugguaaaguaauaauaaaagcaggggcucgaguagaagaagaaaaaguuaaacgacuauacugggccucaaaagaagucaacucucaauuuuuccgcguauacggaaucgauaaaccauuagaagaagguaauccggaugauauauuaaccauggugaucuacaacucaccagaagaauacaaacuaaauucaguccuauauggauacgacacuaauaaugguggaauguacauagaaccagaaggcacauucuucacauacgaaagagaggcucaagaaucaacauacacacuagaagaauuauuccgacacgaauacacacauuacuuacaaggaagauacgcgguacccggacaauggggaagaacaaaacuauacgauaaugaucgacuuacaugguaugaagaaggaggagccgaacuauucgcaggauccacgcgcaccucagggauucuuccaagaaaaucaauaguaucaaauauacacaauacaacacgaaauaacagauauaaauuaucagacacaguacacuccaaauauggcgcaaguuucgaguucuacaauuacgcauguauguucauggauuacauguauaacaaagauauggggaucuuaaacaaacuaaacgauuuagcgaaaaacaaugacguagacggcuaugacaacuacauacgagacuuauccagcaauuacgcacuuaacgauaaauaccaagaucacaugcaagaaagaauagauaacuacgaaaaucuaacagucccauuugucgcagacgacuaccuggugagacacgcuuacaaaaauccaaaugaaauauacucagaaauaagcgaaguagcuaaacucaaagacgccaaaagugaaguuaagaaaagucaauacuuuucaacauucacccuccggggaucauauaccgggggagcaucuaaaggaaaauuagaagaccaaaaagccaugaauaaauuuauagaugacucccuaaagaaacuggacacuuacuccuggaguggguacaaaacuuuaacagcuuauuucaccaacuauaaaguagacagcagcaaucgagucacauaugacgucguguuucaugguuacuuaccaaacgaaggagacagcaaaaacucacuucccuaugguaaaauaaacgguacauacaaaggaacagaaaaagagaaaauuaaauucucuucugaaggaucauuugauccagauggaaaaaucgugaguuaugaaugggacuuuggagacggaaacaaaucuaacgaagaaaacccagaacacaguuaugauaaaguuggaaccuacacaguaaaacuaaaagugacugacgauaaaggagaaucaucagucaguacaacuacagccgaaauaaaagaucuaagcgaaaauaaacuccccguaauauauaugcacgucccaaaaucaggagccuuaaaucaaaaaguugucuuuuacgguaaaggaacauacgaucccgauggaucaaucgcaggauaucaaugggacuuuggagaugguagcgauuucuccagcgaacaaaaccccucacacguauauacaaagaaaggagaguauacaguaacauuaagagugauggauagcucgggacaaaugucagagaaaacaaugaaaauaaaaauuacggauccaguauaccccauaggaacagaaaaagaaccaaacaauuccaaagaaaccgcuagugguccaaucguacccggcauuccggugagcgguacuauagagaacacaucagaccaagauuacuuuuacuucgacgucauuacaccaggcgaaguaaaaauagauauaaauaaauuagguuacggaggugcaacuuggguaguauaugacgagaacaacaacgccgucucauacgcaaccgacgacggucaaaaucuaucaggaaaauucaaagcagacaaaccagguagauacuacauucaccuauacauguucaauggaaguuacaugccauacagaauaaacauagaaggauccguuggaagauaa

SEQ ID NO: 1196 - RNA, 576 nt, Artificial Sequence
  derived and/or modified CDS sequence (opt12) from Homo sapiens__NP_001133.1__HsAMELX
augggaacauggauacuuuucgcaugccuacucggagcagcauucgcaaugccacuaccaccacacccaggacacccaggauacauaaacuucucauacgaaguacuaacaccacuaaaaugguaccaaucaauaagaccaccauacccaucauacggauacgaaccaaugggaggaugguuacaccaccaaauaauaccaguacuaucacaacaacacccacccacacacacauuacaaccacaccaccacauaccaguaguaccagcacaacaaccaguaauaccacaacaaccaaugaugccaguaccaggacaacacuccaugacaccaauacaacaccaccaaccaaaccuaccaccaccagcacaacaaccauaccaaccccaaccaguacaaccacaaccacaccaaccaaugcaaccacaaccaccaguacacccaaugcaaccacuaccaccacaaccaccacuaccaccaauguucccaaugcaaccacuaccaccaaugcucccagaccuaacacuagaagccuggccaucaacagacaaaacaaaaagagaagaaguagacuaa

SEQ ID NO: 1197 - RNA, 135 nt, Artificial Sequence
  derived and/or modified CDS sequence (opt12) from Homo sapiens__NP_001133.1__HsAMELX-TRAP
augccucuaccuccacauccaggucacccuggauauauaaauuucucuuacgaaguacuuacaccucuaaaaugguaucaaucuauacguccaccuuacccuucauauggauaugaaccuauggguggaugguaa

SEQ ID NO: 1198 - RNA, 168 nt, Artificial Sequence; identical to SEQ ID NO: 713
  derived and/or modified CDS sequence (opt12) from Homo sapiens__NP_001133.1__HsAMELX-LRAP

SEQ ID NO: 1199 - RNA, 207 nt, Artificial Sequence; identical to SEQ ID NO: 714
  derived and/or modified CDS sequence (opt12) from Homo sapiens__NP_001133.1__HLA-A2-SP_HsAMELX(17-60)

SEQ ID NO: 1200 - RNA, 240 nt, Artificial Sequence
  derived and/or modified CDS sequence (opt12) from Homo sapiens__NP_001133.1__HLA-A2-SP_HsAMELX(17-47,168-191)
auggcaguaauggcaccaagaacacuaguacuacuacuaucaggagcacuagcacuaacacaaacaugggcaaugccacuaccaccacacccaggacacccaggauacauaaacuucucauacgaaguacuaacaccacuaaaaugguaccaaucaauaagaccaccaccaaugcuaccagaccuaacacuagaagcauggccaucaacagacaaaacaaaaagagaagaaguagacuaa

SEQ ID NO: 1201 - RNA, 579 nt, Artificial Sequence
  derived and/or modified CDS sequence (opt12) from Homo sapiens__NP_001134.1__HsAMELY
augggaacauggauccuauucgcuugccuaguaggagcagcauucgccaugccauuaccaccacacccaggacacccaggauacauaaacuucucauacgaaguacuaacaccacucaaaugguaccaaucaaugauaagaccaccauacucaucauacggauacgaaccaaugggaggauggcuacaccaccaaauaauaccaguaguaucacaacaacacccauuaacacacacacuacaaucacaccaccacauaccaguaguaccagcacaacaaccaagaguaagacaacaagcacucaugccaguacccggacaacaaucaaugacaccaacacaacaccaccaacccaaccuaccacuaccagcacaacaaccauuccaaccacaaccaguccaaccacaaccacaccaaccaaugcaaccacaaccaccuguacaaccaaugcaaccacuauuaccacaaccaccacucccacccauguucccacuaagaccacuaccaccaauacuaccagaccuacaccuagaagcauggccagcaacagacaaaacaaaacaagaagaagucgacuaa

SEQ ID NO: 1202 - RNA, 138 nt, Artificial Sequence; identical to SEQ ID NO: 717
  derived and/or modified CDS sequence (opt12) from Homo sapiens__NP_001134.1__HsAMELY-TRAP

SEQ ID NO: 1203 - RNA, 171 nt, Artificial Sequence
  derived and/or modified CDS sequence (opt12) from Homo sapiens__NP_001134.1__HsAMELY-LRAP
augccacuaccaccacacccaggacacccaggauacauaaacuucucauacgaaguacuaacaccacuaaaaugguaccaaucaaugauaagaccaccaccaauacuaccagaccuacaccuagaagcauggccagcaacagacaaaacaaaacaagaagaaguagacuaa

SEQ ID NO: 1204 - RNA, 210 nt, Artificial Sequence; identical to SEQ ID NO: 719
  derived and/or modified CDS sequence (opt12) from Homo sapiens__NP_001134.1__HLA-A2-SP_HsAMELY(17-61)

SEQ ID NO: 1205 - RNA, 243 nt, Artificial Sequence; identical to SEQ ID NO: 720
  derived and/or modified CDS sequence (opt12) from Homo sapiens__NP_001134.1__HLA-A2-SP_HsAMELY(17-48,169-192)

SEQ ID NO: 1206 - RNA, 570 nt, Artificial Sequence
  derived and/or modified CDS sequence (opt12) from Sus scrofa__NP_999071.1__SsAMELX-001-1
augggaaccuggauauuauucgcaugccuacuaggagcagcauucucaaugccacuaccaccacacccaggacacccaggauacauaaacuucuccuacgaaguauuaacaccacuaaaaugguaccaaaacaugauaagacaccccuacacaucauacggauacgaaccaaugggaggauggcuacaccaccaaauaauacccguaguaucacaacaaacaccacaaucacacgcacuacaaccccaccaccacauaccaaugguaccagcacaacaaccaggaauaccacaacaaccaaugaugccacuaccaggacaacacucaaugacaccaacacaacaccaucaaccaaaccuaccacuaccagcacaacaaccauuccaaccacaaccaguacaaccacaaccacaccaaccacuacaaccccaaucaccaaugcaccccauacaaccacuacuaccacaaccaccacuaccaccaauguucucaaugcaaucacuacuacccgaccuaccacuagaagcauggccagcaacagacaaaacaaaacgcgaagaaguagacuaa

SEQ ID NO: 1207 - RNA, 138 nt, Artificial Sequence; identical to SEQ ID NO: 722
  derived and/or modified CDS sequence (opt12) from Sus scrofa__NP_999071.1__SsAMELX-TRAP

SEQ ID NO: 1208 - RNA, 171 nt, Artificial Sequence; identical to SEQ ID NO: 723
  derived and/or modified CDS sequence (opt12) from Sus scrofa__NP_999071.1__SsAMELX-LRAP

SEQ ID NO: 1209 - RNA, 210 nt, Artificial Sequence; identical to SEQ ID NO: 724
  derived and/or modified CDS sequence (opt12) from Sus scrofa__NP_999071.1__HLA-A2-SP_SsAMEL(17-61)

SEQ ID NO: 1210 - RNA, 243 nt, Artificial Sequence; identical to SEQ ID NO: 725
  derived and/or modified CDS sequence (opt12) from Sus scrofa__NP_999071.1__HLA-A2-SP_SsAMEL(17-49,167-189)

SEQ ID NO: 1211 - RNA, 534 nt, Artificial Sequence
  derived and/or modified CDS sequence (opt12) from Sus scrofa__P45561-2__SsAMELX-001-2
augggaacauggauauuauucgcaugccuacuaggagcagccuucucaaugccacuaccaccacacccaggacacccaggauacauaaacuucucauacauaagacauccauacacaucauacggauaugaaccaaugggaggauggcuacaccaccaaauaauaccaguaguaucacaacaaaccccacaaucacacgcacuacaaccacaccaccacauaccaaugguaccagcacaacaaccaggaauaccacaacaaccaaugaugccauuaccaggacaacacuccaugacaccaacacaacaccaccaaccaaaccuaccacuaccagcacaacaaccauuccaaccacaaccaguacaaccacaaccacaccaaccacuacaaccacaaucaccaaugcacccaauacaaccacuacuaccccaaccaccacuaccaccaauguucucaaugcaaucacuacuaccagaccuaccacuagaagcauggccagccacagacaaaacaaaacgagaagaaguagacuaa

SEQ ID NO: 1212 - RNA, 570 nt, Artificial Sequence
  derived and/or modified CDS sequence (opt12) from Sus scrofa__NP_998965.1__SsAMELX-001-3
augggaacauggauauucuucgcaugcuuacuaggagcauccuuagcaaugccacuaccaccacacccaggccacccaggauacauaaacuucucauacgaaguacuaacaccacuaaaaugguaccaaaacaugauaagacacccauacacaucauacggcuacgaaccaaugggcggcuggcuacaccaccaaauuauaccaguaguaucacaacaaacaccacaaucacacgcacuacaaccccaccaccacauaccaaugguaccagcacaacaacccggaauaccacaacaaccaaugaugccacucccaggacaacacucaaugacaccaacacaacaccaccaaccaaaccucccacuaccagcacaacaaccauuccaaccccaaccaguacaaccacaaccacaccaaccacuacaaccacaaucaccuaugcacccaauacaaccauuacuaccccaaccaccacuaccaccaauguucucaaugcaaucacuacuaccagaccuaccacuagaagcauggccagcaacagacaaaacaaaaagagaagaagucgacuaa

SEQ ID NO: 1213 - RNA, 219 nt, Artificial Sequence; identical to SEQ ID NO: 728
  derived and/or modified CDS sequence (opt12) from Sus scrofa__K7GPB2__SsAMELX-002

SEQ ID NO: 1214 - RNA, 612 nt, Artificial Sequence
  derived and/or modified CDS sequence (opt12) from Sus scrofa__K7GLD0__SsAMELX-003
augggaacauggauacuauucgcaugccuacuaggcgcagcauucucaaugccacuaccaccacaccccggacacccaggcuacauaaacuucucauacgaagauuuauacuuagaagcaauaagaauagacagaacagcauuuguauuaacaccacuaaaaugguaccaaaacaugauaagacacccauacacaucauauggauacgaacccaugggaggauggcuacaccaccaaauaaucccaguaguaucacaacaaacaccacaaucacacgcccuacaaccacaccaccacauaccaaugguaccagcacaacaaccaggaauaccacaacaacccaugaugccacuaccaggacaacacucaaugacaccaacacaacaccaccaacccaaccuaccacuaccagcacaacaaccauuccaaccacaaccaguacaaccacaaccacaccaaccauuacaaccacaaucaccaaugcacccaauacaaccccuacuaccacaaccaccacuaccaccaauguucucaaugcaaucacuacuaccagaccuaccacuagaagccuggccagcaacagacaaaacaaaaagagaagaaguagacuaa

SEQ ID NO: 1215 - RNA, 498 nt, Artificial Sequence
  derived and/or modified CDS sequence (opt12) from Sus scrofa__K7GPE9__SsAMELX-004
augggaacauggauacuauucgcaugccuacuaggagcagcauucucaaugccacucccaccacacccaggacacccaggauacauaaacuucucauacgaaguacuaacaccacuaaaaugguaccaaaacaugauaagacacccaacaccacaaucacacgcacuccaaccacaccaccacauaccaaugguaccagcacaacaacccggaauaccacaacaaccaaugaugccacuaccaggacaacacuccaugacaccaacacaacaccaccaaccaaaccucccacuaccagcacaacaaccauuccaaccacaaccaguacaaccacaaccacaccaaccacuacaaccacaaucacccaugcacccaauacaaccacuacucccacaaccaccacuaccaccaauguucucaaugcaaucacuacuaccagaccucccacucgaagcauggccagcaacagacaaaacaaaaagagaagaaguagacuaa

SEQ ID NO: 1216 - RNA, 522 nt, Artificial Sequence
  derived and/or modified CDS sequence (opt12) from Sus scrofa__J9JIM4__SsAMELX-201
augccacucccaccacacccaggacacccaggauacauaaacuucucauacgaaguacucacaccccuaaaaugguaccaaaacaugauaagacaccccuacacaucauacggauacgaacccaugggaggauggcuacaccaccaaauaauaccaguagucucacaacaaacaccacaaucacacgcacuccaaccacaccaccacaucccaaugguaccagcacaacaaccaggaauaccacaacaaccaaugaugccacuaccaggacaacacucaaugacaccaacacaacaccaccaaccaaaccuaccacuacccgcccaacaaccauuccaaccccaaccaguacaaccacaaccacaccaaccacuccaaccacaaucaccaaugcacccaauacaaccacuacuaccacaaccaccacucccaccaauguucucaaugcaaucacuacucccagaccuaccacuagaagcauggccagcaacagacaaaacaaaaagagaagaaguagacuaa

SEQ ID NO: 1217 - RNA, 2961 nt, Artificial Sequence
  derived and/or modified CDS sequence (opt12) from Homo sapiens__NP_006120.1__HsBMP1
augccugggguugcaagacuaccguuacuauugggauuacuacuauuaccaaggccaggaagaccauuagauuuagcagauuauacguaugauuuagcagaagaagacgauagugaaccauuaaauuauaaagauccauguaaagcagccgcguuuuuaggggacauagcacuagaugaagaagaucuaagagcauuucaaguacaacaagcaguugaccuaagaagacacacagcuagaaaaucaucaauuaaagccgcugucccgggaaauacgaguacaccgaguugucaaucuacuaacggacagccacaacguggugcaugcggaagauggagaggacgcucaaggagucggagagcggcaacaagcagaccagaaagggucuggccagauggaguaauaccuuucguaauaggaggaaauuuuacaggaagucaaagagcaguauuccgucaagcuaugagacauugggaaaaacauaccuguguaacguuuuuagaaagaacagaugaagauaguuacauaguguuuacguaucgaccaugcggauguuguucuuacguaggaagacgagggggugguccccaagcaauaucaauagguaaaaacugcgauaaauucgggauaguaguacaugaacuagggcauguaguuggauuuuggcaugaacacacacgacccgauagagauagacaugucucaauaguaagggaaaacauacaacccggacaagaauauaauuucuuaaaaauggaaccacaagaaguugaaaguuuaggugaaacguaugacuucgauaguauuaugcauuaugcacgaaauaccuuuaguagaggaauuuuucuugacacuauaguaccgaaauaugaaguaaaugguguaaaaccaccaauaggucaaagaacaagauuaucaaaaggagauauagcacaagcucgaaaacuguacaaaugcccagcuuguggugaaacauugcaagauucaacaggaaauuucaguagcccagaauacccaaacggauauagugcgcauaugcauugcgucuggaggauuaguguaacaccaggugagaaaauaauacuaaauuuuacgaguuuagacuuauaucgaagcagauuauguugguaugacuauguugaaguuagagauggauuuuggagaaaagcaccauuaagaggaagauuuuguggaucaaaacuaccagaaccaauaguaaguacagauaguaggcuuuggguagaguucagaagcucgaguaauuggguaggcaaaggauucuuugcagucuaugaagccauauguggaggggauguuaagaaagacuauggacacauacaaucaccuaauuauccggacgauuaccgaccaagcaaaguuuguauuuggcggauucaaguaagcgaagguuuccacguaggacuuacauuccaaucuuuugaaauugaacgccaugauaguugcgcauacgacuaucuagaaguaagagauggucauagcgaaaguucaacacuaauuggaagauacugcggauaugaaaaaccugacgauauaaaaucaacaagcagucgauuauggcuaaaauuugugagugacggaagcauaaauaaagcuggcuucgcuguaaacuuuuucaaagaaguagaugaauguaguagaccaaauaggggcggaugugaacaacguuguuuaaauacuuuaggcucguauaaaugcagcugugaucccggauaugaacucgcaccagauaaaagaagaugugaagcagcauguggaggauuuuugacaaaacuuaaugguuccauaaccaguccaggguggccaaaagaauauccgccaaauaaaaauugcauuuggcagcuaguagcuccaacucaauaccguaucaguuuacaauucgacuucuuugaaacagaaggcaaugacguaugcaaauacgauuuuguagaaguuagaucugggcuaaccgcugacaguaaauuacauggaaaauuuuguggcucagaaaaaccagaaguaaucacaucacaauacaauaacaugagagucgaguuuaaaagcgauaacacaguuaguaagaaagguuuuaaagcccauuucuuuagugauaaagaugaaugcucaaaagauaauggagggugucaacaagauugcguaaauacauuuggaagcuacgaaugccaauguagauccggauuuguacuccaugauaauaaacacgauuguaaagaagcaggaugugaccacaaaguaaccucuacaucggggacuaucacgaguccaaacuggccagauaaauacccuucaaagaaagaaugcacuugggcgaucaguucuacuccaggacauaggguuaaauuaacauuuauggaaauggacauagaaucacaaccugaaugugcuuaugaccauuuagaaguuuuugauggaagagaugcuaaagcgccuguuuuaggucgguuuugcggaaguaaaaagccugaaccugucuuagccacuggcucaaggauguuuuuaagguuuuauucagacaacucaguccaaagaaaaggauuucaagcaagucaugcgacagaaugcggaggccaaguacgagcagauguaaaaacaaaagaucuuuauucucaugcacaauuuggugauaauaauuauccuggaggaguugauugugaguggguaauaguagcagaagaagguuauggaguugaauuaguauuucaaacguuugaaguagaagaagaaaccgauugcgguuaugacuacauggaacuauucgaugguuaugauucaacagcuccuagauuaggaagauauugugggucaggcccgccagaggaaguauauagugcaggagauagcguucuaguaaaauuucacagcgacgacacaauaaccaagaaaggauuccaucuacgcuauacaucaacuaaauuccaagauacacuacauagcagaaaauaa

SEQ ID NO: 1218 - RNA, 1191 nt, Artificial Sequence
  derived and/or modified CDS sequence (opt12) from Homo sapiens__NP_001191.1__HsBMP2
auggucgcaggaacaagaugucuacuagcacuauuacuuccacaaguucuacuaggaggagcagcuggauuaguaccagaauuaggaagaagaaaauuugcggcagcaucaucuggaagacccaguucacaaccaucagacgaaguauuaucagaauuugaacuuagacuacuuagcauguucggauuaaaacaacgucccacaccaucuagagaugcaguaguaccacccuauaugcuugaccuauacagacgucacagcggccaaccaggaucaccagcaccagaccauagacuagaaagagccgcaucaagagcaaacacaguaagaucauuccaccaugaagaaagcuuagaagaauuaccagaaacaucagguaaaacuacaagaagguuuuucuuuaacuuaagcucuauaccaacagaagaauuuauaacaucagcagaauuacaaguauucagagaacaaaugcaagacgcacuaggcaauaauagcagcuuucaccacagaauaaauauauaugaaauuauaaaaccagcaacagcaaacucaaaauuuccaguaacaagacuauuagacacacgacuaguaaaucaaaaugcaucaagaugggaauccuucgacguaacaccagcaguaaugagauggacagcacaaggacacgcaaaccauggauuuguaguagaaguagcucacuuagaagaaaaacaaggaguaaguaaacgucauguaagaauuagcagaaguuuacaucaagacgaacauuccuggucucaaauuagaccacuacuaguaacauucggacaugacggaaaaggacacccacuacacaaaagagaaaaacgacaagcaaaacauaaacaacguaaaagauuaaaauccucauguaaaagacauccauuauacguagauuucucagacguaggauggaacgacuggauaguagcaccacccggauaccacgcuuucuauugccauggagaaugcccauucccacuugcagaccaucuaaacagcacaaaucacgccauuguacaaacauuaguaaacagcguaaacuccaaaauaccaaaagcaugcugcguuccaacagaauuaagcgcaauaucaauguuauacuuagacgaaaaugaaaaaguaguacuaaaaaauuaccaagacaugguaguagaaggcuguggaugccgcuaa

SEQ ID NO: 1219 - RNA, 1227 nt, Artificial Sequence
  derived and/or modified CDS sequence (opt12) from Homo sapiens__NP_001193.2__HsBMP4
augauaccaggaaauagaaugcuuaugguaguauuacuaugccaaguauuacuaggaggugcaucccaugccucauuaauaccagaaaccggcaaaaaaaaaguagcugaaauacaaggacaugcaggaggaagaagauccggacaaucacacgagcuacuaagagacuuugaagcuacauuauuacaaauguuuggauuacgaagaagaccacaaccuucaaaaucagcugucauuccagauuauaugagagacuuauauagauuacaaucuggugaagaagaagaagaacaaauccacucaacuggacuggaauauccagaaagaccagcuucaagagcuaauacuguucguucauuucaucacgaagaacauuuagaaaacauaccaggaacaagcgaaaauagugcauuuagauucuuauucaaccuauccagcauuccagaaaacgaaguaauaucaagugcagaauuaagauuauuucgugaacaaguagaucaaggaccagacugggaaagaggauuucacagaauuaacauauaugaaguuaugaaaccaccugcagaagucguaccaggucaccuaauaacaagauuauuagauacaagacuaguacaucauaacgucacaagaugggaaacuuuugacguaucaccagcaguauuacgauggacacgagaaaaacaaccaaauuacggucuagcaauagaaguaacacaccuacaucaaacaagaacccaccaaggacaacauguacgaauaucaagaucauuaccacaaggaagcggaaacugggcacaauuaagaccacuacuaguuacuuuuggacacgauggaagaggacacgcacuaacacggagaagaagagcaaaacguucaccaaaacaccauucucaaagagcaagaaaaaaaaauaaaaacugcagacgacauagcuuauauguagauuucucagauguaggguggaaugacuggauaguagcaccuccaggauaccaagcauuuuacugucacggugacuguccauuucccuuagccgaucacuuaaacucaacaaaucaugcaauaguacaaacacuaguaaacaguguaaacucaaguauaccuaaagcaugcugcguaccaacagaacuaucagcaauuucaauguuauaccuagacgaauaugacaaaguuguauuaaaaaauuaucaagaaaugguuguagaaggauguggauguagauaa

SEQ ID NO: 1220 - RNA, 1542 nt, Artificial Sequence
  derived and/or modified CDS sequence (opt12) from Homo sapiens__NP_001709.1__HsBMP6
augccaggacuagguagaagggcccaauggcuauguuggugguggggucuauuauguucauguuguggacccccuccucuaagaccaccauuaccagcugcugcagcagcagcagccggcgggcaauuacuaggagauggaggcucgccaggaagaacagaacaaccaccaccaucaccacaaucaucaucagguuuccuauacagacgacuuaaaacacaagaaaaacgagaaaugcaaaaagaaauauuaucuguuuuaggucuaccacauagaccuagaccacuacauggccuacaacaaccucaaccuccagcccuucgccaacaagaagaacaacaacaacaacaacaauuaccaagaggugagccaccacccgguagauuaaaaucagcuccuuuauucauguuagauuuauacaacgcccuauccgccgauaaugaugaagauggagcaucagaaggcgagaggcaacaaucauggccgcaugaagcagcuucaucaucacaacgccgacaaccaccuccuggugcugcacauccauuaaaucguaaaagccuacuugcaccaggaucaggaucuggaggagccucaccacuaacaagcgcacaagauucagcauuucuaaaugacgcugauauggucaugaguuuuguaaaucuaguagaauacgauaaagaguucucuccaagacaaagacaucauaaagaauuuaaauuuaaucuaucucaaaucccagaaggagaaguaguaacagcggcagaauuuagaauauauaaagauuguguaaugggaucauucaaaaaucaaacuuuucuaauuucaauauaccaaguauuacaagaacaucaacaucgcgacucagaccucuuuuuacucgacacccgaguuguuugggcauccgaagaaggcuggcuagaauuugauauuacagcaacaucaaauuuauggguaguaaccccucaacauaacauggguuuacaauuaaguguaguaacaagagacggaguucacguccacccaagagcugcaggauuaguaggaagagauggaccauaugacaaacaaccauucaugguugcauucuuuaaaguuagugaaguucauguacgaacaacaagaucagcaaguucaagaagaagacaacaaucuagaaaccgaaguacacaaucacaagauguugcacgaguaucaucugccagugacuauaauucaucagaauuaaaaacagcauguagaaaacacgaauuauacguaucauuucaagauuuagguuggcaagacuggauaauagcaccaaaaggauacgcagcaaauuauugugacggcgaauguucauuuccuuuaaaugcacauaugaaugcaacaaaccaugcaauaguccaaacauuaguccacuuaaugaauccagaauacguaccaaaaccuuguugugccccaacaaaauuaaaugcaaucucaguacuauacuucgaugauaauucaaauguaauauuaaagaaauaccgaaauaugguaguaagagcuugcggcugucacuaa

SEQ ID NO: 1221 - RNA, 1296 nt, Artificial Sequence
  derived and/or modified CDS sequence (opt12) from Homo sapiens__NP_001710.1__HsBMP7
augcaugucagaucacuuagagcagcagccccacauucuuucguagcauuaugggcaccauuauucuuauuaagaagcgcacuagcagacuuuucauuagacaaugaaguacauaguagcuuuauacauagacgccuaagaucacaagaaagacgagaaaugcaaagagaaauccuaucaauauuaggauuaccacauagaccaagaccucaucuacaaggaaaacacaacuccgcuccaauguucauguuagaccuauauaacgcaauggcugucgaagaaggaggagguccaggaggacaagguuuuaguuaucccuacaaagcaguauuuagcacacaaggcccaccacucgcaagcuuacaagauucccauuuccuaacagaugccgauaugguuaugaguuucguuaaucuuguagaacacgauaaagaauucuuccacccuagauaucaccaucgagaguucagauucgaucuuucaaaaauaccagaaggagaagccguuaccgcagcagaauuuagaauauauaaagauuacauccgcgaacgauuugacaaugaaacauucagaauaucaguauaucaaguacuacaagaacaucuagggagagaaucagaucuauuuuuauuagacucuagaacacuaugggcaucagaagaaggaugguuaguuuucgauauaacagccacaagcaaucacuggguaguaaacccuagacacaacuuaggauuacaauuaagcguagaaacacucgacggccaaaguauaaaccccaaacuagcaggacuaauaggacgacacggcccacaaaacaaacaaccauuuauggucgccuuuuucaaagcuacagaaguacauuuccgaucaauacgaucuacaggauccaaacaaagaucacaaaacagaucuaaaacaccaaaaaaucaagaagcauuaagaauggccaauguagcagaaaauagcucaucagaucaacgacaagcaugcaaaaaacaugaacuauacgugaguuucagagaucucggauggcaagauuggauaauagcaccagaaggauaugcagccuauuauugugaaggugaaugugcauuuccacuaaauucuuacaugaaugcaaccaaucacgcaauaguucaaacacuaguacacuuuauaaacccagaaacaguaccaaaaccuuguugcgcaccaacacaauuaaacgcaaucucaguauuauacuucgaugauaguucuaacguaauauuaaaaaaauacagaaacaugguagucagagcaugcgguugucacuaa

SEQ ID NO: 1222 - RNA, 300 nt, Artificial Sequence; identical to SEQ ID NO: 737
  derived and/or modified CDS sequence (opt12) from Homo sapiens__NP_006264.2__HsCCL7

SEQ ID NO: 1223 - RNA, 3624 nt, Artificial Sequence
  derived and/or modified CDS sequence (opt12) from Homo sapiens__NP_001954.2__HsEGF
augcuacucacguugauaauauuauuaccaguaguaucaaaauucucuuuuguuagccuaagugccccacaacauuggucuuguccagaagggacguuagccgggaauggaaacaguacaugugugggaccugccccauuuuuaauauuuucacacggaaauuccaucuuuagaaucgauacugaagggacaaauuaugaacaauuaguuguagaugccgguguaucaguaaucauggacuuccauuauaaugaaaaacggauuuacuggguugaucucgaaagacaacuacuucaaagaguguuuuuaaaugggaguaggcaagaaagagucuguaauauugagaaaaauguaucaggaauggcuauaaauuggauaaacgaagagguaauauggucuaaucaacaagaagguauuauaacugugacugauaugaaaggaaauaacucacauauccuccuaucugcucuaaaauauccugcuaacguggcaguugauccagucgaacgauuuaucuuuuggucaucagaggucgcaggaucgcuauauagagcagacuuagaugguguaggaguaaaagcauuacuagaaaccagcgagaaaauaacugcaguaaguuuagauguacucgacaaaagauuauucuggauacaauacaauagagaaggaucaaauucacuaauauguucuugugacuaugauggcggaagcguccacauaucuaaacaccccacacaacauaauuuauuugcgaugaguuuauuuggugauagaauauuuuauaguacguggaaaaugaaaaccauauggauagcuaauaaacauacaggaaaagacaugguccgaauaaaccuacacucauccuuuguaccucuaggggaauugaaaguaguacauccacuagcacaaccaaaagcggaagacgacacaugggaaccggaacaaaaacucuguaaacucagaaaggguaauuguucgaguacuguauguggacaagaucuacaaagccauuuauguaugugcgcagaaggauaugcuuuaucaagagaucgaaaauauugcgaagaugucaaugagugugcauuuuggaaucauggauguacccuuggcugcaaaaauaccccaggcucauauuauugcacuuguccaguaggauuuguauuguuaccugauggaaagcgaugucaucaacuuguaaguuguccacgaaauguuagugaauguucacaugauugcguguuaacaucagaaggcccauuaugcuucugcccagaaggaucaguguuagaaagagauggcaaaacuugcaguggaugcaguagcccagacaaugguggauguagucaauuauguguuccguuauccccagugucgugggaaugugacuguuuuccaggauaugauuuacagcuagacgaaaaaucuugcgcagcaagcgguccacaacccuuuuuacuauuugcaaauucccaagacauucgucacaugcauuuugaugguacugauuaugguacauuauuaucacaacaaauggguaugguauaugcauuagaccaugauccugucgaaaacaaaauauauuucgcucauacagccuuaaaguggaucgaacgcgcuaacauggauggaagucaaagagaaaggcucauugaagaaggagucgauguacccgaaggcuuagcaguagacuggauaggccgccgauuuuauuggacagauagagguaaaagucuuauaggacguucagacuuaaauggaaaaagaaguaaaauuauaacaaaagaaaacauaucacaaccuaggggaauagcaguacauccaauggcaaaacgccucuuuuggacagauacaggcauaaauccuagaauugaaaguucuagcuuacagggacuaggccggcuaguaauugccucaucagaccuaauauggccaagugggauaaccauagauuuucucacggacaaauuguauuggugcgaugcaaaacagucaguaauagaaauggcuaaucucgaugguucaaagagaaggagauuaacacagaacgauguuggucacccauucgcaguagcaguauucgaggauuacgucugguuuucggauugggcaaugccaaguguaaugagaguaaacaaaagaacagguaaagauagaguacgauuacaaggauccauguuaaagcccuccucauuaguagucguucauccauuggcuaaaccaggagccgacccaugcuuauaccaaaauggugguugugaacacauuuguaagaaaagauuaggaacagccugguguucaugcagagaaggcuucaugaaagcaucagauggaaaaacaugccuagcauuagauggacaccaacuacuagcaggaggagaaguugaccucaaaaaccaaguaacgcccuuagauauauuaaguaaaacucgaguuagugaggacaacauaacagaaagucaacacauguuaguggcugaaauaaugguaagugaucaagacgauugugcaccaguaggauguucaauguaugcacgcuguaucucagaaggcgaagaugcaacuugccaaugccuaaaaggcuucgcgggcgauggaaaacuauguucagacauagaugaaugugaaauggguguuccuguaugucccccagcguccucaaaaugcauaaauaccgaaggcggcuauguaugucguuguucagaaggguaccaaggugauggaauccauuguuuagauauagacgaaugucaauuaggcgaacauaguuguggugagaacgcuucuugcaccaacacagaaggagguuacacauguaugugcgcagggaggcuaagugagccaggauuaauuuguccagauaguacaccaccuccccaccuaagagaggaugaucaucauuacucaguaagaaauucagauagugaauguccauuaucucacgaugguuacugccuacaugacgguguaugcauguauauagaagccuuagauaaauaugcuuguaacuguguagucggcuacauaggagaaaggugucaauauagggaccuaaaauggugggaauuacgacaugcuggccaugggcaacaacaaaaaguaauaguuguagcagucugugucguaguucuaguaaugcuccucuuacuaucccuauggggugcucauuauuaccgaacgcaaaaacuucugaguaaaaauccuaaaaauccauacgaagaaucaucaagagauguacgaucaaggagaccagccgauacagaagaugggaugucgucuugcccacagccaugguucguuguaauaaaagaacaccaagauuugaaaaacggaggucaaccugucgcaggagaggauggacaagcugcagaugguaguaugcaacccacaaguuggagacaagaaccccaauuaugcggaaugggaacggaacaagggugcuggauuccaguaucgagcgacaaagggucuugcccccaaguaauggaaagaucguuccauaugcccucauacggaacgcaaacuuuagaaggaggaguagagaaaccacauuccuuacuaagcgcaaauccauuauggcaacaacgagcuuuagauccaccacaucaaauggaauugacacaauaa

SEQ ID NO: 1224 - RNA, 510 nt, Artificial Sequence
  derived and/or modified CDS sequence (opt12) from Homo sapiens__NP_001423.1__HsEREG
augacagcaggaagaagaauggaaaugcuaugugcaggaagaguaccagcacuauuacuaugucuaggauuccaucuauuacaagcaguauuaaguacaacaguaauaccaagcuguauaccaggagaaagcucagacaauugcacagcauuaguacaaacagaagacaauccaagaguagcacaaguaagcauaacaaaaugcucaagugauaugaauggauauugcuuacacggacaauguauauaucuaguagacaugagccaaaacuauugcagaugcgaaguaggauacacgggaguaagaugugaacacuucuuucuaacaguacaucaaccacuaucaaaagaauacguagcauuaacaguaauauuaauaauacuauuucuaauaacaguaguaggaagcacauacuauuucuguagaugguacagaaacagaaaaucaaaagaaccaaaaaaagaauaugaaagaguaacaucaggagauccagaacuaccacaaguauaa

SEQ ID NO: 1225 - RNA, 468 nt, Artificial Sequence
  derived and/or modified CDS sequence (opt12) from Homo sapiens__NP_000791.1__HsFGF1
auggcagaaggagaaauaacaacauucacagcacuaacagaaaaauucaaccuaccaccaggaaacuacaaaaaaccaaaacuacuauacugcucaaacggaggacacuucuuaagaauacuaccagacggaaccguagacggaacaagagacagaucagaccaacacauacaacuacaauuaucagcagaaucaguaggagaaguauacauaaaauccacagaaacaggacaauacuuagcaauggacacagacggacuacuauacggaucacaaacaccaaacgaagaaugccuauuccuagaaagacuagaagaaaaccacuacaacacauacauaucaaaaaaacacgcagaaaaaaacugguucguaggacuaaaaaaaaacggaucaugcaaaagaggaccaagaacacacuacggacaaaaagcaauacuauuccuaccccuaccaguauccucagacuaa

SEQ ID NO: 1226 - RNA, 867 nt, Artificial Sequence
  derived and/or modified CDS sequence (opt12) from Homo sapiens__NP_001997.5__HsFGF2
augguaggggugggaggaggagacguagaagacguaacaccaagaccaggaggaugucaaauaaguggaagaggagcaagagguuguaauggaauaccaggagcggcagcaugggaagcagcauuaccgagaagaagaccgagaagacacccaaguguaaauccuagaucaagagcagcuggaagcccaagaacacgaggaagaagaacagaagaaaggccuaguggaaguagauuaggggacagaggaagaggaagagcauugccaggaggaagacuaggcggaagaggaagaggaagagcaccagaaagaguaggagguagaggaagaggaagaggaacagcagcaccaagagcagcaccagcagcaaggggaaguagaccaggaccagcgggaacaauggcagcaggaaguauaacaacacuuccagcauugccagaagauggaggaaguggcgcauuuccgccaggacauuuuaaagauccaaagagauuauacuguaaaaauggagguuuuuuuuuaagaauacauccagauggaagaguagauggaguaagagaaaaaagugauccacauauaaaauuacaauuacaagcagaagaaagaggaguaguaaguauaaaaggaguaugugcaaacagauauuuagcaaugaaagaagauggaagauuacuagcaaguaaauguguaacagaugaauguuuuuucuuugaaagauuagaaaguaauaauuauaauacguaccgaaguagaaaauauacaaguugguauguagcguuaaaaagaacaggacaauauaaauuaggaagcaaaacaggaccgggacaaaaagcaauauuauuuuuaccuaugagugcgaaaaguuaa

SEQ ID NO: 1227 - RNA, 585 nt, Artificial Sequence
  derived and/or modified CDS sequence (opt12) from Homo sapiens__NP_002000.1__HsFGF7
augcacaaauggauacuaacauggauacuaccaacacuacuauacagaagcugcuuccacauaauaugcuuaguaggaacaauaagccuagcauguaacgauaugacaccagaacaaauggcaacaaauguaaacugcagcucacccgaaagacacacaagaucauacgacuacauggaaggcggagacauaagaguaagaagacuauucugcagaacacaaugguacuuacgaauagacaaaagaggaaaaguaaaaggaacacaagaaaugaaaaacaacuacaacauaauggaaauaagaacaguagcaguaggaauaguagcaauaaaaggaguagaaucagaauucuaccuagcaaugaacaaagaaggaaaacuauacgcaaaaaaagaaugcaacgaagacugcaacuucaaagaauuaauacuagaaaaccacuauaacacauacgcaagcgcaaaauggacacacaacggaggagaaauguucgucgcacuaaaccaaaaaggaauaccaguaagaggaaaaaaaacaaaaaaagaacaaaaaacagcacacuuccuaccaauggcaauaacauaa

SEQ ID NO: 1228 - RNA, 627 nt, Artificial Sequence
  derived and/or modified CDS sequence (opt12) from Homo sapiens__NP_001936.1__HsHBEGF
augaaacuacuaccaagcguaguacuaaaacuauucuuagcagcaguacuaagcgcacuaguaacaggagaaagccucgaaagacuacgaagaggccuagccgcagguacaucaaacccagacccaccaacaguaucaacagaccaauuacuaccacuaggaggaggaagagacagaaaaguaagagaccuucaagaagcagaccuagaucuacuaagaguuacauuaucaucaaaaccacaagcacuagcaacaccaaacaaagaagaacacggaaaaagaaaaaaaaaaggaaaaggacuaggcaaaaaaagagacccaugcuuaagaaaauacaaagacuucugcauacacggagaaugcaaauacguaaaagaacuaagagcaccaucaugcauaugccacccaggauaucacggagaaagaugccacggauuaagccuaccaguagaaaauagacuauacacauacgaccacacaacaauacuagcaguaguagcaguaguacuaucaucaguaugucuacuaguaauaguaggacuauuaauguucagauaccacagaagaggcggauacgacguagaaaacgaagaaaaaguaaaacuaggaaugacaaauucacacuaa

SEQ ID NO: 1229 - RNA, 2187 nt, Artificial Sequence
  derived and/or modified CDS sequence (opt12) from Homo sapiens__NP_000592.3__HsHGF
auguggguuacaaaacuauuacccgccuuacuauuacagcaugucuuacuacaucuauuacuauuacccauagcuauaccauaugcugaaggccaacguaaaagaagaaauacaauucaugaauuuaaaaaaucagcuaaaacaacauuaauaaaaauagacccagcuuugaaaauaaaaacaaaaaaaguaaacaccgcagaucaaugugcaaaucgauguacacgaaacaaaggauuacccuuuacauguaaagcauuuguauuugauaaagccagaaaacaaugcuugugguuuccuuucaacucaaugucaucaggaguaaaaaaagaauuuggccacgaauucgaucuauaugaaaauaaagauuauauaagaaauuguauaauaggaaaaggacgaucauauaaaggaacaguaaguauaacaaaaagcggaauaaaaugucaaccgugguccaguaugauaccacaugaacauucauuuuuaccaucaucauaccgagguaaagacuuacaagaaaauuacugcagaaauccacgaggagaagaaggaggaccauggugcuucacaucaaauccagaaguucgauaugaaguaugugacauuccucaauguucagaaguagaaugcaugacuuguaauggagaaucuuauagagguuuaauggaccauacagaaaguggaaaaauaugccaacgaugggaucaccaaacaccacauagacacaaauuccuaccagaaagauacccagacaaaggauuugaugauaacuacuguaggaacccggauggacaaccaaggccauggugcuauacauuagauccacauaccagaugggaauauugugcaauaaaaacuugugcagauaauacaaugaaugacaccgauguaccacuugaaaccacagaauguauacaaggucaaggagaaggauaucgaggaacaguaaauacaauauggaauggaauaccgugucaacgaugggauagucaauacccccaugaacaugacaugacaccagaaaauuuuaaaugcaaagaucuaagggaaaauuauuguaggaauccagauggaucagaaucaccuugguguuucaccacagauccaaauauacgcguuggauauuguucacaaauaccaaauugcgacaugagucacggacaggauugcuauagagguaauggaaaaaauuauaugggaaaccuaucacaaacaagaucaggucuaacaugcucaaugugggacaaaaacauggaagauuuacauaggcacaucuucugggaaccagaugcaagcaaauuaaaugaaaauuauugucgaaauccagaugacgacgcacauggaccaugguguuacacaggaaacccacuaauaccaugggacuauugccccauaucaagaugcgaaggagauacuacacccacuauaguaaaucuagaucacccuguaauaucaugugcaaagaccaaacaacucaggguaguaaacggcauaccaacucgaaccaauauuggauggaugguuucacuaagauaccgcaacaagcauauaugcggaggaagccuaauuaaagaaucauggguauugacagcaagacaauguuucccaagccgagaccuuaaagauuaugaagcaugguuaggaauacacgacguacauggcagaggagaugaaaaaugcaaacaaguacuuaacguuucucaauuagucuacggaccagaaggauccgacuuaguacuaaugaaauuagcaagaccagcaguucuagaugauuuuguaucuacaauagaucuaccaaacuacggauguacaauaccugaaaaaacaagcugcaguguauacggaugggguuauacuggccuuauaaauuaugacggacuccuaaggguagcucauuuauauauaaugggaaaugaaaaaugcucccaacaucaucguggaaaaguuacacuaaaugaaucagaaauaugcgcaggugcagaaaaaauagguucaggaccaugugagggagauuaugguggaccauuaguuugugaacaacauaaaaugcgaaugguccuaggaguaauuguaccaggaagaggaugcgcaauaccuaauagacccggaauuuucgucagaguagcauacuaugcuaaauggauacauaaaauaauacuaacguauaaagugccucaaucauaa

SEQ ID NO: 1230 - RNA, 1926 nt, Artificial Sequence
  derived and/or modified CDS sequence (opt12) from Homo sapiens__NP_005336.3 __HsHSPA1A
auggcaaaagcagcagccauaggaauagaucuugguacaacauauucaugcguaggcguauuucaacauggaaaaguagaaauaauagcaaacgaccaaggcaaccgaacaacaccauccuacguggcuuucacagacacagaaagacuaauuggcgaugcagcuaaaaaucaaguugcauuaaauccacaaaacacaguauuugacgcaaaaagacucauaggaagaaaauuuggggauccuguaguccaaagcgauaugaaacacuggcccuuucaaguaauaaacgacggcgacaaaccaaagguacagguaaguuauaagggagaaacaaaagcauuuuaccccgaagaaaucagcagcaugguauuaacuaaaaugaaagaaauagccgaggcauauuuaggauauccaguuacaaacgcagucauaacuguaccagcauacuuuaaugauucacaaaggcaagcaacaaaagaugcaggaguaauagcuggauuaaacguauuaagaauaauaaacgaaccaacagcagcagcaauagcguaugguuuagaccgaacaggcaaaggagagagaaacguacuaaucuuugaucuaggaggaggaacauucgauguaucaauauuaacaaucgaugacggaauauucgaaguuaaagcaacugcaggagacacacacuuaggaggagaagauuuugauaacagauuaguaaaccacuuuguagaagaauuuaaacgaaaacauaagaaagacauuucacaaaauaaaagggcuguaagaagacuaagaacagcuugcgaaagagcuaaaagaacacuaagcagcucaacacaagcaagucuagaaauagacaguuuauuugaaggaaucgauuucuacacaucaauaacaagagcacgauuugaagaacuauguagugaccuauuuagaagcacucuagagccugucgaaaaagcauuaagagaugcuaaauuagacaaagcacaaauacacgaucuaguucuaguaggaggaucaacucgaauccccaaaguacaaaaacuauuacaagauuucuucaaugguagagaccucaauaaaaguauuaauccagaugaagcagucgcauauggugcugcaguacaggccgcaauuuuaaugggggauaaauccgaaaacguccaagaucuauuauuauuagacguagcaccauuaucacuagguuuagaaacagcuggagggguaaugacugcauuaauaaaaaggaacaguacaauaccgacaaaacaaacacaaauauuuacaacauacucagauaaucaaccaggaguuuuaauucaaguauacgagggagaacgcgcaaugacaaaagacaacaaucucuuaggccgguuugaacuaucagguauaccuccagccccuagagguguuccacaaauagaaguaacauuugauauugacgcuaaugguauccuaaacgucacagcaacugacaaaucaaccggaaaagcaaauaaaaucacaauaacaaaugauaagggaagacuuaguaaagaagaaaucgaaagaaugguacaagaggcagaaaaauauaaagcggaagacgaaguacaaagagaaagaguaagugcuaaaaacgcgcuugaauccuaugcauucaauaugaaaucagcagucgaggacgaaggauuaaaaggaaaaauaagugaagcagacaaaaagaaaguuuuagauaaaugccaagaaguuauuucaugguuagaugcaaauacauuagcagaaaaagacgaguucgaacauaaaaggaaagaacuagaacaaguauguaauccuauaauaagcggauuauaccaaggugcgggagguccaggacccggugguuucggugcucaaggaccuaaaggcggcaguggaaguggaccaacuauagaagaaguagauuaa

SEQ ID NO: 1231 - RNA, 1926 nt, Artificial Sequence
  derived and/or modified CDS sequence (opt12) from Homo sapiens__NP_005337.2 __HsHSPA1B
auggcuaaagcagcagcaaucggaaucgauuuagggacaacauacagcuguguaggaguauuccaacacggaaaaguugaaauaauagcaaaugaucagggaaacaggacaacuccuagcuauguugcauuuaccgauaccgaacgucucauuggagaugcggcaaaaaaucagguagcauuaaacccccaaaacacaguauuugacgcuaaaagauuaauaggacgaaaauucggagauccgguuguacaaagcgacaugaaacacuggccauuucaaguaauaaaugauggagacaaaccaaaaguccaagucucuuacaaaggagaaacaaaagcauucuacccagaagaaauaucaaguauggucuuaaccaaaaugaaagaaauagcagaagcauacuuaggguacccaguaacaaaugcaguaauaacaguucccgcauauuuuaacgauagccaaagacaagcuacuaaagacgcaggaguaaucgcaggauuaaauguacuuagaauuauaaaugagccaacugcagcagcaauugcauauggauuggacaggacuggaaaaggagaaagaaacguauuaauauuugaccuaggaggaggcacauuugacguaucaauauuaaccauagacgacggaauauucgagguaaaagcaacagcaggagacacccauuuaggaggagaagauuucgauaaucgauuaguaaaucauuuuguagaagaauuuaaaagaaaacauaaaaaagauauaucacaaaauaaaagagcaguuagacgauuacgaacagcuugcgaaagagcaaaaagaacccuaaguucuagcacacaagcuagccuugaaauugauucccuauuugaaggcauagauuucuauacaagcaucacucgagcaagauuugaagaauuaugcagugacuuauuuagaucaacucuagaaccuguagaaaaagcgcuuagagacgccaaauuagauaaagcacaaauccaugauuuagucuuaguaggaggaucaaccagaauacccaaaguacaaaaacuauuacaagacuucuucaacggaagagaucuaaauaaaucaauaaauccugacgaggcaguugccuacggagccgcgguacaagcagcaauacuaaugggagacaaaagcgaaaacguacaagaucuauuacuucuagauguagcaccucuaaguuuaggauuagaaacagcaggaggaguaaugaccgcacuaauaaaaaggaauucaacgauaccaacaaaacaaacucaaauuuucacaacauacucagacaaucaaccuggaguacuaauacaaguauacgaaggagagagagcaaugacaaaagauaacaaucuauugggaagauucgaacuaucaggaauacccccggcgccacgaggaguaccgcaaauugaaguaacuuuugauauagaugccaauggaauauuaaauguaaccgcaaccgauaaaagcacuggaaaagcaaauaaaauaacaauaacaaaugacaaaggaagacuaucaaaagaagaaauagaacgaaugguccaagaagcagaaaaauacaaagcagaagacgaaguacaacgagaacgaguuucagccaaaaaugcauuagaaucauacgcauuuaacaugaaaagugcaguagaagacgaaggacuaaaaggaaaaaucucagaagcagauaaaaaaaaaguacuggauaaaugucaagaagucauaaguugguuagacgcaaauacauuagcagaaaaagacgaauucgaacacaaaagaaaagagcuagaacaagucuguaacccuauaauaaguggacuauaccaaggagcgggaggaccaggaccaggagguuuuggugcacaagguccaaaaggcggaagcggcagcggaccuacaauagaagaaguagauuag

SEQ ID NO: 1232 - RNA, 1926 nt, Artificial Sequence
  derived and/or modified CDS sequence (opt12) from Homo sapiens__NP_005518.3 __HsHSPA1L
auggcuacagcaaaaggaauagcuauuggaauagaucuaggcacaacauacaguugcguuggcguuuuucagcauggaaaaguagaaauuauagcaaaugaucaaggaaaucgcaccacuccuucuuauguagcuuucacagauacagaacgacuuauaggagacgcugcuaaaaaccaaguugcaaugaacccacaaaauacugucuuugacgcaaaaagacuaauaggccgaaaauucaaugacccaguaguacaagcggacaugaaacuuuggccauuccaagugaucaacgaaggugguaaaccaaaaguauuaguaucauacaaaggagaaaauaaagcauuuuacccagaagaaauaagcucuaugguacugacuaaauuaaaagaaacagcagaagcauuucuaggacacccaguaacaaaugcaguaauaacaguacccgcuuacuuuaaugacucccaaagacaagcaacaaaggacgcaggaguuauagcaggacuuaauguacuuagaauaaucaacgaaccaacagcggcagcaauagccuauggauuagauaaaggaggacaaggagaacgacauguauuaauauuugaccuagguggagguacauucgaugucucuauauuaaccauagacgacggaauauucgaaguaaaagcaacagcaggggacacucauuuaggcggagaagauuuugacaauagauuaguaagccacuucguagaagaguucaaaagaaaacacaaaaaggauauaagucagaauaaacgagcaguaagaagacuacgaacagccugugaaagagcuaaaagaacguuaucaaguucaacacaagcaaaucuagaaauagacagucuauaugaaggaauagauuucuauaccucaauaacgagagcuagauuugaagaacuaugcgcagaucuauucagaggcacacuagaaccaguagaaaaagcucuacgagaugcaaaaauggacaaagcuaaaauucaugauauaguccuuguagggggaucaacaagaauaccaaaaguacaaagauuguuacaagauuacuuuaacggaagagauuuaaacaaaucaauaaacccagaugaagcuguagcauauggcgcagcaguacaagcagcaauacuuaugggagauaaaagugaaaaaguacaagauuuauuauuauuagacguagcaccacuaucccuaggacuagaaacagcaggaggaguaaugacagcacucauaaaaagaaauaguaccauaccaacaaaacaaacccaaauauuuacaacguauagcgacaaucaaccaggaguacuaauacaaguguaugaaggagaaagagcaaugaccaaagauaauaaucuucuuggccgauucgaucucacaggaauaccuccagcaccaagaggagucccacaaauugaaguuacauuugacauagacgccaaugguauacuaaacguaacagcuaccgauaaaaguacaggaaaaguaaacaaaaucacaaucacaaaugacaaagguagauuaucaaaagaggaaaucgaaagaaugguauuggacgcagaaaaauauaaagcagaagacgaaguacaaagagagaaaauagcagcuaaaaacgcucuugaaucauaugcauuuaacaugaaaucaguaguauccgacgaaggacucaaaggaaaaauaagcgaaucagauaaaaauaaaauacucgauaaaugcaacgaacuauuaagcugguuagaaguaaaucaacuagcagaaaaagaugaauuugaccauaaaagaaaagaacuagaacaaauguguaauccaauaauaacuaaauuauaccaaggaggaugcacaggaccagccuguggcacaggauauguuccuggacgacccgcaacuggaccaacaauagaagaaguugauuaa

SEQ ID NO: 1233 - RNA, 1920 nt, Artificial Sequence
  derived and/or modified CDS sequence (opt12) from Homo sapiens__NP_068814.2 __HsHSPA2
augagcgcaagaggaccagcgauuggaaucgaucuaggaacaacguacaguugcgugggaguauuccaacauggaaaaguugaaauaaucgcaaaugaucagggaaauagaacuacaccaucauacguugcuuuuacagacaccgaaagauugauuggagacgcagcgaaaaaucaaguagcaaugaauccaaccaacacaaucuuugacgcaaaaagacucauaggcagaaaauucgaagacgcaacgguacagagcgauaugaaacacuggccauuuagaguaguaucagaaggaggaaaaccaaaaguacaagucgaauauaaaggagaaacuaaaacauuuuucccagaagaaauaagcaguaugguauuaacaaaaaugaaagaaauagcagaagcauaucuaggaggaaaaguucauagugcaguaauaacuguaccagcauauuuuaaugauucacaaagacaagccacgaaagaugccggaacaauaaccggauuaaauguacugagaauaauaaacgaaccaacagcugccgcaauagcauacgggcuagauaagaaaggaugugccggaggugagaaaaauguauuaauauuugacuuaggcggaggaacauuugauguaucaauacuaacaauugaagacggaauauucgaaguuaaaaguacggcgggagauacacauuuaggaggagaagauuuugauaacagaaugguaagucauuuagcagaagaguucaaacgaaaacacaagaaagacauaggaccuaauaaaagagcaguaagaagacuaaggacugcaugcgaaagagcaaaaagaacacuaaguagcaguacacaggcgaguauagaaauagacucauuauaugaaggagucgauuuuuauacuucaauaacgagagcaagauucgaagaacucaaugcggauuuauuuagaggaacauuggaaccaguagaaaaagcacuuagagaugcaaaacuagacaaaggacaaauccaagaaauaguccuaguagguggcucaacaagaauaccaaaaauccaaaaacuauugcaagauuucuucaauggcaaagaauuaaauaagucaaucaauccagacgaagcagucgcauacggagcagcaguucaagcagcaauauugauaggggauaaaucagaaaauguacaagaccuauuauuguuagauguaacaccauuaagucucgguauagaaacugcaggaggaguaaugacaccucuaauaaaaagaaacacaacuauaccaacaaaacaaacacaaacauuuacaacauacagugacaaucaaucaaguguauuaguacaaguauacgaaggagaaagagcaaugacgaaagacaacaaucuauuaggaaaauuugaucuaacagggauuccuccagcaccgagagguguaccacaaaucgaaguaacauuugacauagacgcaaauggaauauuaaacguaacagcagcagauaaaucaaccgggaaagaaaacaaaaucacaauaacuaacgauaaagggagguuaagcaaagaugauaucgaucguaugguccaagaagcagaaagauauaaaagcgaggaugaggcaaacagagacagaguagcagcgaaaaaugcauuagaaucuuacacguauaauauaaaacaaacuguagaggacgaaaaauuacggggaaaaauauccgaacaagauaaaaacaaaauauuagauaaaugccaagaagucauaaacugguuagacagaaaucaaauggcagaaaaagaugaauacgaacauaaacagaaagaacuagaaagaguguguaaucccauaauaucaaaauuauaccaaggagguccaggagguggaagcgggggaggaggaaguggcgcaagcggagggccaacaauagaagaaguagauuag

SEQ ID NO: 1234 - RNA, 2523 nt, Artificial Sequence
  derived and/or modified CDS sequence (opt12) from Homo sapiens__NP_002145.3 __HsHSPA4
augucuguaguaggaauagaccucggauuucaaaguuguuauguagcagucgcucgggcaggaggcauugaaacaauugcaaaugaauacucagacagguguacaccagcaugcauaaguuucggaccaaaaaaccgaucaauaggcgcagcagcaaaaagccagguaauaucaaaugcuaaaaauacaguacaaggguuuaaaagauuccacggaagagcauuuucagauccuuuuguagaagcugaaaaaaguaauuuagccuacgacauaguucaguuaccaacaggauuaacaggcauaaaaguaacuuauauggaagaagaacgaaacuuuacaacugaacaaguaacagcaaugcuacuaucuaaauuaaaagaaacugcagaaaguguuuuaaaaaaaccaguaguagacuguguaguaagcgugccauguuuuuauacagacgcggaaagaagaucggucauggaugcaacacaaauagcagggcucaauugccuuaggcucaugaaugaaacaacugcaguagcucuagcuuacggaauuuauaaacaagacuugccagcacuagaagagaaaccaagaaacgucguuuucgucgauaugggacacucagcauaccaaguaaguguuugcgcauuuaauagaggaaaacuaaaaguauuggcaacagcauuugacacaacacuaggagguagaaaauucgaugaaguacuagucaaucacuuuugugaagaauucggaaaaaaguacaaacuagauauuaaaucaaaaauuagagcauuauugcgacuaagccaagaaugugaaaaacuaaaaaaauuaaugucagcaaaugcaucugacuuaccauuaagcauugaaugcuuuaugaaugauguagaugucucaggaacaaugaaucgaggaaaauucuuagaaauguguaacgaucuacuagcuagagucgaacccccucucaggucagugcuagaacaaacaaaacuaaaaaaagaagauauauacgccguggaaaucguagguggagcuaccagaauaccagcugugaaagagaaaauaaguaaauucuucggcaaagaauuaucaacaacacuaaaugcagacgaagcaguuacccgaggaugugcuuuacaaugugcaauuuuaucgccagcauucaaaguacgagaauucucaauaacagauguaguaccuuaucccauaucucuuagauggaauucaccagcagaagagggaagcucagauugcgaaguauuuucaaaaaaccacgcugcaccguuuuccaaaguacugacuuucuacagaaaagaaccauuuacguuagaagcauacuauucaucuccccaagacuuaccauacccagaucccgccauugcacaauucucaguacaaaaggugaccccacaauccgacggauccagcucaaaagugaaaguaaagguaagaguaaauguacacggcauauuuucaguaaguucagcgucccucguagaaguucacaaaagcgaagaaaacgaagaaccaauggaaacagaccaaaacgcaaaagaagaagaaaaaaugcaaguagaccaagaagaaccccauguagaagaacaacaacaacaaacacccgcagaaaacaaagccgaaagugaagaaauggaaacaucacaagcaggcaguaaagauaagaaaauggaucaaccaccacaggcaaaaaaagcuaaaguaaaaacaaguacaguagaucucccaauugaaaaucaacuacuauggcaaaucgauagagagauguuaaaccuauacaucgaaaaugaaggaaaaaugaucaugcaagacaaacuagaaaaagaacggaacgaugcaaaaaacgcaguggaagaguauguauaugaaaugcgagacaaacuaucaggagaauaugaaaaauuuguuagcgaggaugacagaaauucauucaccuuaaaacuagaagauacugaaaauugguuauaugaagacggagaagaccaaccuaagcaaguguacguugauaagcuagcagagcucaaaaauuugggccagccaauaaaaauaagauuccaagaauccgaagaaagaccgaaacuauucgaagaacuugggaaacaaauacagcaauacaugaagauaaucucaucauuuaaaaacaaagaagaucaauacgaccacuuagacgcagcagacaugacuaaaguagaaaaaucuacgaacgaagcaauggaauggaugaauaacaaacuaaaucuucaaaacaaacaaucacuuacaauggacccaguaguaaaaagcaaagaaaucgaagcgaaaauaaaagaauuaacgagcacauguucaccuauaauaucaaaaccaaaaccaaaaguggaaccaccuaaagaagaacaaaaaaaugcagaacaaaauggaccgguagacgggcaaggagacaauccaggaccucaagcagccgaacagggcacagacacagcaguaccaucagacagcgacaaaaaacuaccggaaauggacauagacuga

SEQ ID NO: 1235 - RNA, 2520 nt, Artificial Sequence
  derived and/or modified CDS sequence (opt12) from Homo sapiens__NP_055093.2 __HsHSPA4L
augagugugguaggaauagaccuuggauuccuaaauugcuacauagcuguagcaagaucaggaggcauugaaacaauagcaaacgaauauagcgaccgaugcacaccagcaugcauaucauuaggaaguaggacuagagccauagguaaugcggcaaaaucacaaauaguaaccaauguaagaaacaccauacauggauucaagaaacuacacggacgcagcuucgacgauccaauaguacaaacagaaagaauuagacuacccuacgaacuacagaaaaugccaaacggaucugcaggagucaaaguaagauaccuugaagaagaacggccauuugcaauugaacaagugacaggaauguuacuugcaaaacuaaaagaaacaagugaaaaugcauuaaagaaaccaguagcagauugcguaauuucaauacccagcuucuucacagacgcagaaagaagaaguguaauggcagcagcacaaguagccggacuaaacugucuaagacuaaugaacgaaacaacagcuguagcuuuagcauacggcauauauaaacaagaucuaccaccacuagaugaaaaaccaagaaacguaguuuuuauagauaugggacacucagccuaccaaguccuaguaugugcuuucaacaaaggaaaauuaaaaguacuugcaacaacauuugauccauaucuaggggguagaaauuucgacgaagcucuaguagacuacuuuugugaugaguucaaaacaaaauacaaaauuaaugucaaagaaaauucaagagcauuacucagacuuuaccaagaaugcgaaaaauuaaagaaacuaaugucugcaaaugcauccgauuuaccgcuaaauaucgaaugcuuuaugaaugaucuugacguaucaagcaaaaugaacagagcacaauuugaacaacuaugugcauccuuauuagcaagaguagaaccuccccuaaaagcgguaauggaacaagcuaaucuccaacgcgaagacauaagcucaauagaaauaguaggcggagcaaccagaauaccggcagugaaagaacaaauaacaaaauuuuucuuaaaagacauuucuacaacuuuaaacgcagacgaagcuguggcuagagguugcgcacuucaaugcgccaucuuaucaccagcguucaaaguccgcgaguucaguauaacagaccugguaccauacaguaucacgcuccgauggaaaacuagcuuugaagacggcucuggggaaugcgaaguauucuguaaaaaucacccagcaccauuuagcaaaguaauaacauuucacaagaaagaaccauucgaacuagaagcauucuacacaaacuuacaugaaguucccuacccagaugcacgaauagguaguuucacaauacaaaauguauucccacaauccgacggagacucaucuaaagucaaagucaaagugcggguaaacauacauggaauauucuccguugcaagugcaagugugauagaaaaacaaaaccucgaaggggaucauucagacgcaccuauggaaacggaaacaaguuucaaaaacgaaaacaaagauaauauggacaaaaugcaaguagaucaagaagaaggacaccaaaaaugccaugcggaacauacucccgaagaagaaauagaucauacaggugcuaaaacaaaaucagcaguauccgacaaacaagacaggcuaaaucaaacacucaagaaaggaaaaguaaaaaguauagaccugccgauacaaagcagucucugucgacaauuaggacaagauuuacuaaauaguuacauagaaaaugaagggaaaaugauuaugcaagauaaauuagaaaaagaaaggaacgaugccaaaaaugcuguugaagaauacguauaugacuuucgcgacagauuaggaacaguauacgaaaaauuuauaacccccgaagaccuaaguaaacuaucugcaguacuagaagacacagaaaauugguuauaugaagauggagaagaucagccaaaacaaguuuacguagauaaacuacaagagcuuaagaaauacggacaaccaauucaaaugaaauauauggaacaugaagaacgcccgaaagcauuaaacgacuuaggaaagaaaauacaauuaguaaugaaaguaauagaggccuacagaaacaaagaugaaagguaugaccaccucgaucccacagaaauggaaaaaguugaaaaaugcauaucagacgcuaugucauggcuaaacagcaaaaugaacgcccaaaacaaauuaucacuuacucaggauccuguaguaaaaguaagcgaaauaguagcgaaaagcaaagaacuagacaacuuuuguaacccuauaaucuauaaaccuaaacccaaagcagaaguaccagaggauaaacccaaagccaauucugaacauaaugggccaauggauggacaauccggcacagaaacaaaaucggacaguaccaaagacucaucacagcacacaaaaagcaguggagaaauggaaguugacuaa

SEQ ID NO: 1236 - RNA, 1965 nt, Artificial Sequence
  derived and/or modified CDS sequence (opt12) from Homo sapiens__NP_005338.1__HsHSPA5
augaaacucucacuaguagcagcgauguuauuacuuuuaagugcugcacgagcagaggaagaagauaaaaaagaagacguagguacaguaguagguauagaccuaggaacaacauacucauguguaggaguauucaagaauggacgaguagaaauuauagcaaaugaucaaggcaauagaauaacaccaaguuauguagcuuucacacccgaaggagaaagauuaauaggggacgcagcuaaaaaccaauuaacaagcaauccagagaacacaguauuugacgcaaaaagauuaaucggcagaacauggaaugaccccucuguacaacaagauauuaaauuucuaccguuuaaagugguagaaaaaaaaacaaaaccuuauauacaaguagacauaggaggaggacaaacgaaaacauucgcuccagaagaaauaagcgcaaugguuuuaacuaaaaugaaagaaacagcggaagcauauuuaggaaaaaaaguaacucacgcuguaguaacagucccagcauacuuuaacgaugcucaaagacaagccacaaaagaugcaggaacaauugcaggcuuaaauguaaugagaauaauaaaugaaccuacagcagccgcaauagcguacggacuagacaaaagagaaggcgaaaaaaacauacuaguauuugauuuaggaggaggaacauucgauguaagucuacuuacaauugacaacggagucuuugaaguaguagccacaaauggagauacgcaucuaggaggagaggacuucgaccaaaggguuauggaacacuucauaaaauuauacaaaaaaaaaacaggaaaagacguuagaaaagacaauagagccguacaaaaauuaagacgagagguagaaaaagcaaaaagagcauugucaagccaacaccaagcaagaauagaaauagaaucauuuuaugaaggagaggacuucagcgaaacacuuacaagagcaaaauuugaagaacugaauauggauuuauuuagaaguacaaugaaaccaguucaaaaagucuuagaagauagugauuuaaaaaaaagcgacauagaugaaauaguacucguaggaggaucaacaaggauaccaaaaauacaacaauuaguuaaagaguuuuuuaauggaaaagaaccaucacgaggaauaaauccagacgaagcaguagcauacggagcagcaguacaggcaggaguacuaagcggagaucaagauacaggagaucuagucuuacuagaugucugcccacuuacauuaggaaucgaaaccguaggagggguaaugacaaaacuaauaccacguaacacgguugugccaacaaaaaaaucacagauauucaguacagcgucagacaaucagccaaccgucacuauaaaaguauacgaaggagaacgaccacuuacaaaagauaaccaucuacuaggaaccuucgauuuaacaggaauaccacccgccccaagaggaguaccacaaauagaaguuacauucgaaauagacguaaacgguauucuuagagugacagcugaagacaaaggaaccggaaauaaaaauaaaauaacaauaacuaacgaucaaaaccgacuaacuccagaagaaauagaacgcaugguaaacgaugcagaaaaauuugcagaagaagacaaaaaacuaaaagaacgaaucgauacuagaaaugaacuagaaucauacgcauauucauuaaaaaaucaaauaggcgacaaagaaaaacuaggaggaaaauuaucaagugaggauaaagaaacuauggaaaaagcggucgaagaaaaaauagagugguuagaaagucaucaagacgcugauauagaagauuuuaaagcaaaaaaaaaagaauuagaagagauaguacaaccaauaauaucaaaacuauauggaagcgccgguccuccaccaacaggcgaagaagacacagcugaaaaagacgaauuauga

SEQ ID NO: 1237 - RNA, 1932 nt, Artificial Sequence
  derived and/or modified CDS sequence (opt12) from Homo sapiens__NP_002146.2__HsHSPA6
augcaagccccaagagaauuagcaguuggaauagaccuagguacaacauacucauguguaggaguuuuucaacaaggaagaguugagauacuagcaaaugaucaaggaaacagaacaacacccagcuauguagcauucacugacacagaaagauuagucggagacgccgcaaaaucacaagcagcucuaaacccucauaauacaguuuuugaugcuaaaaggcuuauagggagaaaauucgcagacacaacaguacaaucagauaugaaacacuggcccuuucgaguaguaucagaaggaggaaaaccgaaaguaagaguuugcuauagaggagaagauaaaacauuuuacccagaagaaaucucaucaaugguucuuaguaagaugaaagagacagcggaagcauacuuaggacaaccggucaaacacgccguuauaacaguaccugcauauuucaaugacagucaaagacaagcuacaaaagaugcaggagcaauagcaggauuaaauguauuaagaauuauuaaugaaccaacagccgcagcaauagcauacggacuagaucguagaggagccggagaaagaaacgucuuaauauuugauuuaggagggggaacauuugauguaucaguucuaucgauagaugcaggaguauuugaaguaaaagcuacagcaggagauacacauuuaggcggggaagauuuugauaacagauuaguaaaucacuucauggaagaauuuagaagaaaacacgguaaggacuuaucaggaaauaaacgagcacucagaagacuuagaacagccugugaacgagcaaaacguacuuugagcucaaguacacaagcuacuuuagaaauagacaguuuauucgaagguguugauuuuuacacaaguauuacuagagcaagauuugaagaacuauguucagauuuauuucguucaacauuagaaccaguagaaaaagcacuaagagaugcaaaacuagauaaagcucaaauacaugauguggugcuaguaggagguuccacaaggaucccaaaaguccaaaaacuacuacaagauuucuuuaauggcaaagaacucaacaaaaguauaaaucccgaugaagcaguagcauauggugcagcaguacaagcagcaguuuuaaugggagauaagugugaaaaaguacaagauuuacuauuacuagacguagcaccccuaucacucggacuagaaacagcuggaggaguaaugacuacacuaauucaaagaaacgccacaaucccaacaaaacaaacacaaacauuuacaacauacucagauaaucaaccaggcguauuuauacagguuuacgaaggugaacgagcaaugaccaaagacaauaaucuacucgguagauucgaacuaaguggaauaccaccagccccaagaggaguaccacaaauagaaguaacauuugauauagaugcaaaugguauucucagcguaacugcaaccgaccguagcacaggaaaagcuaacaaaauaacuauaacgaaugauaaaggaagacuaaguaaagaagaaguagaacgcaugguacaugaagcagaacaauauaaagcagaagacgaagcacaaagagauagaguugcagcuaaaaacaguuuagaagcacauguguuccauguaaaaggaucauuacaagaagaaucauuaagagauaaaauuccagaagaagauagacgaaaaaugcaagauaaaugcagagaaguacucgcauggcuagagcacaaucaauuagcagagaaagaggaauaugaacaccagaaacgagaauuagaacaaauuugucgaccaauauuuaguagguuauacggaggaccaggagucccaggagguucaucauguggaacccaagcaagacaaggagaucccaguacagguccaauaauagaagaaguugacuaa

SEQ ID NO: 1238 - RNA, 1104 nt, Artificial Sequence
  derived and/or modified CDS sequence (opt12) from Homo sapiens__P48741__HsHSPA7
augcaagcuccaagagaacuagcuguaggaauagauuuaggaacaacauauaguuguguaggaguauuucaacaaggaagaguugaaauacuagcaaaugaucaagggaauaggacaacaccaucauauguagcauuuacagauacagaacgauuaguaggagaugcagcaaaaucacaggcagcucuaaacccacauaauacaguauuugaugcaaaaagacuaauagguagaaaauuugcagacacuacaguacaaagcgauaugaaacauuggccauuucaaguaguaucagaagguggcaaaccaaaagucagaguauguuauagaggagaagauaaaacuuuuuaucccgaagaaauaucaucaaugguauuaaguaaaaugaaagaaacagcagaagcauaucuaggacaaccaguaaaacaugcgguaauaacaguuccaacauauuuuucaaacucacaaagacaagcaacaaaagaugccggugcaaucgcaggacuuaaaguauuaccaauaauuaaugaagcaacagcagcagcaauagcauauggacuagauagaagaggagcuggaaaaagaaauguauuaauauucgauuuaggagguggaaccuuugauguaucaguauuaagcauagaugcaggaguauuugaagucaaagcaacagcaggagauacacaucuaggaggggaagauuucgauaauagauuaguaaaucacuuuauggaagaguuuagaagaaaacauggaaaagauuuaagcgguaauaaaagagcauuaagaagacuaagaacagcaugcgaaagagcaaaaagaacaccaucaagcaguacgcaagcaacauuagaaauagacucauuauucgaaggaguagacuuuuauaaaucaauaacaagagcgagauucgaagaauuaugcucagacuuauucagaaguacacuagaaccaguagaaaaagcauuaagagaugcaaaacuugacaaagcacaaauacaugauuucguacuaggaggaggauuacacagucauccacaaggagcugaaguagcagcaggacuauuacaacgacaaggugcagaacaagaacaucaaccauag

SEQ ID NO: 1239 - RNA, 1941 nt, Artificial Sequence
  derived and/or modified CDS sequence (opt12) from Homo sapiens__NP_006588.1 __HsHSPA8
augucaaaagguccggcaguaggaaucgauuuaggaacaacauauaguugugucggaguauuucaacauggaaaaguugaaauaauagcaaacgaucaaggcaauagaacuacaccaucuuacguugcauuuacagauacagaaagauuaauaggggacgcagcuaaaaaccaaguagcaaugaacccaacaaauacaguauuugacgcaaaacgacuaauaggaagaagauuugaugaugccguuguacaaucugacaugaaacauuggcccuuuaugguaguaaaugacgcaggaagaccaaaaguccaagucgaauacaaaggagaaacaaagagcuuuuacccugaagaaguuucuagcaugguccuaacaaaaaugaaagaaauugcagaagcguaccuaggcaaaaccguaacaaacgcagucgugacaguaccagcauauuuuaacgauucacaaagacaggcaacaaaagacgcaggaacaauugcaggacucaacguacuccgaauaauaaaugaaccaacugcugcagcaaucgcauauggguuagacaagaaaguaggagcagagcgcaauguacuaauauuugaccuaggaggagguacguucgauguaagcauauuaacaauagaagauggcauauuugaaguaaaauccacagcaggagacacacacuuaggaggagaagauuuugacaauagaauggucaaccauuucauugcagaguucaaaagaaaacacaagaaagauauuucagaaaauaaaagagcaguaagaagauuaagaacagcuugugaaagagcuaaaagaacuuuaucaucaucaacacaagcuagcauagaaauugacaguuuauaugaaggaauagauuucuauacauccaucacgcgagcaagguuugaagaauuaaaugcagacuuauuucgaggaacacuugacccuguugaaaaagcccuacgagacgcuaaacuagacaaaagccaaauacaugacauaguucuaguaggaggaagcacuagaauacccaaaauacaaaagcuacugcaagacuucuucaacggaaaggaacucaacaaaagcauuaaucccgaugaagcaguagcuuacggagcugcaguacaagcugcaauauuaaguggagacaaaagcgaaaacguacaagaucuacuauuacuagauguaacaccucuaagccucggaauagaaacggcaggaggagugaugacaguacucauaaaaagaaauacuacaauaccaaccaaacaaacacaaacauuuacaacauacucagacaaucaaccaggaguauuaauacaaguauacgaaggagaaagagccaugacaaaagacaauaaucuccuaggaaaauucgaauuaacaggaauaccaccagcaccucgcggaguaccacaaaucgaaguaaccuuugacauugaugcgaacggcauauuaaauguuucagccgucgacaagucuacaggaaaagagaacaagauaacaauaacuaaugauaaagggcgauuaagcaaagaagauauagaacgaaugguacaagaagcagaaaaauauaaagcagaagaugaaaaacaaagagauaaaguaucuagcaaaaauagccuagaaaguuaugcauucaauaugaaagccacaguugaagacgaaaaauuacaaggcaaaauaaaugacgaagauaaacagaaaauauuagacaaauguaacgaaauaauaaacuggcuggauaaaaaucaaacggccgaaaaagaagaauuugaacaucaacaaaaagaauuagaaaaaguaugcaauccgauaauaacaaaauuauaccaaucagcuggggguaugccaggggguaugccagguggauucccaggagggggagcaccaccaagcggaggagcaagcucaggaccaacaaucgaagaagucgacuaa

SEQ ID NO: 1240 - RNA, 2040 nt, Artificial Sequence
  derived and/or modified CDS sequence (opt12) from Homo sapiens__NP_004125.3 __HsHSPA9
augauauccgcaucaagagcagcagcggcaagauuaguaggagcagcagcaaguagaggaccaacagcagcaagacaccaagacaguuggaaugguuuaagccaugaagcauuuagacucgugaguaggagagauuaugcaagugaagccauaaaaggagcugugguaggaauagauuuaggaacaacuaauucauguguugcaguaauggaaggaaaacaggcuaaaguacuagagaaugcggaaggagcuagaaccacucccaguguaguagcauucacagcugauggagaaagauugguagggaugccggcaaaaagacaagcaguuacgaacccaaauaacacauuuuaugcaacaaaacgacuaauagggaggcgauacgaugacccggaaguucaaaaagauauuaaaaacguuccuuuuaagauaguaagagccagcaauggagaugccuggguagaagcccacggaaaguuauauucaccaagucaaauaggggcuuuuguacuaaugaaaaugaaagaaacagccgaaaauuacuuaggacauacugcuaaaaaugcaguuauaacaguaccagcauauuuuaaugauagccaaagacaagcuacaaaagaugcaggucagauaaguggucucaacguucugcgcguaauuaaugaaccaacagcugcugcacuagcauacggguuagauaaaagugaagauaaagucauagcgguauaugauuuaggaggaggcacauuugauauaucaauauuagaaauacaaaaagggguauucgaaguuaaaagcaccaauggagauacguuucuuggaggggaagauuuugaccaagcguuauuaagacauauagugaaagaauuuaagagagagacaggaguagaucuaacaaaagacaacauggcauuacaaagaguuagagaagcugcugagaaggcaaaaugugaauuaagcucaaguguacaaacagauauaaauuuacccuauuuaacaauggauagcaguggaccgaaacaucuaaauaugaaauugaccagagcucaauuugaaggaauagugacagauuuaauaaggagaacaauagcaccaugccagaaagcaaugcaagaugcagaggugaguaaaagcgauaucggagaagugauauugguaggaggaaugacaagaaugccaaaaguacaacaaacaguacaagacuuauuuggcagagcaccaagcaaagcuguuaacccagaugaagcaguggcuauuggagcagcuauacaaggaggaguguuagcaggagauguaacagauguauuauuacuagauguaacaccauuaucauuggguauagaaacacuaggagggguauuuacaaagcuaauaaauagaaauacaacaauaccaacaaagaagucucaaguauucucaacugcagcagaugggcaaacacaaguagaaauaaaaguaugucaaggagaaagagaaauggcaggcgacaauaaacuacuuggacaauuuacacuaauaggcauaccgcccgcccccaggggaguuccacaaauagaaguaaccuucgauauagaugccaacggaauaguacacguaagcgcaaaggacaaagggacagggagagaacaacaaauaguaauacaauccagcggagguuuaucaaaagacgacauagaaaacaugguuaaaaaugcagagaaguaugcagaagaagauagaagaaagaaagaaagaguagaagcaguaaauauggcagaggguauuauacaugauacggaaacaaaaauggaagaauuuaaagaucaauuaccugcagacgaaugcaauaaacuaaaagaagaaauaagcaaaaugagagaauuacuagcaagaaaagauucggaaacuggagaaaauauaagacaagcagcuaguagccugcagcaagccagcuuaaaacuauucgagauggcauauaagaaaauggcaagcgaaagagaaggcagugggagcucaggaacaggugaacaaaaagaagaccaaaaagaagaaaaacaauaa

SEQ ID NO: 1241 - RNA, 2028 nt, Artificial Sequence
  derived and/or modified CDS sequence (opt12) from Homo sapiens__NP_079291.2__HsHSPA12A
auggcugauaaagaagcuggagguucugauggaccacgagaaacagcuccaacuucugcuuacucaaguccagcaaggucuuuaggagacacgggaauuaccccguuaagucccagucauauagucaacgauacugauucuaacguguccgaacaacaaagcuuucuuguaguaguagcaguugacuucggaacuacuucaucaggauaugcguauucauuuacaaaagaaccagaauguauccacgugaugagacgaugggaaggaggagaucccggaguaagcaaucaaaaaacaccgacaacaauacucuuaacaccagaacgaaaauuccauucauuuggcuacgcagcuagagauuucuaucaugaucuagauccaaaugaagcaaaacaaugguuauaucuugaaaaauuuaaaaugaaacuacauacaacaggugaccucacaauggauacugaucuaacagcagcaaaugggaagaaaguuaaagcacuagaaauauuugcauacgcccuucaauacuuuaaagaacaagcacuuaaagaacuaucagaucaagcaggaucugaauuugaaaauagcgauguuagauggguaauaacaguuccagcaauauggaaacaaccagcaaaacaauuuaugcgccaagcugcauaccaagcaggacucgccucuccagagaauucagaacaauuaauaauugcauuagaaccugaagcagccaguauauauugcagaaaacuaagauuacaucaaaugauugaauuaaguaguaaagcagcaguaaacgguuauagugguucagauacaguaggagcuggcuuuacucaagcaaaagaacauauaagaagaaauagacaaucaaggacauuuuuaguagaaaauguaauuggugaaauaugguccgaauuagaagaaggagacaaauauguagucguagacucugguggcggaacuguagaccuaacaguacaucaaauaagacuuccagaaggacaucuaaaagaauuauauaaagcaacgggaggccccuauggaucauuagguguagauuaugaauucgaaaaauuauuauauaaaauauuuggcgaagauuuuauagaacaauucaaaauaaaaagaccugcggcuuggguagacuuaaugauagcuuuugaaucaagaaaaagagcugccgccccagacagaacaaauccauuaaauauaacauuaccauuuucauuuauugauuauuauaaaaaauuuagaggacacucuguagaacaugcacuuagaaaaagcaacguagauuuuguaaaauggaguucucaaggaauguuaagaaugucaccagacgcaaugaacgccuuguucaaaccaacgauugauaguauaauagaacacuuacgcgacuuauuucaaaaaccagaaguaucaacagucaaauuucuauuuuuagucggaggauuugcagaagcaccacuucuacaacaagcaguacaagcagcauuuggagaucaaugcagaaucauaauaccucaagacguaggccucacgauucuaaaaggcgcagugcuauucggucuagauccagcaguuauaaaaguucggcgaucacccuuaacauauggaguuggaguauuaaaucgauacguagaaggaaaacauccaccagaaaaauuauuaguaaaagacgguacgagaugguguaccgauguauucgauaaauuuauaucagcagaccaaucaguagcucucggcgaacucguuaaaagauccuauacaccagcaaaaccaucucaauuaguuauaguaauuaauauauauucaagcgagcacgauaacguuucauuuauaacagauccagguguaaaaaagugcgguacauuaagacucgacuuaaccggaacaaguggaacagcaguuccagcacgcagagaaauacaaacauuaaugcaauuuggugauacugaaauaaaagcaacagccauagacauagccacaucaaaaucaguuaaaguuggaauagacuuucuaaauuacuga

SEQ ID NO: 1242 - RNA, 2061 nt, Artificial Sequence
  derived and/or modified CDS sequence (opt12) from Homo sapiens__NP_443202.3 __HsHSPA12B
auguuagcaguaccagaaaugggauuacagggacuauauauuggaucuucuccagaaagaucaccaguaccaucaccacccgggucaccaagaacccaagaaagcuguggaauagcuccacuaacaccaucacaauccccuaaaccagaaguaagggcaccccaacaagccaguuucaguguuguaguagcaauagauuuuggaacuacaucaucagguuacgcauuuuccuuugcaucagauccugaagcaauucauaugaugagaaaaugggaaggaggagacccuggcguagcacaucagaaaacuccuacauguuuacuuuugacaccagaaggagcauuucauucauuuggauauacagcacgagauuauuaucacgacuuagauccagaagaagcuagagauuggcucuacuuugaaaaauuuaaaaugaaaauacauagugcaacagaucuaacauuaaaaacccaauuagaagcuguuaaugguaaaacuaugccagcgcuagaaguauuugcgcacgcauuaagauuuuuccgagaacaugcauuacaagaacuuagagaacaaucaccuucacuaccugaaaaagauacaguuagauggguauugacuguaccggcaauauggaaacaaccagcgaaacaauuuaugagagaagcugcauauuuagcuggguuaguaucacgagaaaaugcagagcaacucuuaauugcgcuugagccagaagcagcaucugucuacugcagaaaauuaagacuacaucaacuacuagauuuaaguggcagagcacccggagguggaagacuaggugagcgaagaagcauagauucaaguuuccgacaagcaagagagcaacuaagacgaucaagacacucaagaacauuucuaguagaaagcgguguaggagaauuaugggcagaaaugcaagcaggagaucgauauguaguugccgauugcggggguggcacaguagauuuaacaguccaucaacuagaacaaccacacggaacucuaaaagaacuauauaaagcaucaggagguccauacggcgcaguaggaguggacuuagcguucgaacaacuacuaugcagaauauuuggagaagauuuuauagcgacauuuaaaagacaaagaccugcggccuggguagaucuaacaauagcauucgaagcaagaaaacggacggccgggccgcauagagcaggagcucuaaauauaagccuaccauuuucauuuauagacuuuuauagaaaacagagaggacauaacguugaaacugcacugagacgauccucaguaaauuucguaaaauggucuucacaaggaauguugcgaaugagcugcgaagcaaugaaugaacuauuucaaccaacuguaaguggcauuauucaacauauagaagcacuauuagcaagaccugaaguccaaggaguuaaacugcuauuccugguagguggauuugcagaaucggcaguauuacagcaugcaguacaagcagcuuuaggugcaagaggauuacgaguaguaguaccacaugauguaggacuaacaauuuuaaaaggagcuguacuauucggccaagcuccaggaguuguaagaguuagaagaaguccauuaaccuacgggguagggguacuuaauagauucguaccuggacgacauccaccagaaaaauuauuaguaagggauggaagacgcugguguacagauguguucgaaagauucguagcugcugaacagagcguugcucuaggggaagaaguacgaagaucauacuguccagcuagaccaggccaaaggcgaguauuaauaaauuuauauuguugugcagcagaagaugcaagauucaucacugauccaggaguuagaaaaugcggagcacucucucuagaguuagaaccugcggacuguggacaagacaccgcaggagccccaccaggaaggagagaaauacgagcagcaaugcaauuuggugauacagaaauuaaagucacugcaguagauguaucgacaaauagaucaguaagagcuucgauugauuuccuuucgaauuaa

SEQ ID NO: 1243 - RNA, 1416 nt, Artificial Sequence
  derived and/or modified CDS sequence (opt12) from Homo sapiens__NP_008879.3__HsHSPA13
auggcucgagaaaugacaauuuuaggaucagcgguauugacacuuuuauuagcaggauaccuagcccaacaauaccuaccacuaccuacaccaaaagugauaggaauagaccuuggaacaacauacuguucaguaggaguauucuuuccaggaacagguaaaguaaaaguaauaccagaugaaaacggacacauaaguauacccucaaugguaaguuuuaccgauaacgauguauacguaggauacgaaucaguugaauuagcagacucaaauccacaaaacacaauauaugacgcaaaaagauuuaucggaaaaaucuucacagcagaggaauuagaagcagaaauaggaagauaucccuucaaaguauuaaauaaaaacggaaugguagaauucucugucacaucaaacgaaacaauaacaguaagcccagaauacguaggcagucgauuacuacuaaaacucaaagaaauggcagaagcguacuuaggaaugccaguagcaaaugccguaauaucagucccagcagaauucgaucuaaaacaacgaaacagcaccauagaagcagccaaucuagcaggauuaaaaauacuaagaguaauaaacgaaccaaccgcagcagccauggcauauggacuacacaaagcagauguauuucacguauuaguaauugaucuaggaggcggaaccuuagacguaucauuauuaaauaaacaaggaggaauguucuuaacuagagccaugucaggaaauaacaaacuaggaggacaagauuuuaaccaacgacucuuacaauacuuauacaaacaaauauaucaaacauauggauuuguuccuagcagaaaagaagaaauacauagacuaagacaagccguagaaaugguuaaauuaaaucuuacacuccaccaaagugcacaacuaagcguguuacuaacaguagaagaacaagacagaaaagaaccacacucuucagacacagaauuaccaaaggauaaauuaucaucagcagaugaccaccgaguaaauucaggauucggaagaggacuaucagauaaaaaaucaggagaaucacaaguucuauucgaaacagaaauaucaagaaaacuauuugacacauuaaacgaagauuuauuccaaaaaauacuaguaccaauacaacaaguacuuaaagaaggacaucuugaaaaaacggaaauagacgaaguaguacucguaggagguucaacaagaauaccaagaauaagacaaguaauucaagaauuuuuuggaaaagacccaaauacauccguagauccagaucuagccguaguaaccggcguagcuauacaagcaggaauagaugguggaucauggccauuacaaguaucagcacucgaaaucccaaacaagcacuuacaaaaaacaaauuucaacuaa

SEQ ID NO: 1244 - RNA, 1530 nt, Artificial Sequence
  derived and/or modified CDS sequence (opt12) from Homo sapiens__NP_057383.2__HsHSPA14
auggcagcaaucggaguucaucuaggauguacaagcgcaugcguagcaguauacaaagacggucgagcagguguugucgcaaacgaugcaggagauagaguaacaccagcuguaguagcauauagugaaaacgaagaaauaguaggauuagcagcaaaacaaagcaggauucgaaauauaucaaauacaguaaugaaaguaaaacaaauauuaggccgaagcagcuccgacccucaagcacaaaaauauauagcagaaaguaaauguuuaguaauagaaaaaaauggaaaacuaagauacgaaauugauacgggagaagaaacaaaauucguaaauccggaagauguagcaaggcuaauauuuagcaaaaugaaagaaacagcucauaguguauuaggaagcgacgcaaacgacguaguuauaacagucccuuucgauuuuggagaaaaacaaaaaaaugcucuuggagaagccgcaagagcagccggcuuuaauguacuaagacuaauacaugaaccaucagcagcucuauuagcauauggaaucggacaagauucaccaacagguaaaaguaacauacuaguauuuaaauuaggaggaacaucauuaucacuauccguaauggaaguaaauucaggaaucuauagaguauuaaguacaaacacagacgacaacauuggaggagcacacuuuacagaaacuuuagcacaauaucuugcauccgaauuucaaagaaguuuuaaacaugacguaagagguaacgcaagagcgaugaugaaacugacaaauucagcagaaguagcaaaacauagucuaucaacauuaggauccgcaaacugcuuucuagauaguuuauaugaaggacaagacuuugacugcaauguaucaagagcacguuucgaacucuuauguucaccguuauuuaauaaaugcauagaagcaauaagaggacuauuagaucaaaauggauuuacagcugaugauauaaauaaaguuguguuauguggaggaucaucaagaauaccaaaauuacaacaauuaauaaaagauuuauuucccgcaguagaauuauuaaauucaauaccaccagacgaaguaauuccaauaggcgcagccaucgaagcaggcauacuaauaggaaaagaaaaccuauuaguagaagacucauuaaugauagaauguucagcaagagauauauuaguaaaaggaguagaugaaaguggugcgucaagguuuacaguauuauuuccaagcggaacaccacuaccugcaagaagacaacauacgcuacaagcaccagguaguauaaguucaguaugucuagaacuauaugaauccgacggaaaaaacagcgcaaaagaagaaacaaaauuugcacaaguuguuuuacaagauuuagauaaaaaagaaaacggcuuaagagacauuuuagcaguauuaacaaugaaacgcgauggaucacuacauguaacauguacagaccaagaaacaggaaaaugcgaagcaauaaguauagaaauagcuucauaa

SEQ ID NO: 1245 - RNA, 2577 nt, Artificial Sequence
  derived and/or modified CDS sequence (opt12) from Homo sapiens__NP_006635.2 __HsHSPH1
augucaguaguaggacuugauguaggaucacaaucauguuacauagcaguagcuagagccggugggauagaaacaauagcaaacgaauuuagugauagaugcacaccaagugucauaucauuugguagcaaaaacagaacaauaggaguagcagcgaaaaaccaacaaauaacccacgcaaacaacacaguaucaaacuucaaaagauuccacggcagagcauuuaacgaccccuucauacaaaaagaaaaggaaaacuugaguuaugacuuaguaccacucaaaaauggaggaguuggaauaaaaguaauguacaugggggaagaacacuuauuuagcguagaacaaauuacugcaaugcuauuaacaaaacuuaaagaaacagcagaaaacucauuaaagaaaccaguaacagauuguguaaucuccguaccaucuuucuuuacagaugcagaaagacgauccgucuuagacgcagcacaaauaguuggccuaaauuguuuaagguugaugaacgacaugacugccguagcccuaaauuaugguauuuacaaacaagacuuaccaagccucgaugagaaaccccggauaguaguauuuguagacaugggacacagcgcauuucaagugagugccugugccuuuaacaaaggaaaacucaaaguucucgguaccgccuuugauccguuuuuaggaggcaaaaauuucgacgaaaaauuagucgaacauuuuugcgcagaauuuaaaacaaaauauaaauuagacgcgaaaagcaaaauaagagcgcuacugagauuauaccaagaaugugaaaaacuaaagaaacuaaugaguucaaauaguacagaccuaccacuaaauauagaguguuucaugaacgacaaagacguaagcggaaaaaugaauagaucacaguucgaagaacuuugugcagaacuauuacagaaaauagaaguucccuuauauucauuauuagaacaaacacacuuaaaaguagaggaugucucagcuguagaaaucgucggaggagccacccguauuccagcggucaaagaaagaauagcaaaauucuuuggcaaagacauaaguacaacccuaaacgccgaugaagcagucgcaagaggaugugcacuccaaugugcaauccuuaguccagccuuuaaaguaagagaguuuuccguaacugacgcaguaccauuuccuauuucucuaauuuggaaucaugauucagaagauacagaaggaguacaugaaguauuuucaagaaaccaugcagcaccguucaguaaaguauugacauuuuugcgaagaggcccauucgaacuagaagcauuuuacucagauccacaagggguaccauaccccgaagcaaaaaucggaagauuuguuguacaaaacgucucagcacaaaaagauggagagaaaagcagaguaaaaguaaaaguacgaguaaacacucauggaauauucacaauaucuaccgcaagcaugguagaaaaagucccaacagaagaaaacgaaaugucaagcgaagccgauauggaaugcuugaaucaacgaccgcccgaaaacccagauacugacaaaaacguacaacaagauaauucagaagcuggaacucaaccacagguacaaaccgaugcacaacaaaccucacaaagcccaccaagucccgaacuuacguccgaagaaaacaaaauaccagacgcagauaaagcaaacgagaagaaagucgaccaaccaccagaagcaaagaaaccgaaaauaaaaguagugaauguagaauuaccaauagaagccaaccuaguguggcaacuaggaaaagaccuccuaaacauguacauugaaacagaaggaaaaaugauaaugcaagauaaauuggagaaagaaagaaacgacgccaaaaaugcaguagaagaauacgucuacgaguucagagauaaacuaugugguccauaugaaaaauucauaugugaacaagaucaccaaaauuuccuuagauuacuuacagaaacugaagauugguuauaugaagaaggcgaagaucaagcaaaacaagccuacgucgacaaauuagaagaauuaaugaaaauaggaacaccagugaaaguaagauuccaagaagcagaagaaagaccaaaaauguuugaagaauuaggucagcgcuuacaacauuacgccaaaauugcagcagauuuuagaaauaaagaugaaaaauauaaccauauugacgaaucagagaugaagaaaguagaaaaaucagucaaugaaguaauggaauggaugaauaauguaaugaacgcucaagcaaagaaaucauuagaccaagacccaguagugagagcccaagaaauaaaaacaaaaauaaaagaauuaaauaauacaugugaaccuguuguuacacaaccaaaaccaaaaauagaaaguccaaaacuagaacgaacgccaaacggaccaaauauagacaagaaagaagaagaucuagaagacaaaaauaacuucggugcagaaccuccacaucaaaacggagaauguuacccaaacgagaaaaacaguguaaacauggacuuagacuaa

SEQ ID NO: 1246 - RNA, 3000 nt, Artificial Sequence
  derived and/or modified CDS sequence (opt12) from Homo sapiens__NP_006380.1 __HsHYOU1
auggccgauaaaguaaggcgccaacguccaagaagaagaguauguugggcacuuguugcaguucuacuugcagacuuauuagcacuaagugauacacuugcagugaugaguguagaucuuggauccgaaagcaugaaaguagcaaucguaaaacccggaguaccaauggaaauuguacucaacaaagaaagucgaagaaaaacaccaguaaucguaacucuaaaagaaaaugaaagauuuuucggggauucugcagcaucuauggcaauuaaaaacccaaaagcuacauuacguuacuuccaacauuuacuugguaagcaagcagauaacccucacguugcucuauaucaggcucguuucccagaacaugaacucacauucgacccacaacgacagacaguacacuuucaaauaucaagccaauuacaauucucaccagaagaaguacuagguaugguacuaaacuauucgcgaaguuuagcagaagacuucgcugaacaaccaauaaaagaugccguaauaacagucccagucuucuuuaaccaagcagaaaggagagccguucuacaagcggcuagaauggcaggauuaaaaguauugcaacuaauaaaugacaauacugcgaccgcccuaaguuacggcguuuuucgaagaaaagauauaaauacaacagcccaaaacauaauguucuacgacaugggaaguggaucaacaguaugcacuauaguuacauaccaaaugguaaaaacgaaggaagcaggaaugcaaccacagcuacaaauaagaggaguaggauuugaucguacacuaggaggauuagaaauggaacuaagacuuagagaacgcuuagcaggauuguucaaugaacaaagaaagggccaacgcgccaaggaugugagagagaauccaagagcaauggcaaaauuacucagagaggccaaccgguuaaaaacaguguuaucagcaaacgcagaucauauggcucagauagaaggacugauggaugacguugauuucaaagcaaaagucacacgaguugaauuugaagaguuaugugcagauuuauucgaaagaguuccuggaccuguucaacaagcgcuacaaagugcagaaaugaguuuagaugagauugaacaagugauucuaguuggcggagcaacucgaguuccaagaguccaagaaguacuguuaaaagccguaggcaaagaagaauuagguaaaaauauaaaugccgaugaagcagccgcaaugggagccguuuaucaagcugcugccuuaucgaaagcauuuaaaguaaaaccauuuguuguaagggacgccgugguauacccaauauuagucgaguuuacacgagaagucgaagaagaacccggaauacauucauuaaaacauaacaaacgaguucuauuuucaagaauggggccguauccacaaagaaaaguaauaaccuuuaauagauacucccacgauuuuaauuuccacauuaauuauggagaucuaggauuuuuagguccggaagaucuucguguauuugggucacaaaauuugacaacagucaaacuaaaaggagucggagacucauuuaagaaauauccagauuaugaaucaaaaggaauuaaagcucauuucaauuuggaugaaaguggaguacucagucuagauaggguagaaagcguauuugaaacauuagucgaagacucagcagaagaagaaagcacucugacuaaacuaggaaauacaauaucaucacuauucggaggugggacgaccccagaugcaaaagaaaauggaacagauacuguacaggaagaagaagaaucaccagcagaaggaagcaaggaugaaccaggugagcaaguagaacuaaaagaagaagcagaagcaccaguagaagacggaagucaaccaccuccaccagaaccuaaaggagacgcgaccccagaaggagaaaaagcuacagaaaaggaaaauggagauaaaucagaagcucaaaaaccgucagaaaaagcugaagcaggaccagaaggcguugccccagcaccggagggagaaaagaaacaaaaaccagcaagaaaaagaagaaugguggaagaaaucgguguagagcuaguaguauuagacuuaccugacuuaccagaagauaaauuggcucaauccguucaaaaacuucaagaucuaacacuuagagacuuagaaaaacaagaacgagaaaaagcagcaaacucacuagaagcauuuauauucgaaacacaggauaaacuauaccaaccagaauaccaagagguuucaacugaggaacaaagggaagagaucucaggaaaacucagugcagccaguacaugguuggaagacgaaggaguaggcgcaacaacggucauguuaaaagaaaaacuagcggaacuuagaaaauuaugccaaggauuauuuuucagaguugaagaaagaaagaaauggccagaaagauuauccgcuuuggauaauuuauuaaaucauucaucaauguuucuaaaaggcgcaagauuaauaccugaaauggaucaaauauucacagaaguagaaaugacuacauuagaaaaaguaauaaaugaaacuugggcuuggaaaaaugcuacacuagcagaacaagcaaaauuaccagcuaccgaaaaaccaguacuacuaucaaaagacauagaggcaaaaaugauggcccuagacagagaaguucaauaucuacuaaauaaagcaaaauuuacuaaaccuagaccaagaccuaaagauaaaaaugguacacgagcugagccuccacucaaugcguccgcauccgaucaaggagaaaaaguuauacccccugccggacaaacagaagacgcagagccaaucucagaaccagaaaaaguggaaacaggaagugaaccuggagacacagaaccacuagaacucggagguccgggggcagaaccagaacaaaaagaacagaguacaggacaaaaacgaccgcuaaagaaugaugaguuauaa

SEQ ID NO: 1247 - RNA, 2199 nt, Artificial Sequence
  derived and/or modified CDS sequence (opt12) from Homo sapiens__NP_005339.3 __HsHSP90AA1
augccagaggaaacccaaacucaagaucaaccaauggaagaagaagaaguagaaacauuugcuuuccaagccgaaauagcacaacugaugucacuaauaauaaauacauuuuauucaaacaaggaaauuuucuugagagaacucauaaguaacucaagcgacgcacucgacaaaauaagauacgaaagccuaacagacccgucuaaacuggacucaggaaaagagcuacauauaaaccuaauaccuaacaaacaagauagaacacuaaccauaguagauacaggaauagguaugacaaaagcagauuuaauaaacaaccuaggcacaauagccaaguccggaaccaaagcguucauggaagcgcuccaagccggcgcagauaucagcaugauaggacaauucgggguaggauucuacucagcauaucuaguagcagaaaaaguaacgguuaucaccaaacauaaugacgacgaacaguacgcaugggaaaguucggcaggcggcucauucacagucagaaccgacaccggggaaccaaugggaagagguacaaagguaauacuacaccuuaaagaagaccaaacagaauaccuagaagaaaggagaauaaaagaaauaguaaaaaaacacucacaauucauuggauacccaauaacauuauuuguagaaaaagaaagagacaaagaaguaagcgacgaugaagcagaagaaaaagaagauaaagaagaagagaaagaaaaagaagagaaagaaagugaagacaaaccagaaauagaagacguuggcucggaugaagaagaagaaaaaaaagacggagauaaaaaaaaaaaaaaaaaaauaaaagaaaaguacauagaucaagaagaacucaauaaaacaaagccaauauggacacgaaauccagaugacauaacuaacgaagaauacggcgaauuuuauaaaaguuuaacaaacgacugggaagaccaucucgcaguaaaacauuuuucaguagaaggacaacuagaauucagagcacuauuauucguccccagaagagcaccauuugauuuauuugaaaauagaaaaaaaaaaaacaacauuaaacuauauguaagaagaguuuucauaauggacaauugugaagaauuaauaccagaauaucuaaacuuuauaagaggggugguugacagcgaagauuuaccgcuuaacauaagccgagaaauguugcaacagaguaaaauacuaaaaguaauaagaaaaaaucuaguaaaaaaauguuuagaauuauuuacggaauuagcagaggacaaagaaaacuacaagaaauuuuacgaacaauucaguaaaaacauaaaauuaggcauacacgaagacagucaaaauagaaagaaacuaucagaacuacuaagauauuacacaagugcaaguggagaugaaaugguaagcuuaaaagacuacuguacaagaaugaaggaaaaccaaaaacauauauauuauauaacaggagaaacaaaagaucaaguagcaaacagugccuucguagaaagacuaagaaaacaugggcuagaaguaauauacaugauagaaccuauagaugaauauugcguacaacaacuaaaagaauuugaaggaaaaacccuaguaucgguaacaaaggaaggauuagaauuacccgaagaugaagaagaaaaaaagaaacaagaagaaaaaaaaacaaaauucgaaaaccuaugcaaaauaaugaaagauauacuagaaaaaaaaguugaaaaaguugugguaucuaacagauuaguaacuucaccaugcugcaucguaacuaguacguauggcuggacagcaaacauggaaagaauaaugaaagcacaggcuuugagagauaacaguaccaugggauauauggcagcaaaaaaacaucuagaaauuaauccagaccacaguauaauagaaacguuaagacagaaagcagaagcggacaagaacgacaaaucaguaaaagaccucguuauacuacucuaugaaacagcacuacuaagcaguggauuuucauuagaagauccacagacacacgcaaacaggauuuauagaaugauuaaacuuggacucggaauagacgaagaugacccaacagcagaugacacaagugcagcagugaccgaagaaaugccaccguuagaaggggaugacgacacuaguagaauggaagaaguagauuaa

SEQ ID NO: 1248 - RNA, 339 nt, Artificial Sequence
  derived and/or modified CDS sequence (opt12) from Homo sapiens__NG_005218__HsHSP90AA3P
auggacagcucaaaacuagacucaggaaaaggacuacacauaaaccuaguaccaaacaaacaaaaccaaacacuaacaauaguagacacaagaauaggaaugacaaaaacagaccuaauaaacaaccuaggaacaguaacaaaaagcggaacaaaagcauuuauggaagcacuacaagcagacgcagacauaagcaugauaggacacuucggaguaggauucuacucagcauaccuaguagcaaaaaaaguaacaguaauaucaaaacacaacaacgacgaacaauacacaugggaaucaagcgcaggaggaagcuucacaguaagaacagacgaauaa

SEQ ID NO: 1249 - RNA, 2175 nt, Artificial Sequence
  derived and/or modified CDS sequence (opt12) from Homo sapiens__NP_031381.2__HsHSP90AB1
augccagaagaaguacaccauggagaagaagagguagaaacauucgcauuucaagcagagauugcacaacuaaugaguuugauaauaaauacauuuuauagcaacaaagaaauauuuuuaagagaacuaauuucuaacgcaagcgacgcauuagacaaaauacgauaugagagucuaacugauccaaguaaacuagauaguggaaaggaacuuaaaauagacauaauaccgaauccacaagaacgaacauugacacuaguggacacaggcauaggaaugacaaaggccgaucuaauaaauaaucuuggcacaauagcaaaaagugggacuaaagcguuuauggaggcacuacaagcgggagcagauauaaguaugauaggacaauuuggaguuggauuuuauucagcauacuuaguggcagaaaaaguugucguaauaacaaaacauaacgaugacgaacaauacgccugggaaucaagcgcaggaggaaguuuuacaguaagagcagaccacggugaaccaaucggaaggggaacaaaaguaauacuacacuuaaaagaagaucaaacagaguauuuggaagaacgaaggguaaaagaaguaguaaaaaaacacucacaauuuauaggauauccgauaacauuguaccuagaaaaggaaagggaaaaagaaauaagcgaugacgaagcagaagaagaaaaaggggaaaaggaagaagaagauaaagacgaugaagaaaaaccaaaaauagaggacguaggaagugaugaagaagaugacucaggaaaagauaaaaaaaaaaaaacuaaaaaaaucaaagaaaaauacauagaucaagaagaauuaaauaaaacaaagccaauauggaccagaaacccagacgacauaacacaagaagaauauggcgaauucuauaaaagucuaacaaaugacugggaagaccaccuagcaguaaaacacuucagcgucgaaggucaauuagaauucagagcucuacuauuuauaccaagaagagcaccauucgaucuauucgaaaacaaaaaaaaaaaaaauaauauaaaacucuacguccgcagagucuuuauaauggacucgugcgacgaacuaaucccagaauauuuaaacuuuaucagagggguaguagacucagaggaccucccacuaaacauaagcagggaaaugcuucaacaaagcaaaauccuaaagguaaucagaaaaaauaucgucaaaaaaugccucgaacuauuuucagaauuagccgaagauaaagaaaacuacaaaaaauuuuacgaagcauucagcaaaaauuuaaaacuaggcauacacgaagacuccacaaacagaagaagauuaagcgaauuacuaagauaucacacaucacagucgggagaugaaaugacaucuuuaucagaguacguaagccgaaugaaagaaacacaaaaaaguauauacuauaucacuggagaaaguaaagaacaaguagcgaacucagcauuuguagaacguguaagaaaacgaggauuugaaguaguauacaugacagaaccaauugacgaauacuguguccaacaauuaaaagaauucgaugguaaaaguuuaguuucaguaacaaaagaaggauuagaauuaccugaagacgaagaagaaaagaaaaaaauggaagaaagcaaagcaaaauuugaaaaucuaugcaaacucaugaaagaaauauuagacaaaaaaguggaaaaagucacgauuuccaacagacucguaagcucacccuguugcauaguaacaucuacauaugguuggacugcaaacauggaaagaauaaugaaagcacaagcuuugagagacaauucaacaaugggauauaugauggcaaagaaacauuuagaaauaaacccagaccauccaaucguagaaacacugagacaaaaggcagaagcagacaaaaaugauaaggccgugaaagaucuugugguacuucuauucgaaacagcccuacugaguaguggauucaguuuagaagacccacaaacacacuccaauagaaucuaucgaaugaucaaacuaggauuaggaauagacgaggaugaaguagcugcagaagaaccaaaugcagcaguaccagaugaaauaccaccgcuagaaggagaugaagaugcgagccgcauggaagaaguagacuag

SEQ ID NO: 1250 - RNA, 2412 nt, Artificial Sequence
  derived and/or modified CDS sequence (opt12) from Homo sapiens__NP_003290.1__HsHSP90B1
augagagcacuguggguauuaggauuaugcugcguauuacuaacguuuggaucagugagagcagaugaugaagucgauguugauggaacaguagaggaagaccucgguaaaaguagagaaggcucaagaacugacgacgaaguuguucaaagagaagaagaagcgauacaauuagauggauuaaaugcaucacaaauaagagaacuucgugaaaaaucagaaaaauuugcguuucaagcagaaguaaacagaaugaugaaacuaauaauaaauucauuauacaaaaauaaagaaauauuuuuaagagaacuuauuucaaacgcaagcgaugcauuggauaaaauaagauugauaagucuaacagaugaaaacgccuuaucaggaaaugaagaauuaacaguaaaaauaaaaugcgauaaagagaaaaauuuacuacauguaacugacacgggaguaggaaugacaagagaagaauuagucaaaaauuugggaacaauagccaaaucaggaaccucagaauuucuaaacaaaaugacugaagcacaagaagacgggcaaucaacaagugaauuaauaggacaauuugggguaggauucuacagugcguuuuuaguagcggacaagguaauaguaaccaguaaacauaauaacgacacacaacauauaugggagucagacaguaacgaguucaguguaaucgcagacccgagagguaacacauugggacgaggaacaacuauaacguuaguacucaaagaagaggcuucagauuaccuagaacuggauacaauaaagaaucucgugaagaaauauucccaauucaucaacuucccaauauacguauggaguucaaaaacagaaacaguggaggaaccaauggaagaagaagaagcagcuaaagaagagaaagaagaaucagaugaugaagcugcagucgaagaagaagaagaagaaaagaaaccgaaaacuaagaaaguagagaaaacaguuugggauugggaacuaaugaacgacauaaaaccaauuuggcaacgaccgucaaaagaaguggaagaggaugaauauaaagcauuuuacaaaucauucucuaaagaaucagaugauccaauggcauauauacauuuuacagcagaaggggaaguaacauuuaagucaauccuauuuguaccaaccucagcaccgaggggauuauucgacgaauauggaagcaagaaaucggauuauauaaaacuauauguaagaaggguauuuauaaccgaugauuuccacgauaugaugcccaaauaucuaaauuuuguaaaaggaguaguagacagcgacgaucuaccauuaaauguaucucgagaaacacuccaacagcauaaacuccuaaaaguuauaaggaagaaauuagucaggaaaacacucgauaugauaaagaaaauagcagaugauaaauauaacgacacauuuuggaaagaauuugguacaaauauuaaauuaggaguaaucgaagaucacaguaacagaacgagauuagcaaaacuauugagauuucaaaguucacaccacccaacagauauaacuagcuuagaccaauauguggaaaggaugaaagaaaaacaagauaaaauuuauuuuauggcagggaguaguaggaaagaagcugaaaguagccccuucguggaaagauuauuaaagaaaggauaugaaguaauauaucuaacagaaccaguagacgaauauuguauacaagcacuaccagaguucgacggaaaaagauuucaaaauguagccaaagaaggaguaaaauuugacgagucagagaaaacaaaagaaagcagagaagcaguagaaaaagaauuugaaccucuacuuaacuggaugaaagauaaggcuuuaaaagauaaaauagaaaaagcaguaguaagccaaagacuuacagaaucaccaugugcauugguagcaagucaauauggauggaguggaaacauggaaaggauaaugaaagcacaagcguaccaaacaggaaaagauauaucaacgaauuacuaugccagccagaaaaagacauucgaaauaaauccaagacacccauuaauaagagacauguuaagaagaauuaaagaagaugaagaugauaaaacuguauuagaccuugcaguaguuuuguucgaaacggcaacauuacgaaguggcuaucugcuaccggauacaaaagcauauggagacagaauagaacgaauguuaagacuaucauuaaauauagauccugaugccaaaguagaagaagaaccagaagaagaaccagaagaaacggcagaagauacaacagaagacaccgaacaagacgaggaugaggaaauggacguaggaacugaugaagaagaagaaacagcaaaagaaagcacugcagaaaaagaugaacuauaa

SEQ ID NO: 1251 - RNA, 2115 nt, Artificial Sequence
  derived and/or modified CDS sequence (opt12) from Homo sapiens__NP_057376.2__HsTRAP1
auggcaagagaacuaagagcauuacuauuauggggccgccgacuaagaccucucuuaagagcuccagcacuagcagccguaccaggcggaaagcccauacuauguccaaggagaacaacugcacaacuaggaccaagaagaaauccugcuuggagucugcaagcagguaggcuuuucuccacacaaacagcugaagacaaagaagaacccuuacauucaauaauaucuaguacagaaucuguucaaggaaguaccucaaaacaugaauuucaagcagaaacaaaaaaacuacuagacauaguagcacgaucacuauauagugaaaaagaaguuuuuauaagagaauuaauaaguaacgccucagaugcacuagaaaaauuacgacacaaauuaguaagcgauggucaagcuuuaccagaaauggaaauacauuuacaaacuaacgcugaaaaaggaaccauuacaauacaagauacagguauaggaaugacacaagaagaacuuguuaguaaucuaggaacaauagcucgaucaggaucaaaagcauucuuagacgcauuacaaaaccaagcagaagcuagcucgaaaauaauuggucaauuuggaguaggauuuuauucagcauucaugguugcagacaggguagaaguauauucacguagcgcugcaccaggaucauuagguuaccaauggcuaucagacgguucaggcguuuucgaaaucgcagaagcaucaggaguaagaacaggaacaaaaauaauaauacaccuaaaaagugauuguaaagaguucucuagugaagcaagaguuagagauguaguaacaaaauauucuaauuuuguaucguuuccacuauacuuaaauggacgaagaaugaauacacuacaagcaauauggaugauggauccaaaagauguacgagaauggcaacaugaagaauucuacagauacguugcacaagcacaugacaaaccaagauauaccuuacauuauaaaaccgacgcaccuuuaaauauaagaucaaucuuuuauguuccagacaugaaacccucuauguucgacguaucaagagaacuaggaaguaguguggcccuuuauucaagaaaaguccuaauucaaacaaaagcaacagauauauuaccuaaaugguugagauuuaucagaggaguaguagauucagaagacaucccauuaaaucuaaguagggagcuauuacaagaaucagcauuaauaaggaaacuaagagacguuuuacaacaaagacuuauaaaauuuuuuauagaucaaagcaaaaaagaugcagaaaaauacgcuaaauuuuucgaagacuaugggcuauuuaugagagagggaauaguaacagcaacugaacaagaaguaaaagaagacauugcaaaacuacucagauaugaaaguagugcucugccuagcggucaauuaacaagucugucugaauaugcuucacgaaugagggccggaacaagaaauauauacuacuuaugcgcaccaaaccgacacuuagcagaacauucacccuauuaugaggcaaugaaaaagaaagacacagaaguucuauuuugcuuugaacaauucgacgaacucacuuuacuacaccuaagagaauuugacaaaaaaaaauuaauuagcgucgaaacagauauagugguugaccauuauaaagaagaaaaauuugaggauagaucuccagcggccgaaugccuuucagaaaaagaaacagaagaacuuauggccuggaugagaaacguucuagggucuagaguaacaaaugugaaaguaacauuaagauuagacacacauccggcaaugguaacaguucuagaaaugggagcggcaagacacuuuuuaagaaugcaacaauuggcaaaaacacaggaagaaagagcacaauuauuacagccaacacucgaaaucaacccuagacacgcauuaauaaaaaaacuaaaucaacuaagagcaucagaaccaggacuugcacaauugcuagucgaucaaauauacgaaaaugcaaugauagcagcaggauuaguagaugauccacgagcgaugguaggacgacuaaaugaguuauuaguaaaagcauuagaaagacacuaa

SEQ ID NO: 1252 - RNA, 462 nt, Artificial Sequence
  derived and/or modified CDS sequence (opt12) from Homo sapiens__NP_000609.1__HsIGF1
augggaaaaauaucaucacuaccaacacaacuauucaaaugcugcuucugcgacuuccuaaaaguaaaaaugcacacaaugucaucaucacaccuauucuaccuagcacuaugcuuauuaacauucacaucaucagcaacagcaggaccagaaacacuaugcggagcagaacuaguagacgcacuacaauucguaugcggagacagaggauucuacuucaacaaaccaacaggauacggaucaucaucaagaagagcaccacaaacaggaauaguagacgaaugcugcuucagaucaugcgaccuaagaagauuagaaauguacugcgcaccacuaaaaccagcaaaaucagcaagaucaguaagagcacaaagacacacagacaugccaaaaacacaaaaagaaguacaccuaaaaaacgcaucacgaggaucagcaggaaacaaaaacuacagaauguaa

SEQ ID NO: 1253 - RNA, 543 nt, Artificial Sequence
  derived and/or modified CDS sequence (opt12) from Homo sapiens__NP_000603.1__HsIGF2
augggaauaccaaugggaaaaucaaugcuaguacuacuaacauuucuagcauucgcaucaugcuguauagcagcauacagaccaucagaaacacuaugcggaggagaauuaguagauaccuuacaauuuguauguggagacagaggauucuauuucucaagaccagcaucaagaguaucaagaagaucaagaggaauaguagaagaaugcuguuucagaucaugugacuuagcauuacuagaaacauauugcgcaacaccagcaaaaucagaacgagauguaucaacaccaccaacaguacuaccagauaacuuuccaagauacccaguaggaaaauuuuuccaauacgauacauggaaacaaucaacacaaagacuaagaagaggacuaccagcacuacuaagagcaagaagaggacacguacuagcaaaagaacuagaagcauuuagagaagcaaaaagacauagaccacuaauugcauuaccaacacaagauccagcacacggaggagcaccaccagaaauggcaucaaacagaaaauaa

SEQ ID NO: 1254 - RNA, 639 nt, Artificial Sequence
  derived and/or modified CDS sequence (opt12) from Homo sapiens__NP_000591.1__HsIL6
augaacucauucucaacaucagcauucggaccaguagcauucucacuaggacuacuacuaguacuaccagccgcauucccagcaccaguaccaccaggagaagacucaaaagacguugcagcaccacacagacaaccccuaacauccucagaaagaauagacaaacaaauaagauacauacuagacggaauaucagcacuaagaaaagaaacaugcaacaaaucaaacaugugcgaaucaucaaaagaagcacuagccgaaaacaaccuaaaccuaccaaaaauggcagaaaaagacggaugcuuccaaucagguuucaacgaagaaacaugccuaguaaaaauaauaacaggacuccuagaauucgaaguauaccuagaauaccuacaaaacagauucgaaucaucagaagaacaagcaagagcaguacaaaugucaacuaaaguacuaauacaauuccuacaaaaaaaagcaaaaaaccuagacgcaauaacaacaccagacccaacaaccaacgcaucacuacucacaaaacuacaagcacaaaaccaauggcuacaagacaugacaacacaccuuauacuacgaucauucaaagaauuccuccaaucaucccuccgagcccucagacaaauguaa

SEQ ID NO: 1255 - RNA, 1281 nt, Artificial Sequence
  derived and/or modified CDS sequence (opt12) from Homo sapiens__NP_002183.1__HsINHBA
augccauuacuaugguuaagaggauuuuuauuagcuaguugcuggauaauagucagaucaagcccaacgccaggaagcgaaggacacucagcagcuccagacuguccaaguugugcauuagcagcauuaccuaaagauguuccuaauucacaaccagaaaugguagaagcaguaaaaaaacauauauuaaauauguuacacuuaaaaaaaaggccagacguaacacaaccaguuccaaaagcagcauuauugaacgcaauaagaaaauuacacguaggaaagguaggggaaaacggauauguagaaauagaagacgauauaggaagaagagcagaaaugaaugaacuaauggaacaaacaagugaaauaauaacuuucgcagaaagcggaacagcaagaaaaacacuacacuuugaaauaaguaaagaagggagcgauuuaucaguaguagaaagagcagaaguaugguuauuucuaaaaguaccaaaagcaaauagaacuagaacaaaaguaacaauaagacuauuccaacaacaaaaacauccacaaggaucuuuagauacuggagaagaagcggaagaaguaggacuuaaaggagaaagaucagaacuacuauuaagugaaaaaguaguagaugcacgaaaaaguacauggcauguauuuccaguauccaguucaauacaaagacuauuagaucaaggaaaaagcagcuuagacguuagaauagcuugugaacagugucaagaaucaggagcaaguuuaguuuuacuaggaaaaaaaaaaaaaaaagaagaagagggagaagguaaaaaaaaaggugggggagaaggaggagcaggagcugaugaagaaaaagaacaaucacauagacccuucuuaaugcuacaagcaagacaaucagaagaucauccacauagaagaagacgaagaggcuuagaaugugauggaaaaguaaauauauguugcaaaaaacaauucuuuguaucauuuaaagauauaggauggaaugauuggauaauugcacccagcgguuaucaugcaaacuauugugaaggagaaugcccaucacacauagcgggaacuaguggaaguucauuaagcuuucacucaacugugauaaaucauuaucguaugagaggccauucgccguuugcaaauuuaaaaucauguuguguaccaacaaaacuaagaccaaugaguauguuauauuaugacgauggacaaaauauaauaaagaaagacauacaaaauaugauaguagaagaauguggauguaguuaa

SEQ ID NO: 1256 - RNA, 1224 nt, Artificial Sequence
  derived and/or modified CDS sequence (opt12) from Homo sapiens__NP_002184.2__HsINHBB
auggacggauuaccuggcagagcuuugggagcagcaugucuauuacuauuagcugcaggaugguuaggaccagaagcauggggaucgccaacaccaccaccaacaccagcugcaccaccaccaccaccaccuccugguucaccaggcgggucucaagacaccuguacaagcuguggaggcuuuaggaggccagaagaacuaggaagaguagauggagacuuuuuagaagcuguaaaaagacauauacuuaguagacuccaaaugagaggaagaccaaauauaacacaugccguaccaaaagcugcaaugguaacugcacuucgaaaacuacaugcaggaaaaguaagagaagauggaaggguagaaauaccucaucuagauggacaugcaucaccaggagcagauggacaagaaagaguaucagaaauaauaucuuuugcagaaacagauggauuagcgucaucaagaguaagauuauacuuuuucauaucaaacgaaggaaaucaaaauuuauuuguaguacaagcgagcuuaugguuauaucuaaaauuauuacccuauguuuuagaaaaaggaucaagacgaaaaguaagaguaaaaguuuauuuucaggaacaaggacacggagacagauggaauaugguagaaaagagaguagacuuaaaaagaaguggauggcauacauucccacuaacugaagcaauucaagcacuauuugaaagaggagaaagaagauuaaaccuagaugugcaaugugauucuugucaagaauuagcagucguaccaguauuuguugauccaggagaagaaagucauagaccauuugugguaguucaagcaagauuaggagauaguagacauaggauaagaaaaagaggauuagaaugugauggaaggacaaauuuauguuguagacaacaauucuuuauugacuuuagauuaauaggauggaaugauuggauaauagcacccacaggauauuaugggaauuauugugaaggaaguuguccagcauacuuagcaggaguacccggaucagcaaguuccuuucauacagcaguugucaaccaauaucgaaugagaggguuaaauccagguacaguaaacucauguuguauaccaaccaaacuaaguacuaugagcauguuauauuuugaugaugaauauaacauuguaaaacgagauguaccaaacaugauaguagaagaauguggaugugcauaa

SEQ ID NO: 1257 - RNA, 3459 nt, Artificial Sequence
  derived and/or modified CDS sequence (opt12) from Homo sapiens__NP_000623.2__HsITGAM
auggcauuaagaguauuacugcugacagcuuugacucuaugucacggcuucaaccuagacacagaaaaugcuaugaccuuucaagaaaaugcacgagguuucggacagucugucguccaacuacaaggaucaaggguuguagucggcgcaccccaagaaauuguagcagcaaaucaaagaggcuccuuauaucaaugcgacuacucaacagguagcugcgaaccaauacgucuucaaguucccguugaagcagugaacaugucacuugguuuaaguuuagcagcuacaacaagcccaccucaacuauuagcuugcggccccacaguacaccaaaccuguagcgaaaauacuuauguuaaaggauuguguuuccuauucgguuccaauuuacgacagcaaccucaaaaauucccugaagcacuucguggaugcccccaagaagauagcgauauagcauuuuuaaucgacgguuccggauccauaauaccccaugacuuccggagaaugaaagaauuuguaaguacagugauggaacaauugaagaaaucuaaaacucuauuuucucugaugcaauauagugaagaauuuaggauacacuuuacuuuuaaagaauuucaaaacaacccaaauccgagaucguuaguaaaaccgauuacucagcuuuuaggacgaacucauacagcuacuggaauacguaaaguaguaagagaacucuucaacauaacaaauggcgcacguaaaaaugcuuuuaagauauuaguaguaauuacagacggagaaaaauucggagauccucuaggauacgaagacguaauaccagaagcugauagagagggcguaauaagauauguaauaggcguuggagaugcauucagaagcgagaaaagcagacaagaauugaacacaaucgcaucuaaacccccacgagaucauguauuccaggucaauaauuucgaagcucuaaaaacaauacaaaaccaacugagagagaaaauauuugcaauagaagggacacaaacaggcucaucgagcucauuugaacaugaaaugagccaagaaggauuuucagcagcaauaaccucaaacggaccacuauuauccacuguuggaaguuaugauugggcagggggagucuucuuauacacguccaaagaaaaaucuacauuuauaaacaugaccagaguugacagugacaugaaugacgcuuaccucggcuaugcagcagcuauuauacuacgaaauagaguacaaucacuuguuuuaggggcaccacgguaccaacauauuggucuaguugccauguuccgacaaaauacaggaaugugggaaucaaaugccaauguaaaaggaacacaaauaggagcuuauuucggcgcaucauuauguuccguagauguagacucaaacggaucaacagauuuaguccugauuggugccccacauuauuaugaacaaacaagagguggucagguaaguguuuguccgcucccacgagguagagcccgauggcaaugcgaugcuguacuuuauggagaacaaggacagccauggggaagauucggggcagcacuaacaguacuaggugacgugaauggggauaaacuaaccgauguagcaauaggugcaccaggcgaagaagacaauagaggagcaguauacuuauuucacggaacaucaggcucaggaauaagcccuucgcacucacaaagaaucgcuggcaguaaauuaagcccucgccuucaauacuuuggacagucgcuuaguggaggccaagaucuaacaauggacggauuaguugaccuaacgguaggagcacagggucauguccuacuauuacgaucccaaccuguuuugcgugucaaagcaauuauggaguucaauccaagagaaguagcacgaaauguuuuugaaugcaaugaucaaguaguuaaaggcaaagaagcuggagaaguacggguuugucuacauguacaaaaauccacacgagaccgucuacgcgaaggucaaauacaaucaguaguuaccuaugaucuugcacuugacucuggaagaccucacucuagggcuguauuuaaugaaacuaaaaauuccacgagacgacaaacacaaguacuaggucuuacccaaacuugugaaaccuuaaagcuacaacucccaaauugcauagaagauccaguaaguccaauaguacugagacucaauuucucccuugucggaaccccucuaagcgcguucggaaacuuacgaccaguacuagcagaagacgcacagagacuuuuuacugcacuuuuuccauucgagaaaaauugcggaaacgacaauauaugucaagacgacuuaucuauaacauuuucauucaugucauuagauuguuugguaguuggagguccccgggaguucaaugucacaguaacagucagaaaugauggagaagauucuuaccgaacacaaguuaccuuuuucuuuccacuugauuuaagcuaccgaaaagucucuacacuacagaaccaacgaagucaacgcucguggagacuugcaugugaaagcgcuucuucaacugaaguuucaggugcuuugaaaucaacaucauguaguauaaaccaucccauuuuuccggaaaauucugaaguuacauuuaacauuacguucgaugucgauucaaaggcuucucuugguaauaaauuacuauugaaagcaaaugucacauccgaaaauaauaugccaaggaccaacaaaacagaguuccaacuugaauuaccuguaaaauaugcugucuacaugguuguaacaucacauggaguaucuaccaaauaucucaauuuuacagcaucugaaaauacuucacgaguaaugcaacaccaauaccaaguaucaaauuuaggacaacgaucacucccaauuagucuuguuuuucuagucccagucagauugaaucaaacaguaaucugggauagaccacaaguaacauuuucugaaaacuuaagcaguacaugucauacaaaagaacgcuuaccaucccauuccgacuuucuugcugaauuaagaaaagcaccugucgucaauugcucaaucgcagugugccaacgaauacaaugugacauucccuucuuuggcauacaagaagaguuuaacgcuacacuaaagggcaauuuauccuuugacugguacauaaaaacaucacauaaucaucuauuaauuguaucaacagcagaaauauuauuuaacgacagcguauucacacuucuccccgggcaaggagcuuuugucagaagucaaacagaaacaaaaguagaaccauucgaaguuccaaaccccuuaccucucauaguagguuccucgguagguggauuacuacugcuugcauuaauuacagccgcuuuauauaaacuuggauucuuuaagagacaauauaaggauaugaugucugaaggaggaccuccuggcgcagaaccacaauaa

SEQ ID NO: 1258 - RNA, 1404 nt, Artificial Sequence
  derived and/or modified CDS sequence (opt12) from Homo sapiens__NP_002415.1__HsMMP8
auguucucacuuaaaacucucccauucuuacuacuacuacacguccaaauaucaaaagccuuccccguauccucaaaagaaaaaaauacuaaaacaguucaagacuaccucgaaaaauucuaccaacuaccuucaaaccaauaccaaucaacaagaaaaaaugguacuaaugucauagucgaaaaauuaaaagaaaugcaaagauuuuuuggacuuaacguuacaggaaaaccuaacgaagaaacccuagacaugaugaaaaaaccacgaugcggagucccagacucaggaggcuucaugcuaacaccaggaaauccaaaaugggaacguacaaacuuaacauaccgcauacgaaacuacaccccacaacuaagugaagcagaaguagaacgcgccauaaaagacgccuucgaacuauggucaguagcaagcccacucauauuuacuagaauaucacaaggugaagcugauaucaauaucgcauuuuaccaacgagaccacggcgauaacucaccauucgacggcccaaauggaauacuagcccacgcauuccaaccaggacaaggaauaggaggugacgcacacuucgacgcagaagaaaccuggacaaacacaucagcaaacuauaacuuauuucuagucgccgcacacgaauucggacacucacuagguuuagcacacucaucagacccaggcgcacuaauguaucccaacuaugcauucagagaaaccucaaauuauucauuaccucaagacgauauagacggaauucaagcaauauauggacuuucuucaaauccaauacaaccaacaggcccuucaaccccaaaacccugugaucccucacuaacauucgacgcaaucacaacucuacgaggagaaauuuuauucuuuaaagacagauauuuuuggagaagacacccacaacuacaaagaguagaaaugaacuucauaagcuuauucuggccaucacuaccaacaggcauucaagcagcauacgaagacuucgauagagaccuaauauucuuauuuaaaggaaaccaauauugggcacuaucagguuacgacauacuacaaggauacccaaaagacauauccaauuauggauucccaucaucaguacaagcaauagacgcagcaguauucuauagaucaaaaaccuacuucuucguaaaugaucaauucuggagauacgacaaccaacgccaauucauggaacccggauaucccaaaucaauaucaggagcauucccaggaauagaaucaaaaguagacgcuguauuccaacaagaacauuucuuucaugucuucuccggacccagguacuacgcauuugauuuaauagcccaaagaguaacacgaguagcaagaggaaauaaaugguugaauuguagauacggauaa

SEQ ID NO: 1259 - RNA, 2124 nt, Artificial Sequence
  derived and/or modified CDS sequence (opt12) from Homo sapiens__NP_004985.2__HsMMP9
augagccuuuggcaacccuuaguuuuaguuuuacuaguauuaggaugcugcuucgcagcuccuagacaaaggcaaucaacacuuguucucuuuccaggagacuuacgaacaaaucuaacagauagacaacuagcagaagaauacuuauauagauauggauauaccagaguugcagaaaugagaggagaaaguaaaucguuaggaccugcccuacuacuucuucaaaaacaauuaucauuaccagaaacaggagaacuagauucugcuacacuaaaagcaaugagaaccccuagaugcggaguuccagauuuaggccgauuucaaacauuugaaggagaccuaaaauggcaccaucauaauauaacuuauuggauacaaaauuacucugaagacuuaccgagagccguaauagacgaugcauucgcuagagcauuugcuuuauggucagcaguuacaccccuaacauuuacuagaguauauucaagagaugcugauauaguaauucaauuuggagucgcagaacauggugauggauauccauuugauggaaaagacggauuauuagcccacgcauucccaccugguccaggcauucaaggagaugcacauuucgacgaugacgaauuauggagcuuaggaaaaggaguaguaguaccuacacgcuuugggaaugcugauggagcagcaugccauuucccauuuauuuucgaagguagaucauacucugcaugcacuacagauggaagauccgauggauuaccuuggugcagcacaacagcuaauuaugacacugaugacagauuugguuuuuguccauccgaaagacuuuacacacaagacggaaaugcagaugguaaaccaugccaauuuccuuuuauauuucagggacaaucauauucagcuuguacaacagaugggagaagugauggauaccgcuggugugcaaccacugccaauuaugauagagacaagcuauuuggauucuguccuacaagagcagacucgacuguaauggguggaaauucagccggagaacuaugugucuucccauuuacauuuuuagguaaagaauacucuacauguacuucagaaggccguggugauggaagacuuuggugugcaacaacaucaaauuucgacucugacaaaaaauggggauuuuguccagaucaaggauacagcuuauuucuaguugcagcacacgaauuuggacaugcacuagguuuagaucacaguucaguaccagaagcauuaauguauccaauguauagauuuaccgaagggccuccccuucacaaagaugacguuaauggaauaagacacuuauacggacccagaccugaaccugaaccaagaccuccuacuacaacuacuccacaaccaacagccccaccaacaguaugcccaacgggaccgccaacaguacacccaagcgaaagaccaacugcuggaccaacaggaccacccagugcagguccaacugguccaccuacagcaggcccaucuacugcaacaacagucccauuaaguccaguggacgaugcaugcaacguuaacauauucgacgcaauugcagaaauuggaaaucaauuauaucuuuuuaaagauggaaaauacuggagguucucagaaggaagagguucaagaccacaagguccauuucuuauagcugauaaauggccagcucuccccagaaaauuagacucaguauucgaagaacgauuaaguaaaaaauuauucuucuuuucaggcagacaaguuuggguauauacuggugcaaguguacucggaccaagaagacuugauaaauuaggcuuaggggcagacguugcacaaguaacuggagcccuaagauccggucgaggaaaaauguuauuauucucaggaagaagauuauggagauuugauguuaaagcacaaaugguugauccaagaucagcaucagaaguagacagaauguuuccaggcguaccacuagauacucaugacguauuucaauaucgggaaaaagcguacuuuugucaagauagauuuuauuggagaguuucuucaagaucagaauuaaaccaaguagaucaaguuggauauguaacauaugauauccuacaaugcccagaagacuaa

SEQ ID NO: 1260 - RNA, 1416 nt, Artificial Sequence
  derived and/or modified CDS sequence (opt12) from Homo sapiens__NP_002418.1__HsMMP13
augcacccaggaguacuagcagcauucuuauucuuaucuuggacccacuguagagcacuaccucuaccuagcggaggagaugaagaugaccucucagaagaagaccuacaauucgcagaaagauaucuacgaucuuauuaccacccaacaaacuuagcaggaauacuaaaagaaaacgcugcaucaucaaugacagaaagacuaagagaaaugcaaucauuuuucggacuagaaguaacaggaaaauuagacgacaacacauuagacguaaugaaaaaaccaagaugcggaguaccagaugucggagaauacaacgucuucccaagaacauuaaaauggagcaaaaugaaccuaacauauagaauaguaaauuacacacccgacaugacacacucagaaguagaaaaagcauuuaaaaaagcauucaaaguaugguccgaugucacaccccuaaacuucacaagauuacaugacggaauagcagacauaaugauaucuuucggaauaaaagaacacggugacuucuacccuuucgacggaccaucaggacuauuagcacacgcauucccacccggaccaaauuacggaggagaugcacacuuugacgaugaugaaacuuggacaucaucaucaaaagguuauaacuuauuucucguagcugcccacgaauucggacacucacuagggcuagaccacagcaaagaccccggagcauuaauguuuccaauuuauacauauacaggaaaaagucacuuuaugcuaccggacgacgacguacaaggcauacaaucacucuacgguccaggagacgaagacccaaacccaaaacaccccaaaacaccagauaaaugcgacccaucacuaucauuagaugcaauaacaucauuaagaggagaaacuaugauuuucaaagacagauucuucuggagguuacacccccaacaaguagaugcagaacucuuucuaacaaaaucauuuuggccagaauuaccaaauagaauugacgcugcauacgaacacccaucacacgaccuaauauuuauauucagaggaagaaaauucugggccuuaaacggauaugacauacuagaaggauacccaaaaaaaauaucagaauuaggucuacccaaagaaguaaaaaaaauaucagcagccguccacuucgaagacacuggaaaaacauuacucuuuaguggcaaccaaguauggagauaugacgauacaaaccacauaauggauaaagacuacccaagauuaauagaagaagacuuuccaggaauuggagacaaaguagacgccguauacgaaaaaaauggauacauauacuuuuucaacggaccaauucaauucgaauauuccauauggucaaaccgaauaguuaggguaaugccagcaaacuccauauuaugguguuaa

SEQ ID NO: 1261 - RNA, 1068 nt, Artificial Sequence
  derived and/or modified CDS sequence (opt12) from Homo sapiens__NP_001286.1__HsCCR1
auggaaacaccaaauacaacagaagacuaugacacaacuacagaauucgacuauggcgacgccacaccaugccaaaaaguaaacgaaagagcauucggcgcacaauuauuaccaccuuuauacucauuaguauucguaauaggauuaguaggaaacauacuaguaguauuaguacuaguacaauacaaaagacuaaaaaacaugacauccauauaccuacuaaacuuagcaauaucugaccuacuauuccuauucacucuaccauucuggaucgacuauaaacuaaaagaugacuggguuuucggugacgcaaugugcaaaauccucucaggauuuuacuacacaggauuauacagcgaaaucuuuuucaucauacuauuaaccaucgaccgauaccuagccauaguacacgcaguauucgcacucagagccagaacaguaacuuucggcguaauaacaucaauaauaaucugggcauuagccauacucgcaucaaugccaggacuauacuucucaaaaacacaaugggaauucacccaucacacaugcucauuacacuucccucacgaauccuuaagagaauggaaacuauuucaagcccuaaaauuaaacuuauucggacuaguacuaccuuuacuaguaaugauaaucuguuacacaggaauuauaaaaauacuacucagaagacccaacgaaaaaaaaucaaaagccguaagauuaauauucguaauaaugauaauuuucuucuuauucuggacaccauacaacuuaacaauacucauuuccgucuuccaagacuucuuauucacucacgaaugcgaacaaucaagacaucuagaccuagcaguccaagucaccgaaguaauagcauacacacacugcugcguaaacccaguaauuuacgcauucguaggagaacgauucagaaaauaccuuagacaacuuuuucacagaagaguagcaguccaccuugucaaauggcuaccauuuuuaucuguagacagacuagaaagaguaucuucaacaucaccaucuacaggagaacacgaacucucugccggcuuuuaa

SEQ ID NO: 1262 - RNA, 636 nt, Artificial Sequence
  derived and/or modified CDS sequence (opt12) from Homo sapiens__NP_002598.4__HsPDGFA
augcgaacacuagccugccuauuacuacuaggaugcggauaccuagcacacguacuagcagaagaagcagaaauaccaagagaaguaauagaaagacuagcaagaucacaaauacacaguauaagagaccuacaaagacuacuagaaauagacucaguaggaucagaagacucacuagacacaucacuaagagcacacggcguacaugcaacaaaacacguacccgaaaaaagaccauuaccaauaagaagaaaaagaagcauagaagaagccguaccagcaguauguaaaacaagaacaguaauauacgaaauaccaagaagccaaguagacccaacaucagccaacuucuuaauauggccaccaugcguagaaguaaaaagaugcacaggaugcugcaacacaagcagcgucaaaugccaaccaaguagaguacaccaucgaucaguaaaaguagcaaaaguagaauacgucagaaaaaaaccaaaacuaaaagaaguacaaguaagacucgaagaacaccuagaaugcgcaugcgccacaacaagccuaaacccagacuacagagaagaagacacaggaagaccaagagaaucaggaaaaaaacgaaaaagaaaaagacuaaaaccaacuuaa

SEQ ID NO: 1263 - RNA, 726 nt, Artificial Sequence
  derived and/or modified CDS sequence (opt12) from Homo sapiens__NP_002599.1__HsPDGFB
augaacagaugcugggcacuauuccuaucauuaugcuguuacuuaagacuaguaucagcagaaggagauccaauaccagaagaauuauacgaaauguuaagugaucacucaauaagaagcuuugacgauuuacaaagacuacuacauggagauccaggagaagaagacggagcagaacuugaucuaaauaugacaagaucacacaguggaggagaauuagaaucacuagccagaggaagaagaagucuaggaucacucacaaucgcagaaccagcaaugauagcagaauguaaaacaagaacagaagucuucgaaaucucaagacgacuaauagacagaacaaaugcaaacuucuuaguauggccaccaugcguagaaguacaaagaugcucaggaugcugcaauaacaggaacguacaauguagaccaacacaaguacaacuaagacccgugcaaguaagaaaaauagaaauaguaagaaaaaaaccaaucuuuaaaaaagcaacaguaacacuagaagaucaucuagcaugcaaaugcgaaacaguagcagcugcaagaccaguaacaagaucaccaggaggaagccaagaacaaagagcaaaaacgccacaaacaagaguaacaauaagaacaguuagaguaagaagaccaccaaaaggaaaacauagaaaauucaaacacacacacgauaaaacagcauuaaaagaaacauuaggagcauaa

SEQ ID NO: 1264 - RNA, 1038 nt, Artificial Sequence
  derived and/or modified CDS sequence (opt12) from Homo sapiens__NP_057289.1__HsPDGFC
augucauuauucggauuauuacuuuuaacaucugcauuagcaggacaaagacaaggaacacaagcagaaucaaaccuaucaagcaaauuucaauuuucaucaaauaaagaacaaaauggcguacaagauccacaacacgaaagaauaauaacaguaagcacuaacggaucaauacacagcccccgauucccacauacauacccaagaaacacaguauuaguauggagauuagucgccguagaagaaaauguauggauacaacuuacauucgaugaaagauucggauuagaagaccccgaagacgacauaugcaaauacgacuucguagaaguagaagaacccucagacggaacaauauuaggucguuggugcggaucaggaacaguaccaggaaaacaaauaaguaaaggaaaccaaauaagaauucgauucguaucagaugaauacuuuccaucagaaccaggauucugcauccauuacaauauaguaaugccacaauuuacagaagcaguaucaccaagcguauuaccaccaucagcccuaccucuagacuuauuaaauaacgcaauaacagcauuuagcaccuuagaagacuuaauacgauacuuagaaccagaacgauggcaacuagaccuugaagaccuauacagaccaacauggcaauuacuaggaaaagcauucgucuuuggcagaaaaucaagaguaguagaucuaaaccuacuaacagaagaaguaagauuauacaguugcacaccuagaaacuucucaguaagcauaagagaagaacuaaaaagaacagacaccauauucuggccaggaugccuacuaguuaaaagaugcggaggaaauugcgcauguugcuuacacaacuguaacgaaugccaaugcguacccucaaaaguaacaaaaaaauaccacgaaguacuacaauuaagaccaaaaacaggaguaagaggacuccacaaaucacuuacagacguagcacuagaacaccacgaagaaugugacugcguaugcagaggcucaaccggaggauaa

SEQ ID NO: 1265 - RNA, 1095 nt, Artificial Sequence
  derived and/or modified CDS sequence (opt12) from Homo sapiens__NP_149126.1__HsPDGFD
augcauagauuaauauucguauacacacuaauaugugcaaacuucugcucaugcagagacaccagugcaacaccccaaagcgcaucaauaaaagcacuacgaaacgcaaacuuaagaagagacgaucuauauagaagagaugaaacaauacaaguaaaaggaaacggauacguacaaucaccacgauuuccaaauucauacccacgaaaccuauuauuaacauggcgacuacacucacaagaaaauacaagaauacaacuugucuucgacaaccaauucggacuagaagaagcagaaaaugacauaugcagauaugacuucguagaaguagaagacauaucagaaacuucaacaauaauaagaggaagaugguguggacacaaagaagucccaccaagaauaaaaucaagaacaaaccaaauaaaaauaaccuucaaaucagaugacuacuucguagcaaaaccgggcuuuaaaauauacuauagccuauuagaagacuuccaaccagcagcagcaucagaaaccaacugggaaucaguaacaagcucaauaucuggaguaucauacaacucaccaucaguaacagauccaacacuaauagcagacgcauuagacaaaaaaauagccgaauucgacacaguagaagaucuacuaaaauacuucaacccagaaucauggcaagaagaccuagaaaacauguaccuagacacaccaagauacagaggaagaucauaccaugacagaaaaaguaaaguagaccuagacagacuaaacgacgaugcaaaaagauacagcugcacaccaagaaauuacucaguaaacauaagagaagaacuaaaacuagcaaacguaguauucuucccaagaugcuuauuaguacaaaggugcggaggaaauuguggaugcggaacaguaaacuggagauccuguacaugcaacucaggcaaaacagucaaaaaauaccacgaaguacuacaauucgaaccaggacacauaaaaagaagaggcagagcaaaaacaauggcacuaguagacauacaacucgaucaccacgaaagaugcgacuguauaugcucaagcagaccaccacgauaa

SEQ ID NO: 1266 - RNA, 678 nt, Artificial Sequence
  derived and/or modified CDS sequence (opt12) from Homo sapiens__NP_003946.3__HsSOCS3
augguaacacacucaaaauucccagcagcaggaaugucacgaccucuagacacaucauuacgacuaaaaacauucucaucaaaaucugaauaccaacuaguaguaaacgcaguaagaaaauuacaagaaucaggauucuacuggucagcaguaacaggaggagaagcaaaccuacuauuaucagcagaaccagcaggaacauuccuaauaagagacucaucagaccaaagacacuucuuuacacuaucaguaaaaacccaaucuggaacaaaaaaccuacgaauacaaugugaaggaggauccuucucucuacaaucagacccaagaucaacacaaccaguacccagauuugacugcguacuaaaauuaguacaccacuacaugcccccacccggagcaccaucauucccaucacccccaacagaacccucaucagaaguaccagaacaaccaucagcacaaccacuaccaggcucaccaccaagaagagcuuauuacauauacuccggaggagaaaaaauaccacuaguucuaucaagacccuuaucaucaaacguagccacacuacaacaccuaugcagaaaaacaguaaacggacacuuagacucauacgaaaaaguaacacaacuuccaggaccaauaagagaauucuuagaucaauacgacgcaccauuauaa

SEQ ID NO: 1267 - RNA, 483 nt, Artificial Sequence
  derived and/or modified CDS sequence (opt12) from Homo sapiens__NP_003227.1__HsTGFA
augguaccaucagcaggacaauuagcauuauucgcauuaggaauaguauuagcagcaugucaagcauuagaaaauucaacaucaccauuaucagcagacccaccaguagcagcagcaguaguaucacauuuuaaugauugcccagauucacauacacaauucugcuuucauggaacauguagauuuuuaguacaagaagauaaaccagcauguguaugucauucaggauauguaggagcaagaugugaacaugcagauuuauuagccguaguagcagcaucacaaaaaaaacaagcaauaacagcauuaguaguaguaaguauaguagcauuagcagucuuaauaauaacauguguauuaauacauuguugucaaguaagaaaacauugugaauggugcagagcauuaauauguagacaugaaaaaccaucagcacuauuaaaaggaagaacagcauguugucacucagaaacaguaguauaa

SEQ ID NO: 1268 - RNA, 1173 nt, Artificial Sequence
  derived and/or modified CDS sequence (opt12) from Homo sapiens__NP_000651.3__HsTGFB1
augccaccaaguggauuaagacuacuaccauuacuauuaccacuauuauggcuacuaguauuaacaccuggaagaccagcugcaggccuaucaaccugcaaaacaauagacauggaacuaguaaaacgaaaaagaauagaagcaauaagaggccaaauacuaucaaaacuaagauuagcaucaccaccuucccaaggagaaguaccaccaggcccacuaccagaagcaguacuagcacuauacaacuccacaagagacagaguagcaggcgaaucagccgaaccagaaccagaaccagaagcugacuacuacgcaaaagaaguaacuagaguauuaaugguagaaacacacaacgaaaucuaugacaaauuuaaacaaucuacacauucuauauauauguucuucaauacaagcgaauuacgagaagcaguacccgaaccaguacuauuaucaagagcugaacuccgauuacuaagauuaaaacuaaaaguagaacaacacguagaacuauaccaaaaauauucuaauaauucauggagauaucuuagcaauagauuacuagcaccauccgacucaccugaauggcuaucauuugauguaacaggaguaguacgucaauggcuaucacgaggcggagaaauagaaggauuuagauuaagcgcucacugcagcugugacucaagagacaacacauuacaaguagacaucaacggauucacaacaggaagaagaggagaucuagccacaauacacggaaugaacagaccauuucuacuauuaauggcaacaccacuagaaagagcacaacaucuacaaucuucaagacacagaagagcauuagacacaaacuacugcuuuucaagcacagaaaaaaauugcugcgucagacaauuauauauagauuucagaaaagauuuaggcuggaaauggauacaugaaccaaaaggauaccacgcaaacuucugccuaggaccaugcccauacauuuggucauuagauacccaauacucaaaaguucuugcauuauacaaccaacacaacccuggagcaagugcagcaccauguugcguaccccaagcauuagaaccacuaccaauaguauauuacguuggccgaaaacccaaaguagaacaacuaucaaacaugauagucagaucauguaaauguucauaa

SEQ ID NO: 1269 - RNA, 1245 nt, Artificial Sequence
  derived and/or modified CDS sequence (opt12) from Homo sapiens__NP_003229.1__HsTGFB2
augcacuacugcguacucucagccuuccuaauacuacaccuaguaacaguagcauuaagcuuaucaacaugcucaacacuagacauggaucaauucaugagaaaaagaauagaagcaauaagaggccaaauacuaucaaaacuuaaauuaacaucaccaccagaagacuaucccgaaccagaagaaguaccaccagaaguaauaucaauauauaacucaacaagagaccuauuacaagaaaaagcaagccgaagagcagcagcaugcgaacgagaaaggucagacgaagaauacuacgccaaagaaguauacaaaauagacaugccacccuucuucccaucagaaaaugccauaccccccacauuuuacagaccauacuucagaaucguaagauucgacguaucagcaauggaaaaaaacgcaucaaaucuaguuaaagcagaauucagaguauucagacuacaaaacccaaaagcaagaguaccagaacaaagaauagaacuauaccaaauacuuaaauccaaagaucuaacaucaccuacacaaagauauauagacucaaaaguaguaaaaacuagagcagaaggcgaauggcuauccuucgacguaacagacgccguucacgaauggcuucaccacaaagaccgaaacuuaggauucaaaauaucacuucacuguccauguugcacauuuguccccucaaauaacuacauaauccccaauaaaucagaagaacucgaagcaagauucgccggaauagacggaacuagcacauauaccuccggagaccaaaaaaccauaaaaucuacaagaaaaaaaaacucuggaaaaacaccacacuuacuauuaaugcuacuacccucauaccgacucgaaucucaacaaacaaacagacgaaaaaaaagagcauuagacgccgcuuauuguuucagaaauguacaagauaacugcugccuacgaccacuauacauagauuucaaaagagaucuaggcuggaaauggauccaugaaccaaaaggcuauaacgcaaacuucugcgcuggagcaugcccauaccuauggucaucagacacacaacauucaagaguauuaucacuuuacaacaccauaaaucccgaagcaucagcaagccccuguugcguaucacaagaccuagaaccacuaaccauccuauacuauauaggaaaaacuccaaaaauagaacaacuaucuaauaugauaguaaaaucaugcaaaugcucuuaa

SEQ ID NO: 1270 - RNA, 1239 nt, Artificial Sequence
  derived and/or modified CDS sequence (opt12) from Homo sapiens__NP_003230.1__HsTGFB3
augaaaaugcacuuacaaagagcccuaguaguccuagcuuuacuuaacuucgcaaccguaucccuaagccuaucaacuuguacaacccuagacuuuggacacauaaaaaaaaaacgcguagaagcaauuagaggacaaauauuaucuaaacuaagauuaaccucaccaccagaaccaacaguaaugacacauguaccauaccagguauuagcacuauacaauucaacacgcgaacuacuagaggaaaugcauggagaaagagaagaaggaugcacacaagaaaacacagaaucagaauacuacgcaaaagaaauccauaaauucgacaugauacaaggauuagcagaacacaacgaacuagcaguaugcccaaaaggaauaacaucaaaaguauuuagauucaauguaucuucaguugaaaaaaauagaacuaaccucuuuagagccgaauuccgcguauuaagaguccccaacccaagcagcaaacgaaacgaacaaagaauagaacuauuccaaauacuaaggccagacgaacacauagcaaaacaaagauauauaggaggcaaaaauuuacccacaagagguacagcagaauggcuaucauucgauguaacagauaccguaagagaauggcuacuaagaagagaaaguaaucuaggccuagaaauaucaauacauuguccaugucacacauuccaaccaaacggagacauauuagaaaacauacacgaaguaauggaaauaaaauucaaaggaguagacaacgaagaugaucacggacgaggcgaucuaggcagauuaaaaaaacaaaaagaccaccacaauccacaccuaauauuaaugaugauaccaccacacagacuagacaauccaggccagggaggccaaagaaaaaaaagggcacuagacaccaacuacugcuucagaaaccuagaagaaaacugcugcguaagaccacuauacauugacuucagacaagaccuaggcuggaaauggguccaugaaccaaaaggauacuacgccaacuuuugcucaggaccaugcccauaccucagaucagcagacacaacccacucaacaguauuagguuuauacaacacauuaaacccagaagcaagugccuccccuuguugcguaccacaagaccuagaaccauuaaccauauuauauuauguaggacgaacaccaaaaguagaacaacuaucaaauaugguaguaaaaucaugcaaauguagcuaa

SEQ ID NO: 1271 - RNA, 1386 nt, Artificial Sequence
  derived and/or modified CDS sequence (opt12) from Homo sapiens__NP_001057.1__HsTNFRSF1B
auggcuccuguagccguaugggcagcucuagccguaggauuagaauuaugggcugcugcccaugcacuaccugcccaaguugcuuuuacaccauacgcaccagaaccugguucaacauguagauuaagagaauauuaugaucaaacugcucaaauguguuguucaaaauguagcccuggucaacaugccaaaguauucuguacuaaaacuucugauaccguaugugauucaugugaggauucaacauauacacaauuauggaauuggguaccagaauguuuaucauguggaucucgauguucaucagaucaaguagaaacacaagcuuguacaagagaacaaaauagaauauguacuuguagaccagguugguacugcgccuuaucaaaacaagaaggauguagacuaugcgccccacuacgaaaauguagaccaggauuugguguugcacguccaggaacagaaacaucagacguaguauguaaaccaugcgcucccgguacauucucaaauacaacaucauccaccgauauaugucgaccacaucaaauauguaauguaguagcaauaccaggaaaugcaucuauggacgcaguauguacaucaacaucacccacaagaucaauggcaccaggugcuguccaucuaccacaaccuguuucaacaagaucacaacauacacaaccuacacccgaaccauccacagcaccaaguaccucauuucuuuuaccuaugggaccaucaccaccugcagaaggaucaacaggagauuuugcacuuccaguaggacuaauaguuggaguaacugcacuaggauuauuaauaauuggagucguaaauuguguaauaaugacacaaguaaaaaaaaaaccauuaugcuuacaacgagaagccaaagucccucauuuaccagcagacaaagcuagaggaacccaaggaccagaacaacaacaccuacucauaaccgcaccuucaucaucuucaucaucuuuagaaucaucugcaucugcauuagauagaagagcacccacaagaaaucaaccacaagcaccuggaguugaagcuuccggggcaggugaagcucgagcuucaacaggaucuucagauucaucuccagguggucauggaacccaaguuaauguaacuugcaucguaaauguauguucaucaucagaucacucaucacaauguucaucacaagcaaguucaacuaugggagauacugacucaagcccaucggaaucaccuaaagaugaacaaguaccauuuaguaaagaagaaugugcauuuagaucucaacuugaaacaccagaaacuuuauuaggaaguacagaagaaaaaccacuaccauuaggaguacccgaugcagggaugaaaccuuccuaa

SEQ ID NO: 1272 - RNA, 513 nt, Artificial Sequence
  derived and/or modified CDS sequence (opt12) from Homo sapiens__NP_002623.2__HsPGF
augccaguaaugaggcuauuuccauguuuuuuacaauuacuagcaggauuagcauuaccagcaguaccaccacaacaaugggcauuaagugcaggaaauggaaguucagaaguagaaguaguaccauuucaagaaguauggggaagaucauauuguagagcacuugaaagauuaguagauguaguaagugaauauccaagcgaaguagaacauauguuuucaccaucauguguaaguuuauuaagauguacaggauguuguggagaugaaaaucuacauuguguaccaguagaaacagcaaauguaacaaugcaauuacuaaaaauaagaaguggagauagaccaucauauguagaauuaacauucagucaacauguaagaugugaauguagaccauuaagagaaaaaaugaaaccagaaagaagaagaccaaaaggaagaggaaaaagaagaagagaaaaacaaagaccaacagauugccauuuauguggagaugcaguaccaagaagauaa

SEQ ID NO: 1273 - RNA, 1239 nt, Artificial Sequence
  derived and/or modified CDS sequence (opt12) from Homo sapiens__NP_001020537.2__HsVEGFA
augacagacagacaaacagauacagcaccuucaccaagcuaucacuuauuaccugguagaagaagaacaguagaugcagcagcuaguaggggacaaggaccagaaccagcuccaggaggagguguagaaggaguaggggcaagaggaguagcuuuaaaauuauuuguacaacuuuuaggauguagcagguuuggaggagcgguuguaagagccggugaagcagaaccgucaggagcagcaagaucagcaagcucaggaagggaagaaccacaaccagaagaaggugaagaagaagaagaaaaggaagaagaaaggggaccacaauggcgacugggagcaagaaagccagguaguuggacaggagaagcagcaguaugcgcagacucugcaccagcagcaagagcaccgcaagcauuagcucgagcaaguggaaggggaggaagaguagcucgaagaggagcagaagaaucaggaccuccacacaguccaaguaggagaggaagugcaagcagggcaggaccagggagagcaagcgaaacaaugaauuuucuauugaguuggguacauuggagccuagcccuauuauuauauuuacaucaugcuaaauggucacaagcagcaccaauggcagaaggaggaggacaaaaucaucaugagguagugaaauuuauggauguauaucaaagaucauauugucauccaauagaaacauuaguugacauauuucaagaauauccagaugaaauagaauauaucuuuaaaccuagcugugucccauugaugagauguggaggauguuguaaugaugagggauuagaaugcguaccaacagaagaaaguaacauaacaaugcaaauaaugcgaauaaaaccacaucaaggacaacauauaggagaaaugucauuuuugcaacauaacaaaugcgaaugcaggccaaaaaaagacagagcaagacaagaaaaaaaaaguguuagaggaaaaggaaaaggucaaaaaaggaaaagaaaaaaaaguagauauaaaaguuggaguguauauguaggagcaagauguuguuuaaugccauggagucuaccgggaccacauccauguggaccuugcagugagaggagaaaacacuuauuuguucaagacccacaaacauguaaauguucuuguaaaaacacugauagcagauguaaagcucgacaauuggaauuaaaugaaaggacauguagaugugauaaaccaagaagauaa

SEQ ID NO: 1274 - RNA, 699 nt, Artificial Sequence
  derived and/or modified CDS sequence (opt12) from Homo sapiens__NP_001165094.1__HsVEGFA
augaacuuccuauuaagcuggguacacuggucacuagcauuauuauuauauuuacaucacgccaaauggucacaagcagcaccaauggcagaaggaggaggacaaaaccaccacgaaguaguaaaauuuauggauguauaccaaagaagcuauugccauccaauagaaacacuaguagacauauuccaagaauauccagaugaaauagaauauauauuuaaaccauccugcguaccauuaaugagaugcggaggaugcugcaacgacgaaggacuagaaugcguaccaacagaagaaaguaauauaacaaugcaaauaaugagaauaaaaccacaccaaggacaacacauaggcgaaaugaguuucuuacaacauaacaaaugcgaaugcagaccaaaaaaagacagagcaagacaagaaaaaaaaagcguaagaggaaaaggaaaaggacaaaaaagaaaaagaaaaaaaagcagauacaaaagcuggagcguauacguaggagcaagaugcugcuuaaugccauggucacuaccaggaccacacccaugcggaccauguucagaaagaagaaaacaucuauuuguacaagacccacaaacauguaaaugcucaugcaaaaacaccgacaguagauguaaagcaagacaacuagaacuaaaugaaagaaccuguagaugugacaaaccaagaagauaa

SEQ ID NO: 1275 - RNA, 624 nt, Artificial Sequence
  derived and/or modified CDS sequence (opt12) from Homo sapiens__NP_003368.1__HsVEGFB
augucaccacuauuaagaagacuacuauuagcagcauuacuacaacuagcaccagcacaagcuccaguaagccaaccagacgcacccggacaucaaagaaaaguaguaucauggauagauguauacacaagagcaacaugucaaccaagagaaguuguagucccacuaacaguagaauuaaugggaacaguagcaaaacaauuaguaccaucaugcguaaccguacaaagaugcggaggauguugcccagacgauggcuuagaaugcguaccaacuggacaacaucaaguaagaaugcaaauacuaaugauaagauacccaucaucacaauuaggagaaaugucauuagaagaacauucacaaugcgaaugcagaccaaaaaaaaaagacucagcaguaaaaccagacagagcagcaacaccacaucauagaccacaaccaagaucaguaccaggaugggacucagcaccaggagcaccaucuccagcagacauaacacauccaacaccagcaccaggaccaucagcacaugcagcacccucaacaacaagugcacuaacaccaggaccagcagcagcagcagcugacgcagcagcaucaucagucgcaaaaggaggagccuaa

SEQ ID NO: 1276 - RNA, 1260 nt, Artificial Sequence
  derived and/or modified CDS sequence (opt12) from Homo sapiens__NP_005420.1__HsVEGFC
augcaccuauuaggauucuuuagcguagcgugcaguuuauuggcagcagcacuauuaccagguccacgugaagcaccagccgcagccgcagcuuucgaaucaggauuagacuuaagcgacgcugaacccgacgcaggcgaagcaacagcauacgcuucaaaagaucuagaagaacaacuaagaucuguaucuucaguagacgaauuaaugacaguacuauacccagaauauuggaaaauguauaaaugccaacuaagaaaaggagguuggcaacacaauagagaacaagcaaacuuaaacuccagaacagaagagacuauaaaauuugcagcagcacauuacaacacagaaauucuaaaaucaauagacaaugaauggagaaaaacucaauguaugccaagagaaguaugcauagacguagguaaagaauucgguguagccaccaacacauuuuuuaaaccaccaugcguaucaguauauagaugcggaggcuguugcaauucagaaggauuacaauguaugaauaccucuacaagcuaccuaucaaaaacacuauucgaaauaacuguaccauuaucacaaggaccaaaaccaguaacaauaucauuugcaaaccacacaucaugucgaugcaugucaaaauuagacguauaccgacaaguacacaguauaauaagaagaucacuacccgcaacacuaccacaaugccaagcagcaaauaaaacaugcccaacuaacuacauguggaauaaucauauuuguagaugccuagcacaagaagauuucauguucucaagugaugcaggugacgacucuacugacggauuucaugacauauguggaccaaauaaagaacuagacgaagaaacaugucaaugcguaugcagagcaggacuucgaccagcauccugugguccacauaaagaacuagauagaaauucaugccaauguguuuguaaaaauaaauuauuccccagccaaugcggagcaaauagagaauuugaugaaaauacaugccaauguguauguaaaagaaccugcccaagaaaucaaccacuaaacccaggaaaaugcgccugcgaaugcacagaaaguccacaaaaaugucuauuaaaagguaaaaaauuccaucaccaaacauguucaugcuacagaagaccaugcacaaacagacaaaaagcaugugaaccuggauuuucauauucagaagaaguuuguagauguguuccaucauacuggaaacgaccacaaaugagcuaa

SEQ ID NO: 1277 - RNA, 1065 nt, Artificial Sequence
  derived and/or modified CDS sequence (opt12) from Homo sapiens__NP_004460.1__HsVEGFD
auguacagagaauggguaguaguaaacguauucaugaugcuauauguacaacuuguacaaggaagcucaaaugaacacggaccaguaaaaagaucaucacaguccacacuagaaagaucagaacaacaaauaagagcagcauccucucuagaagaauuacuaagaaucacacauuccgaagacuggaaauuauggcgaugucgacuacgcuuaaaaagcuuuacuaguauggacucacgcucagcaucacauagaaguacaagauuugcagcaacauucuacgacauagaaacacuaaaaguaauagaugaagaauggcaaagaacacaaugcucaccaagagaaacaugcgucgaaguagcaucugaacucggaaaauccaccaauacauucuucaaaccaccaugcguuaacguauuuagaugcggaggauguugcaacgaagaaucacuaauaugcaugaauacauccacaucauacauaucaaaacaacuauucgaaauauccguaccauuaacaucaguaccagaacuaguaccaguaaaaguagcaaaucacacaggaugcaaaugccuaccaacagcaccaagacacccuuacagcauaauaagaagaucaauacaaauacccgaagaagacagaugcucccacagcaaaaaauuaugcccaaucgacaugcuaugggacucaaacaaaugcaaaugcguacuacaagaagaaaacccacuagcagguacagaagaccacucacaccuacaagaaccagcauuaugcgguccucacaugauguucgacgaagauagaugcgaaugcguaugcaaaacaccauguccaaaagacuuaauacaacacccaaaaaauugcuccuguuuugaauguaaagaaucacuagaaacaugcugccaaaaacacaaauuauuucaucccgauacaugcucaugcgaagacagaugcccauuccacacaagaccaugcgcaaguggaaaaacagccugcgccaagcacugccgauucccaaaagaaaaaagagcagcucaaggaccacacucacgaaaaaauccauaa

SEQ ID NO: 1278 - RNA, 72 nt, Artificial Sequence; identical to SEQ ID NO: 696
  derived and/or modified CDS sequence (opt13) from Homo sapiens__AAA59606.1__signal peptide-HLA-A2-SP

SEQ ID NO: 1279 - RNA, 69 nt, Artificial Sequence
  derived and/or modified CDS sequence (opt13) from Homo sapiens__AAA61213.1__signal peptide-HsPLAT
auggaugcaaugaaaagaggauuauguuguguauuauuauuauguggagcaguauuuguaaguccaagu

SEQ ID NO: 1280 - RNA, 81 nt, Artificial Sequence; identical to SEQ ID NO: 698
  derived and/or modified CDS sequence (opt13) from Homo sapiens__NP_000790.2__signal peptide-HsEPO

SEQ ID NO: 1281 - RNA, 54 nt, Artificial Sequence; identical to SEQ ID NO: 699
  derived and/or modified CDS sequence (opt13) from Homo sapiens__NP_000468.1__signal peptide-HsALB

SEQ ID NO: 1282 - RNA, 18 nt, Artificial Sequence
  derived and/or modified CDS sequence (opt13) from Artificial____cleavage site-Furin
agaagaaggaggaagaga

SEQ ID NO: 1283 - RNA, 630 nt, Artificial Sequence
  derived and/or modified CDS sequence (opt13) from Homo sapiens__NP_061986.1__HsFGF21
auggacucagacgaaacagguuucgaacacuccggauuauggguaucaguauuagcaggauuacuauuaggagcaugccaagcacauccaauaccagacucaucaccacuucuacaauucggaggacaaguaagacaaagauacuuauacacagaugacgcccaacaaacagaagcacacuuagaaauaagagaagacggcacagucggaggagcagcagaccaaucaccagaaucuuuauuacaauuaaaagcauuaaaaccaggaguaauacaaauauuaggaguaaaaacaucaagauuucuaugccaaagaccagacggagcauuauacggaucauuacauuucgacccagaagcauguucauucagagaauuauuacuagaagaugguuauaauguauaucaaucugaagcacacggauuaccacuacaucuaccaggaaauaaaucaccacauagagacccagcaccaagaggaccagcaagauucuuaccauuacccggauuaccuccagcacuaccugaaccaccaggaauacuagcaccacaaccaccagauguaggaucauccgacccauuaucaaugguaggaccaucacaaggaagaaguccaucauacgcaucauaa

SEQ ID NO: 1284 - RNA, 1410 nt, Artificial Sequence
  derived and/or modified CDS sequence (opt13) from Homo sapiens__NP_002412.1__HsMMP1
augcacucauucccuccacuauuauuauuacuauuuuggggaguaguaucacacaguuucccugcaaccuuagaaacacaagaacaagacguagaccuaguucaaaaauacuuggaaaaauacuacaaccuuaaaaaugacggaagacaaguagaaaaacgaagaaauucaggaccagucguagaaaaacuaaaacaaaugcaagaauuuuucggacuaaaaguuacaggaaaaccagaugcagaaacacuaaaaguaaugaaacaaccuagauguggaguacccgacguagcccaauuuguauuaacagaaggcaacccaagaugggaacaaacccacuuaaccuacagaauagaaaauuacacaccagaucuaccuagagccgacguagaucaugcgauagaaaaagcauuucaauuauggaguaauguaacuccacuaacauuuacaaaagucucagaaggacaagcggacauaaugauauccuucguaagaggagaucacagagacaauaguccauucgacggaccaggcggaaaccuagcacacgcuuuccaaccaggacccggcauaggaggagaugcacacuucgacgaagacgaaagauggacaaacaacuucagagaauauaaccuccacagaguagcugcacaugaacuaggacauucauuaggacuuagccacagcacagacauaggagcacuaauguacccuucauauacauuuucaggagacguacaauuagcacaagacgauauagacggaauacaagcaauauauggaagaucacaaaauccuguacaaccgaucggaccucagacaccaaaagcaugcgauagcaaacuuaccuucgacgcuauaacaacaauuagaggcgaaguaauguucuucaaagaccgauuuuacaugagaacaaauccauucuaucccgaaguagaauuaaacuuuauauccguauuuuggccacaacucccuaacggauuagaagccgcauacgaauuugcagauagagacgaaguaagauuuuucaaaggaaacaaauacugggcuguacaaggacaaaacguacuacacggauauccaaaagacauauacucaucauucggcuuuccccgaacaguaaaacauauagaugcagcauuaucagaagaaaacacaggaaaaacauauuucuuuguagccaacaaauacuggagauaugaugaauacaaaagaucaauggacccagguuacccaaaaaugauagcacaugauuuuccaggaauuggacauaaagucgacgccgucuucaugaaagacggauucuucuauuucuuucauggaacuagacaauauaaauucgacccaaaaacaaaaagaauauuaacacuacaaaaagcaaacucuugguucaacuguaggaaaaauuaa

SEQ ID NO: 1285 - RNA, 1170 nt, Artificial Sequence
  derived and/or modified CDS sequence (opt13) from Homo sapiens__NP_002412.1__HsMMP1(1-19,100-469)
augcacucauuuccaccauuacuacucuuauuauuuuggggaguaguaucacacucauucguacuaacagaaggaaauccaagaugggaacaaacacaccuuaccuacagaauagaaaauuacacaccagaucuaccaagagcagacguagaccacgcaauagaaaaagcauuucaauuauggucaaacguaacaccauuaacauucacaaaaguaucagaaggacaagcagacauaaugauaucauucguaagaggagaccacagagacaauucaccauuugauggaccaggagguaaucuggcacacgcauuccaaccaggaccaggaauaggaggagacgcacacuucgacgaagacgaaagauggacaaacaacuucagagaauacaaccuacacagaguagcagcccaugaacuaggacacucacuaggacuaucacacucaacagacauaggagcccuaauguauccauccuacacauucucaggagacguacaacucgcgcaagacgacauugacggaauccaagcuauauacggaagaucacaaaacccaguacaaccaauaggcccccaaacaccaaaagcaugugacucaaaacuaacauuugaugcaauaacaacaauaagaggcgaaguaauguucuucaaagacagauucuacaugcgcacaaauccauucuacccagaagucgaauuaaacuucauaucaguauucuggccccaauuaccaaacggauuagaagccgccuacgaauuugcagaccgagacgaaguaagauucuucaaaggaaacaaauauugggcaguacaaggacaaaacguauuacacggauauccaaaagacauauacuccucauuuggcuuuccaagaacaguaaaacauaucgacgcagcacucuccgaagaaaacacaggaaaaacauacuucuuuguagcaaacaaauacuggagauaugacgaauauaaaagaucaauggacccgggauacccaaaaaugauagcacaugacuucccaggaauaggacacaaaguagacgccguauucaugaaagacggauuuuucuacuucuuucacggaacuagacaauacaaauucgacccaaaaacaaaaaggauacuaacauuacaaaaagcaaacucaugguuuaacugccgcaaaaacuaa

SEQ ID NO: 1286 - RNA, 3357 nt, Artificial Sequence
  derived and/or modified CDS sequence (opt13) from Clostridium histolyticum__BAA77453.1__ColG
augaagaaaaauauacuuaaaauacucauggacucauacaguaaagaaagcaaaauucaaacgguucgaagaguaaccagugucagccuauuagcaguauaucuaacuaugaauacuagcagcuuaguacucgcgaaaccaauugaaaauacaaaugacacaaguauuaaaaauguagaaaaauugagaaaugcaccaaaugaagaaaacucgaagaaaguagaagauagcaaaaaugauaaaguugagcauguuaaaaacauagaagaagcaaaagucgaacagguggcuccagaaguaaaaucaaaaagcacacucagaucagcaaguaucgcaaacacgaacagugagaaauaugauuuugaauaccugaauggccucucauauacagaauuaacaaacuuaauuaaaaauauaaaauggaaucaaaucaacggcuuauucaauuacaguaccggaagucagaaauucuuuggggacaaaaaccgaguacaagcaauaauuaaugcauuacaagaaucagggcgaacauauacagccaacgauaugaaaggaauugaaacauucaccgagguuuuacgagcuggcuucuauuugggcuacuacaacgauggacuauccuauuugaacgauagaaacuuucaggauaaauguauaccagcaaugaucgcaauacagaagaacccaaacuucaaauuaggaacagcaguacaagaugaaguaauuaccagucuugguaaauuaauuggaaacgcaagcgcgaaugcugaaguuguaaauaacugugucccagucuuaaaacaauuuagagagaauuuaaaucaauaugcaccagauuacguuaaaggaacagcgguuaaugaauuaauaaaaggaauagaguucgacuuuagcggagcagcuuacgaaaaagacguaaaaacuaugccuugguacggaaagauugauccauucauaaacgaauuaaaagcauugggccucuacggaaauauaacaucagcuacagaaugggccagcgauguggguauauacuaucuuaguaaauucggucuuuauaguacaaacaggaaugauaucguucaaucacuagaaaaagcaguagauauguauaaauacggaaaaauagcauuuguggcaauggaaagaauaacaugggacuaugauggaauaggaucuaacggcaagaaaguagaccaugacaaauuucucgacgaugccgaaaaacacuacuuaccaaaaacguauacauuugacaauggaacauuuaucauaagagcgggugacaaaguaagugaagagaaaauaaaaagacuauacugggcaucuagagaaguaaaaucucaauuucacagggucgucgggaaugacaaagcacuagaaguaggaaacgccgacgauguccucacaaugaaaauauucaacagccccgaagaauauaaauucaauacuaauauaaauggaguuagcacagacaauggcggauuauauauagaaccacgagggacuuucuacacguaugaaagaacaccacaacaaucaauauucagcuuagaagaacuguuuagacaugaauauacucauuacuuacaagcucgauauuuaguggauggauuauggggacaaggccccuucuacgagaaaaacagacuaacuugguucgacgaaggaacagcagaguucuucgccggcucaaccaggacaucaggagugcuuccgagaaaaucaauacuaggcuaucuugcaaaagauaaaguagaccacagauacagccucaagaaaacauuaaauucaggauaugaugauagcgauuggauguuuuauaauuauggguuugcuguagcccacuauuuauaugaaaaagauaugccaacauuuauaaaaaugaauaaagcaauucuaaauaccgacguuaaaagcuaugaugaaauaauaaagaaauuaucagacgacgcgaacaaaaacacagaauaucaaaaucacauacaagaauuagccgacaaauaucaaggagcaggcauacccuuagugucagacgacuauuuaaaagaucauggauauaagaaagcguccgaaguauauucugaaauaucuaaagcggcaagccuaacaaauacauccguaacagcggaaaaaucacaauacuuuaauacauuuacacuaagaggaacauauacaggagaaacaaguaaaggcgaauuuaaagacugggacgaaaugagcaagaaacuggacggaacacuagaaagccuagcuaaaaacucauggagcggauauaaaacauuaacggcauauuuuaccaauuaccgaguaacguccgacaacaaaguacaauaugacguuguauuucacggcguuuuaacagauaacgcagauauaaguaauaacaaagcaccaauagcaaaaguuacaggcccaucgacaggugccguagguagaaacauugaauuuucuggaaaagauucaaaagaugaagauggaaaaaucguaucauacgacugggacuuuggagacggagcaacaucaagagggaaaaauucaguccaugcauacaagaaagcuggaacauauaacguaacauuaaaaguuaccgaugauaaaggugcgacagcaacugaaucuuuuacaaucgaaaucaaaaacgaagauacaacaacaccaauaacgaaagaaauggaacccaaugacgauauaaaagaagcuaauggaccaauagucgaaggaguaaccgucaaaggugaccuaaacggcuccgacgacgcugauacauucuauuuugauguuaaagaagauggagaugugacaauagaacuaccauauucaggaucuaguaacuuuaccuggcugguauauaaagaaggcgaugaucaaaaucauaucgcuagugguauagacaaaaauaacagcaaaguuggaacauuuaaaagcacaaaagguagacauuacguauucauuuacaaacacgauucagcaucaaauaucucauacucuuuaaauauaaaaggcuuagguaaugaaaaacugaaagagaaagaaaauaaugauucgucagacaaagcuacagugauaccaaauuucaauacaacuaugcaaggaucacugcuaggagaugacagccgugauuauuacagcuucgaaguaaaagaagaaggagagguaaacaucgaauuagauaagaaagaugaauuuggaguaacauggacauuacauccagaauccaacauaaacgacagaauaacauacggacaaguugaugguaacaaaguaaguaauaaaguaaaauugaggccuggaaaauacuaccuguuaguauauaaauacagugggucaggaaacuacgaacuacgaguuaacaaauaa

SEQ ID NO: 1287 - RNA, 3081 nt, Artificial Sequence
  derived and/or modified CDS sequence (opt13) from Clostridium histolyticum__BAA77453.1__HsALB(1-18)_ColG(111-1118)
augaaauggguaacuuuuauaagucuucuauuucuauuuucaucggcauauaguauagcaaacacaaacucagaaaaauaugacuuugaauaucuaaauggauuaucauauacagaauuaacaaaccugaucaaaaacauaaaauggaaucaaauaaacggauuauuuaacuauagcacgggaucacagaaauuuuucggcgauaaaaauagaguacaagcaauuauaaaugcucuccaagaaucuggcagaacguauacagcaaacgauaugaaaggaaucgaaacuuuuacagaaguccugagagcagguuuuuacuuagguuauuacaacgacgggcuaagcuaucuaaaugauagaaacuuccaagacaaauguauaccagcaaugauugcaauacagaaaaaccccaauuuuaaauuaggaacagcaguucaagacgaaguuauaacaucucuuggcaaacuuauagggaacgcaagcgcaaacgcagaaguaguaaacaacuguguaccgguauuaaaacaauucagagaaaauuuaaaucaauacgcaccagacuauguaaaaggaacagcaguaaacgaacuaauaaaaggaauagaauuugauuucagcggagccgcauaugaaaaggaugucaaaacuaugccgugguacggaaaaauagacccauuuauaaaugaacuuaaagcacuagguuuauacggaaacaucacaagcgcaacugaaugggcaucagauguuggaauuuauuaccuaucuaaauuuggacuauacucaaccaacaggaacgauauagugcaaucucuggaaaaagcuguagacauguauaaauauggaaaaauagcuuucgucgcaauggaaagaauaacuugggauuaugaugguauuggaucaaacggcaaaaagguagaucacgauaaauucuuagaugacgcagaaaagcacuacuuaccaaaaacguauacauucgacaacgggacuuuuauaaucagagcaggcgauaaaguauccgaagagaaaauaaaaagauuauacugggcuucaagggaaguaaaaucucaauuccaccgaguaguaggaaaugauaaagcauuagaaguggguaacgcugaugauguauuaacaaugaaaauauucaacagcccugaagaauacaaguucaauacaaauauaaacggagucucuaccgauaacggaggcuuauacauugaaccaagaggaacauuuuacacauaugaaagaacuccacaacaaagcauauucagccuugaggaacuauuccgacacgaauauacacauuacuuacaagccagguaucuuguagauggacuuuggggacagggaccuuucuaugaaaagaauagacuaaccugguucgacgaaggaacagcagaguucuuugcagguucaacaagaacaucuggaguauuaccacgaaaaucaauucucgguuauuuagcaaaagauaaaguagaucauagauauucacuaaagaaaaccuugaacucaggauacgacgacagugacuggauguucuacaauuacggauuugcaguagcacacuauuuauaugaaaaagauaugccuacauucauuaaaaugaacaaagcaauacuaaauaccgaugugaaaagcuaugacgaaauaauaaagaaacuuucagacgaugcgaacaaaaauacagaauaccaaaaccauauucaagaacucgccgacaaauaccaaggugcaggcauuccucuaguaagugacgacuauuuaaaagaccauggauacaagaaagcaucagaagucuauucagaaaucagcaaagccgcauccuuaacuaauacaagcgucacagcagagaaaucacaauacuuuaauacauucacgcuucgaggaacuuauacaggugaaacgucaaaaggagaguuuaaagauugggaugaaaugucaaagaaauuagauggaacacuagaaucguuagcuaaaaacucauggucuggauauaaaacacuaaccgcauacuuuacuaacuacagaguuaccagugauaacaaaguacaauacgauguaguauuucauggaguacuaacagacaaugcagacauuagcaauaacaaagcaccaauagcaaaaguuaccggccccucaacaggggcaguagguagaaauauugaguucucuggaaaagauagcaaagaugaagauggaaaaauaguuucauaugauugggacuuuggugauggagcaacuagcaggggcaaaaacucaguucacgcauacaagaaagcaggaacauauaacguaaccuuaaaaguaaccgaugauaaaggagcaaccgccaccgaaaguuuuacuauagaaaucaaaaacgaagacacaacgacaccaauaacaaaagaaauggaaccaaaugacgacauaaaagaagcaaacggaccaauaguagaaggaguaacaguaaaaggagaccuaaauggcucggacgaugcagauacauuuuacuuugaugucaaagaggauggugacguaaccauagaacuacccuauagcggaucaaguaauuucacuuggcuaguuuacaaagaaggagaugaccaaaaccauauugcaucaggaauugauaaaaacaacucaaaaguaggcacauucaaaucaacaaaaggacgacauuacguuuucauauauaaacacgacagcgcuucaaacauaucauauucucucaacauaaaagguuuaggcaaugaaaaauuaaaagaaaaagaaaauaacgacucaucagauaaagcaaccguaaucccaaauuucaauacaacgaugcaaggaucgcuccucggagaugacagucgugauuacuacucauuugaaguaaaagaagaaggagaaguuaauauagaacuagauaagaaagacgaguucggaguaacauggacauuacacccagagaguaauaucaacgauagaauuacauauggccaaguugacggaaauaaaguuaguaauaaaguaaaacuuaggccaggaaaauauuaccugcucgucuacaaauacucagguagcgguaacuaugaacuaagaguaaacaaauaa

SEQ ID NO: 1288 - RNA, 3429 nt, Artificial Sequence
  derived and/or modified CDS sequence (opt13) from Clostridium histolyticum__BAA77453.1__HsALB(1-18)_ColG(1-110)_CS-F_ColG(111-1 118)
augaaauggguaacauucauuagccucuuauuucuauuuucaucagcauacaguaugaagaaaaauauacuaaaaauauugauggacuccuauaguaaagagagcaaaauacaaacaguaaggcgaguaaccagcgugaguuuacuugcuguauaucuaacaaugaacacaaguagccuaguuuuagcaaaaccaauagaaaauacgaaugauaccuccaucaaaaacguagaaaaacuaagaaaugcaccaaacgaagaaaauucaaagaaaguagaagauaguaaaaacgacaaaguagaacaugugaaaaacauagaagaagccaaaguagaacaaguagcaccagaagucaaaucuaaauccacuuuaagaagugcgucaaggagaagaagaaaaagaauagcaaacacaaauagugaaaaauacgauuucgaauaccuaaacggacuauccuauacugaacuaacaaaucuaauuaaaaacauaaaauggaaucaaauaaacgguuuauuuaacuauuccacaggcucacaaaaauuuuucggagauaaaaaucgcguucaagcaauaauaaaugcccuacaagaaagcgggagaaccuacaccgcaaaugauaugaaaggaauagaaacauucacagaaguacuuagagccgguuucuaucuagguuacuauaacgacggauuaaguuaucuaaaugauaggaacuuccaagauaaaugcauaccagcaaugaucgcaauacagaaaaauccaaauuucaaauugggaacagcaguccaagacgaagugauaacaucacuaggaaaacuaauaggcaacgcaagugcaaacgccgaaguaguaaacaacuguguuccaguacuaaaacaauucagagaaaaccuaaaccaauacgcaccugauuauguuaaagguacagccgucaacgaacucauaaaagguauagaguucgacuucucaggagcagcguacgaaaaagauguaaaaacaaugccaugguauggaaaaauugauccauuuauuaaugaauuaaaggcauuaggauuguacggaaacauaaccucggcuacagaaugggcaucagauguaggaauauacuaccuuucaaaauuuggucuauauagcacaaaccggaacgauauaguacaaucauuagaaaaagccguagacauguauaaauauggaaaaauagcauuugucgcaauggaaagaauaaccugggacuacgacggaauagggucuaacgggaagaaaguagaccaugauaaauuucucgaugaugccgaaaaacauuaucuaccuaaaacuuacacuuucgacaauggcacauucauaaucagagcuggcgacaaaguauccgaagagaaaauaaaaagauuauauugggcaucuagagagguaaaaagucaguuucacagagucguaggaaaugauaaagcucuugagguaggaaacgcagaugacguguuaacaaugaaaauauuuaauucaccggaagaauacaaguucaauacaaacauuaauggcguauccacagacaauggaggacuauauaucgaaccacgaggaacauucuauacauaugaaagaaccccacaacagaguauuuucagucuagaagaauuauuuaggcacgaauacacccauuauuuacaagcacguuaucuaguagacggacuauggggucagggacccuucuacgaaaagaaccgcuuaacaugguucgaugaagguacugcggaauuuuucgcuggaucaacacgaaccaguggaguacucccaagaaaaucaauuuuagguuaccuugcaaaagauaaagucgaucacagauacucacucaaaaagacacuaaauucaggauaugaugacucagacuggauguuuuauaauuauggauucgcagucgcacacuaccucuacgaaaaagauaugccaacguucauuaagaugaauaaggcaauacuaaauacagauguaaaaucauacgacgaaaucauaaagaaacuauccgacgacgcaaauaaaaauacagaauaccaaaaccauauacaagaacuagcagacaaauaucagggagcaggcaucccacuuguaagcgacgacuacuugaaagaccacggauacaagaaagcauccgaagucuacucagaaauauccaaagcagccucauuaacaaauacguccguaacugcugagaaaagucaauauuucaacacauucacacuacguggaacauacaccggcgaaacgaguaaaggagaguucaaagauugggacgaaaugucaaagaaauuagacgguacacuagaaucauuagccaaaaauucauggagcggauacaaaacucuuacggcauacuuuacaaacuauaggguuacaagugauaacaaaguacaauaugacguaguauuucauggaguccucacagacaaugcugauaucagcaacaacaaagcuccuaucgcuaaaguaacugggcccaguacgggagcaguaggcagaaacauugaguucucaggaaaagacucaaaagacgaagauggcaaaauaguauccuaugauugggacuuuggagauggagcaacaucaagaggcaaaaacucaguccacgcauacaagaaagcaggaacauauaauguaacacuuaaaguaacagacgauaaaggcgcaacagcaacagaaucauucacaauagaaauuaaaaacgaagauacaacaacaccaauaacaaaagaaauggaaccaaacgaugauauaaaagaggcaaacgguccaauaguggaaggaguaacaguaaaaggcgacuugaaugggagcgacgacgccgacacauuuuauuucgacguuaaagaggacggcgacguaacaauagaauuaccauacaguggaucaagcaacuuuacguggcuaguuuauaaagaaggagacgaccaaaaccauauagcaagugguauagacaaaaacaauaguaaaguagguacauuuaaaaguaccaaaggcagacauuacguauuuauauacaaacacgauucagcaucaaacauaucauauucucuaaauauaaaaggauuagggaaugaaaaacuuaaagaaaaagagaauaaugacagcagcgacaaagcaacugucauacccaacuuuaacacaacaaugcaagguucacuauuaggagacgacagucgagauuauuauagcuucgaaguaaaagaggaaggagaagucaauauagaauuagauaagaaagacgaauuuggaguaacauggacacuucauccugaaaguaauauaaacgauagaauaacauacggacaaguagacggaaacaaagucucaaauaaaguaaaacuuagaccagggaaauauuaucuacuuguauauaaauacaguggaucagguaacuaugaacuaagagucaauaaauaa

SEQ ID NO: 1289 - RNA, 3105 nt, Artificial Sequence
  derived and/or modified CDS sequence (opt13) from Clostridium histolyticum__BAA34542.1__ColH
augaacuucuugaaaauaauccucaacagaggaaaaaccaugaaacgaaaaugucugucaaaaagauuaaugcuagcuauaacaauggccaccauauucacagucaacucaacacuaccaaucuaugcagcaguagauaaaaauaaugcuacagcugcaguacaaaacgaaucaaaacguuauacaguuucguacuuaaaaacauuaaauuauuaugaccucgucgaucuauugguaaaaacagaaaucgaaaauuuaccagauuuauuccaauacagcucagaugcuaaagaguucuaugguaacaaaacaagaaugagcuucauuauggacgaaauagguagaagggcuccacaauauacagaaauagaccauaaaggaauaccaacccuaguagaaguagucagagccggauuuuaucuuggauuccacaacaaagaauuaaaugaaaucaacaaaagaucauucaaagaacgaguaaucccaagcauauuagcaauacaaaagaauccaaauuucaaauuaggaacagaaguucaggacaaaauaguuagcgcaacaggacuucuagccggaaaugaaacagcaccuccugaaguaguaaauaacuuuacaccaauauugcaggauugcauaaagaacauagauagauacgcguuagaugaccuaaaaucuaaagccuuauucaaugugcuugcagccccaacauacgacaucacugaauaucuccgagccacaaaagaaaaaccagaaaacacaccaugguacgggaaaauagacggauucauaaacgaacucaagaaacuagcauuauaugguaaaauaaacgacaacaacucauggaucauagacaaugguauauaccauauagccccauuaggaaaacuucacagcaauaauaaaauaggaauagagacauuaacagaaguaaugaaaguauacccuuauuuaaguaugcaacauuuacaaucagcagaccaaaucaaaagacauuacgacaguaaagacgcggaaggaaacaaaauuccauuagacaaauuuaaaaaggaaggaaaagaaaaauauuguccaaaaaccuacacauuugacgauggaaaagucauuauaaaagccggagcacguguagaggaagaaaaagugaaaagacuuuacugggcauccaaagaaguaaauucacaauucuuucgaguuuacggaauugacaaaccccuggaagaaggaaacccagacgacauuuuaacgaugguaauauacaacaguccugaagaauacaaacuaaacaguguacuauauggcuacgauacgaacaacggaggaauguacaucgaaccagaaggaacauucuuuacguacgaaagagaagcacaggaaucaacuuauacacuagaggaacuauuucgacacgaauacacacacuaucuccaagguagauaugcaguuccgggacaauggggaagaacuaaguuauacgauaaugacagacuaacaugguaugaagaaggaggggccgaguuauucgcgggcaguaccagaacaagugggauauuacccagaaaaagcauuguauccaacauacacaacaccacgaggaauaaccgauauaaacuuucagauacaguccauucaaaauauggagcaucguuugaguucuacaauuaugcaugcauguuuauggauuauauguauaauaaagacaugggaauacucaacaaauuaaaugaccuagcaaagaacaaugacguggacggauacgacaacuacauaagagaccuaucaagcaacuacgcacuaaaugacaaauaucaagaccacaugcaagaaagaauagauaacuaugaaaaucucacaguaccuuucguugcagaugacuaccuaguccgucaugcauacaaaaauccgaacgaaauauauucagaaauuucagaaguugcuaaacuuaaagaugccaaaucagaaguaaagaaaagucaauacuucaguacuuuuacacuacgcggaagcuacacuggaggagcuucaaaaggaaaauuagaagaccaaaaagccaugaacaaauucauagacgauagccucaagaaauuagauacguauaguuggucuggauauaaaacacuaacagcguauuuuacaaauuauaaagucgauaguagcaacagaguaacauacgauguaguauuucauggauauuuaccaaaugaaggagauuccaaaaauucacucccguauggaaaaauaaacgguacauauaaagggacagaaaaagagaaaauaaaauucagcucagaaggaaguuuugacccggacgguaaaauaguaaguuacgaaugggacuucggugacggcaauaaaucaaacgaagaaaauccagaacacucuuaugauaaaguaggaaccuacacagugaaauuaaaaguaacagaugauaaaggugaaucauccgucaguacgacaacagcagaaauaaaagaucugucagaaaacaagcucccgguuauauauaugcauguaccaaaaagcggcgcccuaaaucaaaaaguagucuuuuacggaaaaggaacguaugacccagacggaaguauagcaggauaccaaugggauuuuggggaugguagugacuuuagcagcgaacaaaacccaucacaugucuacacuaagaaaggcgaguacacaguuacacucagaguaauggacucaaguggacaaaugucagagaaaacaaugaaaauaaaaauaacagauccaguauauccaauuggaacugaaaaagaaccaaacaauucuaaagaaacagccucaggucccauugucccuggcauaccuguaaguggaacaauagaaaacaccagugaccaagacuauuucuauuuugacguuauaacacccggcgaaguaaaaauagacaucaacaaacuuggauacggaggagcuacauggguuguauaugaugaaaacaauaaugcaguaaguuaugcaacugaugauggacaaaaccuaagcggaaaauuuaaagcagauaaacccggacgauauuauauacacuuauauauguucaacggaaguuauaugccauaucgaauaaauauagaaggaagcguaggaagauaa

SEQ ID NO: 1290 - RNA, 3066 nt, Artificial Sequence
  derived and/or modified CDS sequence (opt13) from Clostridium histolyticum__BAA34542.1__ColH
augaaaagaaaauguuuaagcaaaagauuaaugcuagccauuacaauggcaacaauuuucacaguaaauaguacauuaccaauuuacgcagcugucgacaaaaacaacgcaacugcagcaguacagaacgaaucaaaacgguauacagugagcuaccucaaaacacuaaauuauuaugaccuaguagaucuacuuguaaaaacagaaauugaaaaucuaccagaccuauuccaauacuccucagaugcaaaggaauuuuauggaaacaaaacgcgcaugaguuucauuauggacgaaauaggaaggagggccccacaguacacagaaauagaucauaaaggcauaccaacgcuaguagaagucguaagagcaggauuuuaccuagguuuucacaacaaagaacucaacgaaauaaacaagcgcaguuuuaaagaaagagucauuccaucaauauuagcgauccagaaaaacccuaacuucaaacuaggaacagaaguacaagacaaaauuguaucagcgacaggacuacuagcaggaaaugagacagcaccaccagaaguaguaaauaauuucacaccaauauuacaagacugcaucaaaaauauagaccgauacgcauuggaugacuugaaaagcaaagcauuauuuaauguacuugcggcaccaacauaugacauaacagaauaccuaagagcuacaaaggaaaaaccagaaaacacaccaugguauggaaaaauagacggauuuauaaaugaacugaaaaaguuagcacuauacgguaaaaucaaugacaacaacagcuggauaauagacaaugggaucuaccauauagccccauuagguaaacuacauucaaacaacaaaauaggaaucgaaacccuaacagaaguaaugaaaguauauccauaccuaagcaugcaacacuugcaaagcgcagaccaaauaaaaaggcacuaugacagcaaagaugcagaaggaaacaaaauaccacucgacaaguucaagaaagaagguaaagaaaaauauugucccaaaacguauacguucgaugacggaaaaguaaucauaaaagcaggagccagaguagaagaagaaaaaguaaaaagacuuuauugggcuucgaaagaagucaacagccaauucuucagaguauaugguaucgacaaaccucuagaagaaggaaauccagaugacauucuaacaaugguaauauacaacucaccggaggaauacaaauuaaacaguguccuguacggauacgauacaaacaacgguggcauguauauagaaccagaagguacauucuucacuuaugaaagagaagcucaagaaagcaccuacacauuagaggaauuauuuagacaugaauauacucacuauuuacaaggccgauaugcaguaccaggccaaugggggcguacaaaauuauacgauaacgauagauuaacaugguaugaagaagguggagccgaacuauucgcagguuccaccaggacuucaggaauacuaccaaggaaaucaauuguaaguaauauacacaauaccacacguaacaacagauacaaauuauccgacacaguacacucaaaauacggagcaucauucgaguucuacaauuacgcauguauguuuauggauuauauguauaauaaagauaugggaauccuaaacaaacuaaaugacuuagcuaaaaauaaugacguugacggauacgacaauuacauaagggacuuaaguagcaacuacgcauuaaacgacaaauaccaagaccauaugcaagaaagaauagauaacuaugaaaaucuaacgguaccauuuguugcagacgauuauuuagucagacaugcauacaaaaacccuaaugaaauauacagugaaauaucagaaguggcaaaacuaaaagacgcuaaaucugaaguaaagaaaagccaauacuuuaguacauucacacuucgaggcucauacacaggaggagcaagcaaggguaaacucgaagaccaaaaagcaaugaacaaauuuauagaugauucacuaaagaaauuagacacauauaguuggagcggcuauaaaacacuaaccgcauacuuuacuaacuauaaaguagacucaucaaaccgcguaacauacgacguaguauuucacggauaccuccccaaugaaggugacagcaaaaacucacuacccuaugggaaaauaaaugggacauacaaagguaccgaaaaggagaaaauaaaauuuucuucugaaggcagcuucgacccagacggaaaaauagucuccuacgaaugggacuucggugauggaaacaaaagcaaugaagaaaauccagaacacaguuacgacaaaguagggacuuacacuguaaaacugaaaguuacagaugacaagggcgaaagcucuguaaguacaaccacugccgaaauaaaagaccuaucagaaaacaaacuuccaguaauauauaugcacguuccuaaaucuggagcuuugaaccaaaaaguaguuuucuacggaaaaggcacguaugacccggauggaucaaucgcaggcuaucaaugggacuuuggcgauggaagugacuuuuccagcgaacaaaacccuagccacgucuauacuaagaaaggagaauauaccgugacauuacgaguaauggauucaucaggacaaaugucagagaaaaccaugaaaauaaaaaucacugacccaguauauccaauaggaacagaaaaagaaccaaacaacaguaaagaaacagccucagguccaauaguaccuggaauaccagucucaggcacaauagaaaacacaucagaccaagacuacuucuauuuugauguuauaacaccaggugaagucaaaauagauauaaauaaauuaggauaugguggugcaacaugggucguauacgaugaaaacaauaacgccguuaguuacgcaacagacgauggucaaaaccuaucugggaaauucaaagcagauaaaccuggaagauacuauauacaucuauauauguuuaacggcagcuacaugccauauagaauaaauauagaagggucaguaggaagauaa

SEQ ID NO: 1291 - RNA, 3000 nt, Artificial Sequence
  derived and/or modified CDS sequence (opt13) from Clostridium histolyticum__BAA34542.1__HsALB(1-18)_ColH(41-1021)
augaaauggguaacuuuuauaucauuauuauuccuauucaguucagcauauaguguacaaaaugaaucaaaaagguacacaguauccuaucuaaaaacguuaaauuauuacgauuuaguagaucuccuagucaaaacugaaauagaaaacuuaccagaccuauuccaauauucguccgaugcaaaagaauuuuauggaaauaaaacccgaaugucauucaucauggacgaaauuggacgaagggcaccgcaauacacagaaauagaucacaaagguauuccaacccucguagaagucguaagagcuggcuucuaccuaggauuucauaauaaagaauuaaaugaaauaaacaaaaggucauucaaagaaagaguaauacccuccauauuagcaauacaaaaaaauccuaacuuuaaacuuggaacagaaguucaagacaaaaucguuucagcgaccgguuuacuggcaggcaacgaaacagcaccucccgaagucguaaacaacuucacaccaauuuuacaagauuguauaaaaaauauugaucgauacgcuuuagacgaccuuaaaagcaaagcgcuauucaacguacucgcagcaccuacauacgauaucaccgaauaccuucgagcuacaaaagaaaaaccagaaaauacuccuugguauggcaaaauagacggauucauaaacgaauuaaaaaaauuagcuuuauauggaaaaauuaaugauaauaacucauggauaauagacaauggaauauaucacauugcaccauuaggaaaauuacauucuaauaauaaaauaggaauagaaacauugacagaaguaaugaaaguguaccccuaccuaagcaugcaacauuuacagucagcugaucaaauuaaacgacacuacgauucaaaagacgcagaaggcaauaaaaucccacuugacaaauucaaaaaagaaggaaaagaaaaauacuguccaaaaacauauacauuugacgacggaaaaguaauaauaaaagcuggugcaagaguagaagaagaaaaagucaaaagacuauauugggcaagcaaagaaguaaauucacaauucuuucgaguauauggaauugacaaaccccuagaagagggaaacccagacgauauacuaacaauggugauauacaacucaccagaagaauauaaacuaaacaguguacuauacggauacgauacaaacaauggcgggauguacauagaaccagaagguacauucuucacguaugaaagggaagcacaagaauccaccuacacacucgaagaacuauucagacaugaauacacucauuaucuacaaggcagauaugccguaccgggacaauggggaagaacaaaauuauaugacaacgacagauuaacaugguaugaagaaggaggagcagaacuauuugcuggcaguaccagaacaagugggauccuucccagaaaaucaauugugaguaacauacacaacacaacgagaaauaauagauauaaacuaagcgauaccguacauaguaaauauggagccucguucgaauuuuauaauuaugccuguauguucauggauuacauguauaacaaagauauggguauauuaaauaaauuaaacgaccucgcuaaaaauaaugauguagacggauacgacaacuacauaagagauuuauccagcaacuaugcauuaaaugacaaauaucaagaccacaugcaagaaagaaucgacaacuaugaaaaucuuacuguaccauucguagcagacgauuaccuaguuagacacgccuauaaaaaucccaacgaaauauauagcgaaauaucugaaguagcaaagcuaaaagacgcaaaaagcgaagugaaaaaaucacaauacuuuucaacuuucacauugagaggcucauacacaggaggugcaagcaaaggaaaauuagaagaucaaaaagcaaugaauaaauuuauagacgacagucuaaaaaaauuagauacauacucauggucagguuacaaaacacuaacggcauacuucacaaacuauaaaguagauuccucaaauagaguaacauacgaugucguuuuucauggauaucuaccuaacgaaggagacagcaagaauagucuaccauauggaaaaauaaauggaacguacaaaggaacugaaaaagaaaaaaucaaauucucaucagaaggcaguuucgaucccgacgggaaaauaguaucauacgaaugggauuuuggagauggcaacaaaucaaacgaagaaaacccagaacauucauaugauaaagucggaaccuacacaguaaaacuaaaaguaaccgaugacaagggagaaucaucgguuuccaccacgacagcugaaauaaaagacuuaucagaaaacaaauuacccguaauauacaugcacguaccaaaaucaggcgcgcuuaaccaaaaagugguuuucuauggaaaaggcacauacgauccagauggaagcaucgcaggauaccagugggauuucggagaugguucagauuuuaguucugaacaaaauccuagccauguauacaccaaaaaaggugaauacacaguuacacuuaggguuauggacuccucaggacaaaugagcgaaaaaacaaugaaaauaaaaauaaccgacccaguauacccaauaggaaccgaaaaggaaccaaacaauucuaaagaaacagcaucagguccaauaguaccaggaaucccagugucagggacaauagaaaacacaucagaccaagacuauuucuauuucgacguaauaacacccggagaaguaaaaauagacauaaacaaauuaggauacgguggcgccacuuggguuguauaugacgaaaacaacaacgcaguaucuuaugcaacugacgacggccaaaacuuaaguggaaaguuuaaagccgauaaaccuggacgauacuacauacaccuauacauguucaacggcaguuacaugccauacagaauaaacauagaagguagcguuggucgauaa

SEQ ID NO: 1292 - RNA, 3138 nt, Artificial Sequence
  derived and/or modified CDS sequence (opt13) from Clostridium histolyticum__BAA34542.1__HsALB(1-18)_ColH(1-40)_CS-F_ColH(41-102 1)
augaaauggguaacauucaucagcuuacuauuuuuauuuucaucugccuauuccaugaaaagaaaaugucuaucaaaaagauuaauguuagcaauaacaauggcuacaauauucacggucaacaguacacucccaauauacgcugcagucgacaaaaacaacgcgacugcagcacgcaggcgcagaaaaagaguacagaaugaaucaaaacgauacaccgugucguaccuaaaaacccuaaauuacuacgaccucguugaccuauuaguaaaaacagaaauagaaaauuuaccagaccuuuuucaauacucaagcgaugccaaggaauuuuacggaaauaaaacaaggaugaguuucauaauggaugagaucggccgccgagcaccacaauauaccgaaauagaucauaaaggaaucccgacguugguugaaguuguuagagcaggauucuauuuggguuuucacaacaaagaacuaaaugaaauaaauaaacgcagcuucaaagaaagaguaauaccaagcaucuuagcgauucagaaaaauccuaauuucaaacuaggaacggaaguacaagacaaaaucgucucagcaacgggauuguuagcgggaaacgaaaccgcuccaccagaagucguaaacaacuuuacccccauacuacaagacugcaucaaaaauauagauagauacgcauuagaugauuuaaaaucuaaagcauuauucaacguauuggcggcaccaacauaugauauaacagaauauuuaagagcgacaaaagaaaaaccagaaaacacuccaugguauggcaaaauugacggauuuauaaaugaauuaaagaaauuggcccuauacggaaaaauaaaugacaauaacagcuggaucauugacaacggaauauaccacauagcucccuuaggaaaacuacauaguaacaauaaaaucgguauagaaacauuaacugaaguaaugaaaguuuacccauaucuaaguaugcaacauuuacaaucagcagaucaaauaaaaaggcacuaugauagcaaagacgcagagggaaacaaaauaccacuagacaaauuuaagaaagagggaaaagaaaaauacuguccaaaaaccuacacauucgaugacggaaaaguaaucauaaaagcaggagcaagaguagaagaggaaaaaguaaaacgauuauauugggcaucuaaagaaguuaauucucaauucuucagaguauacggaauagacaaaccacuagaagaaggcaauccagacgacauauuaacaaugguaauuuacaacaguccugaagaauauaaauuaaauucaguauuauauggauacgacacaaacaauggaggaauguacaucgaacccgaaggcacauucuuuaccuacgaaagagaggcucaagaaucuacuuauacucucgaagaacuuuuuaggcaugaauauacacacuaucuccaagguagauaugccguaccaggacaaugggguagaacaaaacuauacgauaaugacagacuuacuugguaugaagaaggaggcgcagaacuauuugcgggcagcacacguacuucaggcauccuaccacgaaaauccauaguuuccaacauccacaauacaacaagaaacaaccgauauaaauuaucagauacuguccacucaaaauacggugcguccuucgaauuuuacaacuacgcauguauguuuauggacuacauguauaauaaagauauggguauacuuaacaaauugaaugacuuagccaaaaauaaugauguagacggauacgauaacuacauaagagaccuaucaucaaacuaugcauuaaaugacaaauaucaagaccauaugcaagaaagaauugauaacuacgaaaacuuaacuguaccauucguagcagaugauuacuuaguaagacaugcauauaaaaauccaaacgaaaucuacagcgaaaucagcgaaguagccaaacucaaagaugccaaauccgaagugaagaaaucacaauacuucucaacauucacuuuaagagguaguuacacaggaggugcauccaaaggaaaauuagaagaccaaaaagccaugaauaaauuuauagacgacagucuaaagaaauuagauaccuacucauggaguggauacaaaacauuaacagccuacuucacaaacuacaaaguagauucaucuaaccgagucaccuacgacguaguauuucauggcuacuuaccaaacgaaggcgauagcaaaaacucacuaccguacggcaaaauuaacggcacauacaaaggaacagaaaaagagaaaaucaaauucuccuccgaagguagcuucgacccagacgguaaaaucguaaguuaugaaugggauuucggugacggcaacaaaucgaacgaagaaaacccagaacacagcuaugauaaaguagguacauauacagucaaacuaaaaguaaccgaugauaaaggugaaucgucugucucaacgaccacagccgaaauaaaagauuuguccgaaaauaaauuaccagucaucuauaugcaugucccaaaaucaggagcccuaaaccaaaaagugguuuucuauggaaaaggaacauacgacccugauggaucaauagcaggcuaucaaugggauuucggugacggcucagacuuuagcagugaacaaaauccaucgcauguguacacaaagaaaggagaauacacaguaacacuacgagucauggauucuuccggacaaaugagugagaaaacgaugaaaauuaaaauaacagacccaguauacccaauaggaacagaaaaagaaccaaauaacuccaaagaaaccgcaucuggaccaauaguccccggaauaccaguaagcggcacuaucgaaaauacaucagaccaagacuauuuuuacuuugacguaauaaccccaggagaaguaaaaauagacauaaauaaauuaggauacggcggcgcuacauggguaguuuacgacgaaaacaacaaugcaguaucauacgcaacagaugacggacaaaacuuaaguggaaaauuuaaagcugacaaaccaggaagauauuacauacauuuauauauguucaauggauccuauaugccauacagaaucaacauagaaggaagcguaggaagguaa

SEQ ID NO: 1293 - RNA, 576 nt, Artificial Sequence
  derived and/or modified CDS sequence (opt13) from Homo sapiens__NP_001133.1__HsAMELX
augggaacauggauauuauucgcaugccuacuaggagcagcauucgcaaugccacuaccaccacacccaggacacccaggauacauaaacuucucauacgaaguacuaacaccacuaaaaugguaccaaucaauacgacccccauacccaucauacggauaugaacccaugggaggauggcuacaccaccaaauaauaccaguacuaucacaacaacaucccccaacacacacauuacaaccucaccaccacauaccaguaguaccagcacaacaaccaguaauaccacaacaaccaaugaugccaguaccaggacaacacucaaugacaccaauacaacaccaccaaccaaaccuaccaccaccagcccaacaaccauaccaaccacaaccaguacaaccacaaccacaccaaccaaugcaaccacaaccaccaguacacccaaugcaaccacuaccaccacaaccaccacuaccaccaauguucccaaugcaaccacuaccaccaaugcuaccagaccuaacacucgaagcauggccaucaaccgauaaaacaaaaagagaagaaguagacuaa

SEQ ID NO: 1294 - RNA, 135 nt, Artificial Sequence; identical to SEQ ID NO: 712
  derived and/or modified CDS sequence (opt13) from Homo sapiens__NP_001133.1__HsAMELX-TRAP

SEQ ID NO: 1295 - RNA, 168 nt, Artificial Sequence; identical to SEQ ID NO: 713
  derived and/or modified CDS sequence (opt13) from Homo sapiens__NP_001133.1__HsAMELX-LRAP

SEQ ID NO: 1296 - RNA, 207 nt, Artificial Sequence; identical to SEQ ID NO: 714
  derived and/or modified CDS sequence (opt13) from Homo sapiens__NP_001133.1__HLA-A2-SP_HsAMELX(17-60)

SEQ ID NO: 1297 - RNA, 240 nt, Artificial Sequence; identical to SEQ ID NO: 1200
  derived and/or modified CDS sequence (opt13) from Homo sapiens__NP_001133.1__HLA-A2-SP_HsAMELX(17-47,168-191)

SEQ ID NO: 1298 - RNA, 579 nt, Artificial Sequence
  derived and/or modified CDS sequence (opt13) from Homo sapiens__NP_001134.1__HsAMELY
augggaacauggauacuauucgcaugccuaguaggagccgcauucgcaaugccacuaccaccacauccaggacacccaggauauauaaacuucucauacgaaguauuaacaccacucaaaugguaccaauccaugauaagacccccauacucaucauacggauacgaaccaaugggcggauggcuacaccaccaaauaaucccaguaguaucccaacaacacccacuaacacacacauuacaaucacaccaccacauaccaguaguaccagcacaacaaccaagaguaagacaacaagcauuaaugccaguaccaggacaacaaucaaugacaccaacacaacaccaccaaccaaaccuaccacuaccagcacaacaacccuuccaaccucaaccaguacaaccacaaccacaccaaccaaugcaaccacaaccaccaguacaaccaaugcaaccacuauuaccacaaccaccacuaccacccauguucccacuaagaccauuaccaccaauacuaccagaccuacaccuagaagccuggccagcaacagacaaaacaaaacaagaagaagucgacuaa

SEQ ID NO: 1299 - RNA, 138 nt, Artificial Sequence; identical to SEQ ID NO: 717
  derived and/or modified CDS sequence (opt13) from Homo sapiens__NP_001134.1__HsAMELY-TRAP

SEQ ID NO: 1300 - RNA, 171 nt, Artificial Sequence; identical to SEQ ID NO: 1203
  derived and/or modified CDS sequence (opt13) from Homo sapiens__NP_001134.1__HsAMELY-LRAP

SEQ ID NO: 1301 - RNA, 210 nt, Artificial Sequence
  derived and/or modified CDS sequence (opt13) from Homo sapiens__NP_001134.1__HLA-A2-SP_HsAMELY(17-61)
auggcaguaauggcaccaagaacacuaguacuacuacuaucaggagcacuagcacuaacacaaacaugggcaaugccacuaccaccacacccaggacacccaggauauauaaauuucucauacgaaguacuaacaccacuaaaaugguaucaaucaaugauaagaccaccauacucaucauacggauacgaaccaaugggaggaugguaa

SEQ ID NO: 1302 - RNA, 243 nt, Artificial Sequence
  derived and/or modified CDS sequence (opt13) from Homo sapiens__NP_001134.1__HLA-A2-SP_HsAMELY(17-48,169-192)
auggcaguaauggcaccaagaacauuaguacuacuacuaucaggagcacuagcacuaacacaaacaugggcaaugccacuaccaccacacccaggacacccaggauacauaaacuucucauacgaaguacuaacaccacuaaaaugguaucaaucaaugauaagaccaccaccaauacuaccagaccuacaccuagaagcauggccagcaacagacaaaacaaaacaagaagaaguagacuaa

SEQ ID NO: 1303 - RNA, 570 nt, Artificial Sequence
  derived and/or modified CDS sequence (opt13) from Sus scrofa__NP_999071.1__SsAMELX-001-1
augggaacauggauacuauucgcaugccuacuaggagcagcauucucaaugccacuaccaccacacccaggacauccaggauacauaaacuucucauacgaaguacucacaccauuaaaaugguaccaaaacaugauaagacacccauacacaucauacggauacgaaccaaugggcggauggcuacaccaccaaauaauaccaguaguaucacaacaaaccccacaaucacacgcauuacaaccacaccaccauauaccaaugguaccagcacaacaaccaggaauaccacaacaaccaaugaugccacuaccaggacaacacucaaugacaccaacccaacaccaccaaccaaaccuaccccuacccgcacaacaaccauuccaaccacaaccaguacaaccccaaccacaccaacccuuacaaccacaaucaccaaugcacccaauacaaccacuacucccacaaccaccacuaccaccaauguucucaaugcaaucacuacuaccagaccuaccauuagaagcauggccagcaacagacaaaacaaaaagagaagaaguagacuaa

SEQ ID NO: 1304 - RNA, 138 nt, Artificial Sequence; identical to SEQ ID NO: 722
  derived and/or modified CDS sequence (opt13) from Sus scrofa__NP_999071.1__SsAMELX-TRAP

SEQ ID NO: 1305 - RNA, 171 nt, Artificial Sequence
  derived and/or modified CDS sequence (opt13) from Sus scrofa__NP_999071.1__SsAMELX-LRAP
augccacuaccaccacacccaggacacccaggauacauaaacuucucauacgaaguacuaacaccacuaaaaugguaccaaaacaugauaagacacccaucacuacuaccagaccuaccauuagaagcauggccagcaacagacaaaacaaaaagagaagaaguagacuaa

SEQ ID NO: 1306 - RNA, 210 nt, Artificial Sequence; identical to SEQ ID NO: 724
  derived and/or modified CDS sequence (opt13) from Sus scrofa__NP_999071.1__HLA-A2-SP_SsAMEL(17-61)

SEQ ID NO: 1307 - RNA, 243 nt, Artificial Sequence
  derived and/or modified CDS sequence (opt13) from Sus scrofa__NP_999071.1__HLA-A2-SP_SsAMEL(17-49,167-189)
auggcaguaauggcaccaagaacauuaguacuacuacuaucaggagcacuagcacuaacacaaacaugggcaaugccacuaccaccacacccaggacacccaggauacauaaacuucucauacgaaguacuaacaccacuaaaaugguaccaaaacaugauaagacacccaucacuacuaccagaccuaccacuagaagcauggccagcaacagacaaaacaaaaagagaagaaguagacuaa

SEQ ID NO: 1308 - RNA, 534 nt, Artificial Sequence
  derived and/or modified CDS sequence (opt13) from Sus scrofa__P45561-2__SsAMELX-001-2
augggaacauggauacuauucgcaugccuauuaggagcagcauucucaaugccacuaccaccacacccaggacacccaggauauauaaacuucucauacauaagacacccauacacaucauacggauacgaaccaaugggaggauggcuacaccaccaaauaauuccaguaguaucacaacaaacaccacaaucacacgcacuacaaccacaccaccacauaccaaugguaccagcacaacaaccaggaauaccacaacaaccaaugaugccacuacccggacaacacucaaugacacccacacaacaccaccaaccaaaccuaccacuaccagcacaacaaccauuccaaccacaaccaguacaaccacaaccacaccaaccauuacaaccacaaucaccaaugcacccaauacaaccacuacuaccacaaccaccacuaccacccauguucucaaugcaaucacuacuaccagaccuaccacuagaagcauggccagcaacagacaaaacaaaaagagaagaaguagacuaa

SEQ ID NO: 1309 - RNA, 570 nt, Artificial Sequence
  derived and/or modified CDS sequence (opt13) from Sus scrofa__NP_998965.1__SsAMELX-001-3
augggaacauggauauucuucgcaugccuauuaggagcaucccuagcaaugccacuaccaccacacccaggacacccaggauacauaaacuucucauacgaaguacucacaccauuaaaaugguaccaaaacaugauaagacacccauacacaucauacggauacgaaccaaugggaggcuggcuacaccaccaaauaauaccaguaguaucacaacaaacaccacaaucacacgcacuacaaccacaucaccacauaccaaugguaccagcccaacaaccaggaauaccacaacaaccaaugaugccacuaccaggacaacacucaaugacaccaacacaacaccaccaaccaaaccuaccacuaccagcacaacaaccauuccaaccacaaccaguacaaccacaaccccaccaaccacuacaaccacaaucaccaaugcacccaauccaaccacuacuaccacaaccaccacuaccaccaauguucucaaugcaaucccuacuacccgaccuaccacuagaagccuggccagcaacagacaaaacaaaaagagaagaaguagacuaa

SEQ ID NO: 1310 - RNA, 219 nt, Artificial Sequence; identical to SEQ ID NO: 728
  derived and/or modified CDS sequence (opt13) from Sus scrofa__K7GPB2__SsAMELX-002

SEQ ID NO: 1311 - RNA, 612 nt, Artificial Sequence
  derived and/or modified CDS sequence (opt13) from Sus scrofa__K7GLD0__SsAMELX-003
augggaacauggauacuauucgcaugccuauuaggagcagcauucucaaugccacuaccaccacacccaggacacccaggauacauaaacuucucauacgaagaccuauacuuagaagcaauaagaauagacagaacagcauucguacuaacaccacuaaaaugguaccaaaacaugauaagacacccauacacaucauacggcuacgaaccaaugggaggauggcuacaccaccaaauaauaccagucguaucccaacaaacaccccaaucacacgcauuacaaccacaccaccacauaccaauggucccagcacaacaaccagguauaccccaacaaccaaugaugccacuaccaggacaacacucaaugacaccaacacaacaccaccaaccaaaccuaccacuaccagcacaacaaccauuccaaccacaaccaguacaaccacaaccacaccaaccacuacaaccacaaucaccaaugcacccaauacaaccacuacuaccacaaccaccauuaccacccauguucucaaugcaaucacuauuacccgaccuuccacuagaagcauggccagcaacagacaaaacaaaaagagaagaaguagacuaa

SEQ ID NO: 1312 - RNA, 498 nt, Artificial Sequence
  derived and/or modified CDS sequence (opt13) from Sus scrofa__K7GPE9__SsAMELX-004
augggaacauggauacucuucgcaugccuacuaggcgcagcauucuccaugccacuaccaccacacccaggacaccccggauacauaaacuucucauacgaaguacucacaccacuaaaaugguaccaaaacaugauaagacacccaacaccacaaucacacgcacuacaaccacaccaccacauaccaaugguaccugcacaacaaccaggaauaccacaacaaccaaugaugccacuaccaggccaacacuccaugacacccacacaacaccaccaaccaaaccuaccacuaccagcccaacaaccauuccaaccacaacccguacaaccacaaccacaccaaccauuacaaccccaaucaccaaugcacccaauacaaccacuacucccacaaccaccacuaccaccaauguucucaaugcaaucacuacuaccagaccuaccacuagaagcauggccagcaacagacaaaacaaaaagagaagaaguagacuaa

SEQ ID NO: 1313 - RNA, 522 nt, Artificial Sequence
  derived and/or modified CDS sequence (opt13) from Sus scrofa__J9JIM4__SsAMELX-201
augccacuaccaccacacccaggacacccaggauacauaaacuucucauacgaaguacuaacaccacuaaaaugguaccaaaacaugauaagacaccccuacacaucauacggauacgaaccaaugggaggauggcuacaccaccaaauaauaccaguaguaucacaacaaacaccacaaucacacgcacuacaaccacaccaccacauaccaaugguaccagcccaacaaccaggcauaccacaacaaccaaugaugccacuaccaggacaacacucaaugacaccaacacaacaccaccaaccaaaccuaccacuaccagcacaacaaccauuccaaccacaaccaguacaaccacaaccacaccaaccacuccaaccacaaucacccaugcaccccauacaaccauuacuaccacaaccaccacucccaccaauguucuccaugcaaucacuacuaccagaccuaccacuagaagcauggccagcaacagacaaaacaaaaagagaagaaguagacuaa

SEQ ID NO: 1314 - RNA, 2961 nt, Artificial Sequence
  derived and/or modified CDS sequence (opt13) from Homo sapiens__NP_006120.1__HsBMP1
augccagguguagcacgucuaccauuauugcuagguuuauugcuacuaccccgaccgggacgaccacuagacuuagccgauuacacauaugaccuagcagaagaggacgauagugaaccauuaaacuacaaagauccauguaaagcugccgcauucuuaggugauauagcuuuagacgaagaagauuuacgugcauuucaaguccagcaagcaguagauuuacguagacauacugcacgcaaaaguucaauaaaagcagcuguaccaggaaacacaucaacaccuuccugucaaucaacaaauggucaaccucaaagaggggcuugcggacguuggagggggagaaguagaaguagacgugcagcaacaagucgaccagaacgaguauggccagauggaguaauuccauuuguaauugguggaaacuuuacuggaucacaaagagcuguauucaggcaagcuaugagacauugggaaaaacauacuugcguuacauucuuagaacgaacagaugaagauuccuauauaguauuuacuuauagaccuugugggugcuguaguuauguggguagaagaggggguggaccacaagcaauaucaauugguaaaaauugugacaaauuuggaauaguuguacaugaacuaggacauguaguaggauuuuggcacgaacauacaagaccagauagagacagacauguauccauaguuagagaaaauauacaaccaggacaagaauauaauuuccuaaaaauggagccacaggaaguagagaguuugggagaaacuuacgacuucgacaguauaaugcauuaugcaagaaauacuuuuucacgaggaauauuccuagauacuauugugccuaaauacgaagugaaugguguaaaaccuccaauuggucaaaggacuagguuaagcaaaggagauauagcacaagcgcgcaaacuuuauaaauguccagcauguggugaaacauuacaggacucaacaggaaauuuuucaucaccugaauacccuaacggguauagugcacauaugcacuguguauggagaauaucaguaacaccaggagagaaaauaauauuaaacuucacuagccuggaucuuuauagaucgagacucuguugguaugauuauguagaaguuagagauggcuucuggagaaaagcaccauugagagggcguuuuuguggcaguaaacuaccagaaccaauaguaucuacagauuccagauuaugggucgaguucagaaguucauccaauuggguaggaaaagguuucuucgccguauaugaagcgauaugcggaggggauguaaagaaagacuauggucauauacaaagcccuaauuauccugaugacuauaggccaaguaaaguuuguauuuggagaauacaagugucagaagguuuucacguuggacucacauuucaaucuuuugaaauagagcgccaugacucaugugcguaugacuauuuagagguaagagacggacauucagaaucuucuacucuuauaggaagauauuguggauaugagaaaccagaugauauaaaaaguacaaguucucgacuaugguuaaaauuuguaagcgauggaagcauaaauaaagcaggauuugcaguaaauuucuuuaaagaaguugaugaaugcucgagaccuaauagagggggaugcgaacaacgaugucuaaauacacucggaagcuacaaauguagcugugauccaggauaugaacuugcaccggacaaaagaagaugugaagcugcaugcggcggauuucuaaccaaacucaauggaucaauuacuuccccaggauggccuaaagaauauccaccgaauaaaaacugcauauggcaauuaguagcuccaacacaauaucgcaucagcuuacaauuugacuucuuugaaacugagggaaaugauguuuguaaauaugacuuugucgaagucagaucaggccucacagcagauucuaaauuacacggcaaauuuuguggaagcgaaaaaccggaaguaauaacaucacaauacaauaacaugagaguagaguuuaaaagcgauaauacaguaaguaagaaaggauuuaaagcacacuucuucucagauaaagacgaauguucaaaagacaaugggggaugucaacaagacuguguaaauacguuuggaucauaugaaugucaaugccgaaguggauucguacuucaugauaauaaacaugauuguaaagaagcagguugcgaucacaaaguuacaucaacuucaggcacaauaacuucaccuaacuggccagauaaauauccaucaaagaaagaauguacaugggcaauaucuucaaccccaggucaucgcguaaaauuaacauuuauggaaauggauauugaaucacaaccagaaugugcauaugaucacuuagaaguauucgacggaagggaugcaaaagcaccaguauuagguagauuuuguggcaguaagaaaccagaaccaguucuugcgacaggaagccguauguuuuuaagauuuuacucagauaauuccguacaaagaaaaggauuucaagccucccaugcgacggaauguggaggacaaguacgagcagauguuaaaaccaaagaccuauacucacacgcacaauuuggugauaauaauuacccaggugggguagacugcgaauggguaauaguagcagaagaaggguacggaguugaauuaguauuccaaacauuugaaguagaagaagaaaccgauuguggcuaugauuauauggaacuauucgacggauacgacuccacagcaccgagauuaggacgauacuguggaaguggaccaccagaagaaguuuauucagcaggagacucagucuuagugaaauuucauucggacgacacaauaaccaagaaaggauuccacuuaagauacacuucaacuaaauuccaagauacacuacacaguagaaaauaa

SEQ ID NO: 1315 - RNA, 1191 nt, Artificial Sequence
  derived and/or modified CDS sequence (opt13) from Homo sapiens__NP_001191.1__HsBMP2
auggucgccggaaccagaugccuauuagcccuacuauuaccacaaguucuacuagguggagcugcaggauuaguaccagaacuaggaagacgaaaauucgcggcagcauccucaggaagaccaucaucacagccaucagacgaaguacuauccgaauucgaacuaagguuauuaucuauguuuggauuaaaacaaagaccaacgccaucuagagacgcagucguuccaccauacaugcuagaucuauauagaagacacuccggacaaccaggauccccagcacccgaucauagauuagaacgagccgcaucacgugcaaacaccguaagauccuuccaccacgaagaaucucuagaagaacuaccagaaacaucaggaaaaacuacaagaagauucuucuuuaaccuaucaucuaucccaacagaagaauucaucacaucagcagaauuacaagucuuuagagaacaaaugcaagacgcauuaggaaauaacucaucauuucaccacagaauuaacauauacgaaauaaucaaaccagcaaccgcaaacagcaaauucccagucacucgauuacuagauacaagacuaguuaaccaaaacgcaucaagaugggaaucauuugacguaacucccgcaguuaugagauggacagcacaaggacacgcaaaucacggauuugucguugaaguagcccauuuagaagaaaaacaaggaguuucaaaaagacacguccgcauaagcagaucacuacaucaagacgaacauucuuggagucaaauaagaccacuacuuguaacauucggccacgacggaaaaggacacccauuacacaaaagagaaaaaagacaagcaaaacacaaacaaagaaaaagacuaaaaucaucaugcaaaagacauccauuauacguagauuucucagauguaggauggaacgacuggauaguagcaccaccaggauaccacgcauuuuacugccauggagaaugcccauuuccacuagcagaccaccucaacucaaccaaccacgcaauaguucaaacccuaguaaauucaguaaauucaaaaauaccaaaagcaugcugugucccaacagaacuuucugcaauaucaaugcuauauuuagaugaaaacgaaaaaguaguucuaaaaaauuaccaagacauggucguagaaggaugcggauguagauaa

SEQ ID NO: 1316 - RNA, 1227 nt, Artificial Sequence
  derived and/or modified CDS sequence (opt13) from Homo sapiens__NP_001193.2__HsBMP4
augauaccaggaaauagaaugcucaugguaguauuauuaugccaaguacuucuagguggagcuucacaugcaucacuuauaccagaaaccggaaaaaaaaaaguagcagaaauacaaggacaugccggaggaagaagauccggacaaucacaugaauuacuacgagauuuugaggccacuuuauuacagauguucggauuaagaagacgaccucaaccaucaaaaucagcaguaauuccagacuacaugcgagaucuauacagauuacaaucaggagaagaagaagaagaacaaauacacaguaccggacuagaauacccagaaagaccagcaucaagagccaauaccguuagaucauuccaccaugaagaacauuuagaaaauauaccaggaacaucagaaaauucagcuuucagauuuuuauucaauuuaagcagcauaccagaaaacgaagucauaucaucagcagaacuaagacuauuuagagaacaaguugaccaaggaccugacugggaacgcggauuccacagaauaaauauauacgaaguaaugaaaccaccugcugaaguaguaccaggacaccuaauaacuagauuacuagauacaagacuaguacaccauaauguaacaaggugggaaacauuugacguaucaccggcaguauuacgguggacaagagaaaaacaaccaaauuacggacuagcaauagaagucacacacuuacaucaaacaagaacacaucagggucaacacguaagaauaucacgaucacuuccacaagguucagguaacugggcccaauuaagaccauuacuaguaacauuuggacaugacggaagaggacacgccuuaacacgaaggcgaagagccaaaagaaguccaaaacaccauucacaaagagcacgaaaaaaaaacaaaaauugccgaagacauucacuauacguagacuuuucagaugucggauggaaugacuggaucguagcaccaccaggcuaccaagcauuuuacugucacggagauugcccauuuccacuagcagaucacuuaaacucaaccaaucacgcaauaguacaaacacuaguaaauucuguaaacagcucuauaccaaaagcuuguuguguaccaacagaacuaucagccauaucuauguuauaucuagaugaauaugauaaaguaguauuaaaaaacuaucaagaaauggucguagaaggaugcggauguagauaa

SEQ ID NO: 1317 - RNA, 1542 nt, Artificial Sequence
  derived and/or modified CDS sequence (opt13) from Homo sapiens__NP_001709.1__HsBMP6
augcccggauuaggaagacgagcacaauggcuaugcugguggugggguuuauuauguagcuguugcgguccaccaccuuuaagaccaccauuaccagccgcagcugcugcugcagcaggcggucaacuauuaggagaugggggaucacccgggagaacagaacaacccccaccaucaccccaaagcucaucaggguucuuauacagaagauuaaaaacacaagaaaaacgcgaaaugcaaaaagaaauacuaaguguauuaggauugccacauagaccuagaccauuacauggauuacaacaaccacaaccuccagcuuuaagacaacaagaagaacaacaacaacaacaacaauuacccagaggagaaccacccccaggaagacuaaaaucugcuccauuauucaugcuagaccuauacaaugcacuaagcgcagacaaugacgaagauggagcuucugaaggagaaagacaacaaucauggccucaugaagcagcuucaagcagucaaaggagacaaccaccaccaggagcagcacacccacuuaaucgaaaaagccuacuagcacccggcucuggaucaggaggcgcaaguccauuaacaucagcacaagauagcgcguuuuuaaaugacgcagacaugguaaugucauucgugaauuuaguagaauacgauaaagaauuuucuccaagacaaagacaccacaaagaguucaaauucaaucuaucccaaauaccugaaggagaaguaguaacugcagcagaauuuagaaucuacaaagacuguguaaugggaucauucaaaaaucaaacuuucuuaauaucuaucuaccaaguauuacaagaacaucaacauagagacucugauuuauuccucuuagacacaagaguuguaugggcaucagaagaagguuggcuagaauuugacauuacugcaacaucaaacuuauggguaguaacaccacaacauaacaugggacuacaauuaucagucguaaccagagaugguguucauguacacccuagagcugcaggacuuguaggcagagacggaccauacgauaaacaaccauucaugguagcauucuucaaaguaucagaaguacauguaagaacaacacgaucugcuagcucaagaagaagacaacaaagucgcaacagaucuacacaaucacaagauguagcacgaguaucaucugcuucagacuauaacuccuccgaacuaaaaacagcaugcaggaaacacgaauuauacguuuccuuccaagauuuaggauggcaagacuggauaauagcacccaaaggauacgcugcaaacuacugcgacggugaauguucauuuccauuaaaugcacauaugaacgcaacaaaccaugcaaucguacaaacucuaguacaccuaaugaauccagaauauguccccaaaccauguugcgcacccacaaaacuuaacgcaauaucagucuuauacuuugacgacaauucaaauguaauccuaaagaaauauagaaacaugguagucagagccugcgguugccauuaa

SEQ ID NO: 1318 - RNA, 1296 nt, Artificial Sequence
  derived and/or modified CDS sequence (opt13) from Homo sapiens__NP_001710.1__HsBMP7
augcauguaagaucacuaagagcagcugccccacacucauuuguagcacugugggcaccacuuuuuuuacuaagaagcgcauuagcagacuuuucacuagacaaugaaguacauucaagcuuuauucauaggagacuucggucacaagaaagacgugaaaugcaaagagaaauauuaucuauucuaggacuaccacaccgcccaagaccacaucuacaaggaaaacacaauucagcuccaauguucaugcuagaucuuuauaacgcaauggcagucgaagaaggaggaggccccggaggacaaggauuuuccuauccauauaaagcaguauuuucaacacaaggaccuccucuagcaagucuacaagauucacauuucuuaacagaugcagauaugguaaugucauuuguaaauuuaguagaacaugauaaagaauuuuuucacccacguuaccaccauagagaauucagauucgaucuaucuaaaauaccagaaggugaagcaguaacagcagcugaauucagaauauacaaagauuacauacgagaaagauuugacaacgaaacauucagaauaucaguauaucaaguacuacaagaacacuuagguagagaaagcgaucuauuucuauuagacuccagaacacucugggcaucagaagaaggcuggcuaguauucgauauaacagcaaccaguaaucacugggucguaaacccaagacacaaccucggacuacaauuaucaguagaaacauuagacggccaaaguauuaacccaaaacucgcaggacuaauaggaagacacggaccacaaaacaaacaaccauucaugguagcauucuuuaaagcaaccgaaguacacuucagaucaauacgaucaacaggauccaaacaaagaagccaaaauagaucaaaaacuccaaaaaaucaagaagcauuaagaauggcaaauguagcugaaaauucaucaagugaucaaagacaagccugcaaaaaacacgaauuauacguauccuuccgagauuuaggauggcaagacuggauaauagcaccugaaggcuacgccgcauacuacugugaaggagaaugugcauuucccuuaaacucauauaugaacgcaacuaaucacgcuauaguacaaacacuaguacacuuuauaaaucccgaaacaguacccaaaccaugcugcgcaccaacacaacucaacgcuauaucaguauuauauuuugacgacucuucuaacguuauccuaaaaaaauaucgaaauaugguagucagagcauguggcugccacuga

SEQ ID NO: 1319 - RNA, 300 nt, Artificial Sequence; identical to SEQ ID NO: 737
  derived and/or modified CDS sequence (opt13) from Homo sapiens__NP_006264.2__HsCCL7

SEQ ID NO: 1320 - RNA, 3624 nt, Artificial Sequence
  derived and/or modified CDS sequence (opt13) from Homo sapiens__NP_001954.2__HsEGF
auguugcuuacuuuaauaauauuacuuccaguugucaguaaauuuucguuugugucauuaucugcaccacaacauuggaguuguccagaagguacgcuagcaggcaacgguaauucuacgugugucgguccagcgccauuucuaaucuuuucucaugguaacuccauuuuuagaauagauacagaagguacaaauuacgaacaauuaguaguugacgcaggagucagcguaauaauggacuuucauuauaaugagaaaagaaucuauuggguagacuuggaaagacaauuacuucagcguguauucuugaauggauccagacaagaaagaguauguaauauagagaaaaauguaucagguauggcuauaaacuggauaaaugaagaagugauuuggucaaaucaacaagaagggaucauuaccguuacagacaugaaaggaaauaauucccacauacuacuaucagcacuaaaauaucccgccaauguugcaguagauccaguggaaagauuuauauuuugguccucagaaguagcaggaucauuauauagagcagacuuagacgguguggguguuaaggcuuuacuagaaacuucugagaaaauuaccgcaguaaguuuagacguuuuagacaaaagauuauuuuggauucaauauaauagggaagguucaaauucacuuauauguucuugcgacuaugaugguggaucagugcauauaaguaaacauccaacgcaacacaaucucuuugcaaugucuuuauuuggugauagaauauuuuacagcacuuggaaaaugaaaacaauauggauagccaacaaacauaccggaaaagauaugguaaggauaaaucuacacaguuccuucguuccuuuaggugaacuaaaaguaguacauccacuagcgcaaccuaaagcggaagaugacacuugggaaccagaacaaaaacuauguaaguuacgaaaaggcaacuguucaucuacagugugcgggcaagacuuacaaagucacuuauguaugugcgcggaaggcuaugcgcucaguagagauagaaaauauugugaagauguaaaugaaugugcauuuuggaaccauggauguacacuaggaugcaaaaauacaccagguucauauuauuguacuugucccguuggauuuguccuguuaccagacggcaaaaggugccaucagcuaguaaguuguccacguaauguuucagaauguagccacgauuguguuuugacaagugaaggaccacuaugcuuuugcccagaaggaucaguauuagaaagggauggaaaaacauguagugguuguaguucaccagauaauggagguuguagucaacuuuguguuccauuaucuccuguaucuugggaaugcgauuguuucccagguuaugauuuacaauuagaugagaaaaguugugcagcgucuggcccacaaccauucuuacucuuugcaaauucacaagauauaagacacaugcauuucgauggcaccgacuacggcacccuauuaagucaacaaauggggaugguauaugcacuugaccaugauccaguagaaaacaaaauauacuucgcacauaccgcacucaaauggaucgaaagagcaaauauggacggaagucaaagggaacgguugauugaagaaggaguagauguaccugaggguuuagcaguugauuggauagggaggagauuuuauuggacggacagggggaaaaguuuaauaggacgaagcgaccucaacgggaaaagaagcaaaauaaucacuaaagaaaauauuucacaaccaagaggaauugcuguacauccaauggcaaaacgucuauuuuggacagacacaggaauaaauccuagaauagaguccaguucacugcaaggauuggggagauuagugaucgccaguuccgaccuaauauggccaucgggaauuacaauagacuuuuuaaccgauaaacuauauuggugcgaugcaaaacagucaguaauugaaauggccaaucuagauggaucuaaaagaagaagacuaacacaaaaugaugugggacacccauuugcuguugccguuuucgaggacuacgucugguuuucagauugggcaaugccaagugucaugagagucaauaagagaacugguaaggauagagucagauuacaaggcucaauguuaaaaccaucgagucuagucguaguccacccauuagcaaaaccaggugcagaucccugcuuauaucaaaauggagggugcgaacacauauguaagaaaagacuuggcacagcaugguguucauguagagaaggauuuaugaaggcuucagauggaaaaaccuguuuagcauuagauggccaucaacuucucgccggaggagaaguugacuugaaaaaccaaguaacaccccuagauauauuaagcaaaacaagaguuagcgaagauaacauaacagaaucucaacauauguuaguagcagaaauuauggucucagaucaagaugacugcgcaccuguaggauguucuauguaugcuagaugcauaucagagggggaagaugcgacaugucaaugcuuaaaaggauuugcaggcgacggaaaauuaugcucagacauagacgaaugugaaaugggaguuccuguuuguccuccagcaucuuccaaauguauaaauaccgaaggugguuauguauguagauguagugaaggauaccaaggggacgguauccauuguuuagauauagaugaaugccaauugggagaacacuccuguggagagaacgcauccuguacaaauacugaaggagguuauacguguaugugcgcaggaaggcuuuccgaaccugguuuaauuugcccagauucaacaccucccccacaccuucgugaagaugaccaccauuauaguguacgaaauucagauucugagugcccacuaagccaugauggauauuguuuacacgauggaguaugcauguacauagaagcguuggauaaauacgcuuguaauugugugguuggauacauaggugaaagaugucaauaccgagaccuaaaauggugggaacuaagacaugccgggcacggacaacaacaaaaaguaauagucguugcaguguguguaguagucuuagucaugcuauuacuauugagccucuggggugcacacuauuauaggacacaaaaacuacuaucuaaaaaccccaaaaauccauaugaagaaucaagucgugaugucagaucaagaagaccagcagacacagaagacggaaugucaucguguccacaaccaugguuugugguaauuaaagaacaucaagaucucaaaaacggaggccaacccguugcuggugaagauggacaagcagcagaugguaguaugcagcccacaucauggcgacaagagccacaauuaugcggcaugggaacagaacaagguuguuggauuccaguuaguucugacaaaggaagcuguccgcaagugauggagaggucauuucauaugccaagcuacggaacacagacacucgaaggcggaguagagaaaccacauucgcuucuuucugcaaacccauuauggcaacaaagagcucuagauccaccucaccaaauggaauugacucaauaa

SEQ ID NO: 1321 - RNA, 510 nt, Artificial Sequence
  derived and/or modified CDS sequence (opt13) from Homo sapiens__NP_001423.1__HsEREG
augacagcaggcagaagaauggaaaugcuaugugcaggacgaguaccagcauuauuacuaugucuaggauuccauuuauuacaagcaguacuaagcacaacaguaauaccaagcuguauaccaggagaaagcucagacaauugcacagccuuaguacaaacagaagacaauccaagaguagcacaaguaaguauaacaaaaugcucaagcgauaugaauggauauugcuuacacggacaauguauauaucuaguagacaugagccaaaacuauugcagaugcgaagucggauacacaggaguaagaugugaacauuucuucuuaacaguacaucaaccacuaucaaaagaauacguagcauuaacaguaauauuaauaauacuauuucuaauaacaguaguaggaagcacauacuauuucuguagaugguacagaaacagaaaaucgaaagaaccaaaaaaagaauacgaacgaguaacaucaggagauccagaacuaccacaaguauaa

SEQ ID NO: 1322 - RNA, 468 nt, Artificial Sequence
  derived and/or modified CDS sequence (opt13) from Homo sapiens__NP_000791.1__HsFGF1
auggcagaaggagaaauaacaacauucacagcacuaacagaaaaauucaaccuaccaccaggaaacuacaaaaaaccaaaacuacuauacugcucaaacggaggacacuuccuaagaauacuaccagacggcacaguagacggaacaagagacagauccgaccaacacauacaacuacaacuaucagcagaaucaguaggagaaguauacauaaaaucaacagaaacaggacaauaccuagcaauggacacagacggacuacuauacggaucacaaacaccaaacgaagaaugccuauuccuagaaagacuagaagaaaaccacuacaacacauacauaucaaaaaaacacgcagaaaaaaacugguucguaggacuaaaaaaaaacggaagcugcaaaagaggaccaagaacacacuacggacaaaaagccauacuauuccuaccacuaccaguaucaucagacuaa

SEQ ID NO: 1323 - RNA, 867 nt, Artificial Sequence
  derived and/or modified CDS sequence (opt13) from Homo sapiens__NP_001997.5__HsFGF2
augguaggaguaggagggggagauguagaagauguaacaccaagaccagguggaugucaaauuagcggaagaggugcaagaggauguaauggaauaccaggagcagcagcuugggaagcagcauuaccgagaagacgaccgagaagacauccgagugugaauccaagaucaagagcagcuggaagcccaagaacaagaggaagaagaacagaagaaagaccaaguggaagcagauuaggagauagaggaagaggacgagcauuaccaggaggaagauuaggaggaagaggaagaggaagagcaccagagagaguaggagggagaggaagaggaagaggaacagcagcgccaagagcagcaccagcagcaagaggaucaagaccaggaccagcaggaacaauggcagcgggaaguauaacaacauuaccagcucuaccagaagauggaggaaguggggcguuuccaccaggacauuuuaaagauccaaaaagauuauauuguaaaaauggaggauuuuuuuuaagaauacauccagauggaagaguagaugggguaagagaaaaaucagauccacauauaaaauuacaauuacaagcggaagaaagaggagugguaaguauuaaaggaguuugugcaaauagauauuuggcgaugaaagaagaugggagguuauuagcaaguaaauguguaacggaugaauguuuuuuuuuugaaagacuagaaagcaauaacuauaacacauauagaucgagaaaauacacaucaugguauguagcauuaaaaagaacaggacaauauaaacuaggaaguaaaacaggaccaggacaaaaagcaauauuauuuuuaccaaugagugcaaagaguuaa

SEQ ID NO: 1324 - RNA, 585 nt, Artificial Sequence
  derived and/or modified CDS sequence (opt13) from Homo sapiens__NP_002000.1__HsFGF7
augcacaaauggauacuaacauggauacuaccaacacuacuauacagaagcugcuuccacauaauaugccuaguaggaacaauaucacuagcaugcaacgacaugacaccagaacaaauggcaacaaacguaaacugcucaucuccagaaagacacacaagaucauacgacuacauggaaggaggagacauaagaguaagaagacuauucugcagaacacaaugguaccuaagaauagacaaaagaggaaaaguaaaaggaacacaagaaaugaaaaacaacuacaacauaauggaaauaagaacaguagcaguaggaauaguagcaaucaaaggaguagaaucagaauucuaccuagcaaugaacaaagaaggcaaacuauacgcaaaaaaagaaugcaacgaagacugcaacuucaaagaacuaauacuagaaaaccacuacaacacauaugcaagcgcaaaauggacacacaacggaggagaaauguucguagcauuaaaccaaaaaggaauaccaguaagaggaaaaaaaacaaaaaaagaacaaaaaacagcacacuuccuaccaauggcaauaacauaa

SEQ ID NO: 1325 - RNA, 627 nt, Artificial Sequence
  derived and/or modified CDS sequence (opt13) from Homo sapiens__NP_001936.1__HsHBEGF
augaaauuauuaccaucaguaguacuaaaacuauuucuagcagcaguacuaucagcauuaguaacaggagaaagccuagaaagacuaagaagaggacuagcagcaggaaccucaaacccagacccaccaacaguaucaacagaucaauuacuaccacuaggcggaggaagagauagaaaaguaagagacuuacaagaagcagaccuagauuuacuaagaguaacauuaucaucaaaaccacaagcacuagcaacaccaaacaaagaagaacacggaaaaagaaaaaaaaaaggaaaaggauuaggaaaaaaacgagauccaugccuaagaaaauauaaagacuucugcauacauggagaaugcaaauacgucaaagaacucagagcaccaagcugcauaugucacccuggauaccacggagaaagaugccacggacuaagucuuccaguagaaaacagauuauacacauacgaccacacaacaauacuagcaguaguagcaguaguauuaagcucaguaugucuauuaguaauaguaggucuacuaauguucagauaucaccgaagaggaggauacgauguagaaaaugaagaaaaaguaaaacuaggaaugacaaauagccacuaa

SEQ ID NO: 1326 - RNA, 2187 nt, Artificial Sequence
  derived and/or modified CDS sequence (opt13) from Homo sapiens__NP_000592.3__HsHGF
auguggguaacuaaacuauuaccagcauuacuauuacaacauguccuacuacaccuacuauuacuaccuauugcaauaccauacgccgaaggucaaagaaaacgaagaaauacaauacaugaguucaaaaagucagcaaaaacaacauuaaucaaaauagacccagcacuaaaaauaaaaacaaagaaaguaaauacagcagaucaaugugcaaacagaugcacuagaaacaaaggacuaccauuuacauguaaagcauucguauuugauaaagcaagaaaacaaugucuaugguuuccauuuaauagcaugaguucaggaguaaagaaagaguucggacaugaauuugaccuauaugaaaauaaagacuauauaagaaauugcauaauagguaaaggaagaucauauaaaggaacaguuuccaucacaaaaucaggaauaaaaugucaacccuggucaucaaugauaccacacgaacauagcuuucuaccaagcucauacagagguaaagaucuacaagaaaauuauuguagaaauccgagaggugaagaaggcggaccaugguguuuuacuucuaauccagaaguacgauaugaaguaugugauauaccgcaaugcucagaaguagaauguaugacauguaacggagaaucauauagagguuugauggaucauacagaaucaggcaaaauaugucaaaggugggaccaccaaacuccacaucgacauaaauuucuaccagaacguuauccagauaaaggcuuugaugauaauuacugucgaaacccagacggacaaccaagaccuuggugcuacacauuagauccccauacucgaugggaauacugugcaauaaaaacaugcgcagauaacacaaugaaugacacagauguuccucuagaaacuacugaaugcauacaaggacaaggagaaggauaccgaggaacuguaaauacaauauggaauggaauaccuugucaaagaugggauucacaauauccucaugaacaugacaugaccccagaaaauuuuaaaugcaaagaucuaagagaaaauuauugcagaaacccagacggaucugaaucgccaugguguuuuacaacugauccuaacauaagaguaggcuauugcucucagauaccgaauugcgacaugagccauggacaagacuguuauagaggaaauggcaaaaauuacaugggaaaucucagucaaacaagaucaggauuaacuuguucaaugugggacaaaaauauggaagauuuacauagacacauauucugggaaccagacgcaucaaaauuaaaugaaaacuauugcagaaauccagaugacgacgcacacgggccaugguguuauacaggaaauccauuaauaccaugggacuacuguccuauaagccgaugugaaggagauacaacucccacaauuguaaacuuagaucauccaguaaucucaugugccaaaacaaaacaauuaagagucguaaacgguauaccuacuaggacaaacauaggcuggauggugucacuuagauauagaaauaaacacauaugcggaggcagucuuauaaaagaaucauggguccucacagcaagacaauguuuucccagcagagauuuaaaggacuaugaagcaugguuaggaauacacgauguacacggacgaggagacgaaaaauguaaacaaguacuaaauguuucucagcuagucuauggaccagaagggagcgauuuagucuuaaugaaacuagcaagaccggcagucuuagacgacuucguaucuacaauugauuuaccuaacuacggaugcacgauaccagaaaagacuagcuguucuguuuauggaugggguuauacuggacuaaucaacuacgacggacuauuaaggguggcacauuuauauauuaugggaaacgaaaaauguucucaacaccacagaggaaaaguaacauuaaacgaaucagaaauaugcgcaggagcagagaaaaucggaucaggcccgugugaaggagacuauggugggccgcuagugugcgaacaacacaaaaugcgaaugguauuagggguaauaguaccuggacggggaugcgccauaccaaauagaccaggaauauucguaagaguagcauauuaugccaaauggauacauaaaauaauacuaacauauaaaguaccacaaucuuaa

SEQ ID NO: 1327 - RNA, 1926 nt, Artificial Sequence
  derived and/or modified CDS sequence (opt13) from Homo sapiens__NP_005336.3 __HsHSPA1A
auggccaaagcagcugcaauaggaauagaucuaggaacaacauacuccuguguaggaguauuccaacacggaaaaguagaaauaaucgcaaaugaucaagguaacagaacaacaccaucauacguugcauuuacagacacagaaagauuaauaggagaugcagccaaaaaccaagucgcacuaaauccacaaaacacaguauuugaugcaaaacgcuuaauaggaagaaaauuuggcgauccaguaguacaaucagacaugaaacauuggccauuucagguaauaaacgauggagauaaaccaaaaguucaaguuaguuacaaaggcgaaacuaaagcauuuuacccggaagagauaucaagcaugguauuaacaaaaaugaaagaaaucgcagaggcuuauuuaggauacccaguaacaaacgcaguaauaacaguaccagcuuacuuuaaugauagucagagacaagcaacuaaagaugccggaguaauugccggacuaaacguacuaagaauaauaaacgaaccaacugcagcagcaauagcauauggauuagauagaacaggcaaaggagaaagaaauguauuaauauucgaccuaggaggagguacauucgacgugucaauauuaacaauugaugauggaauauucgaaguaaaagcaacagccggggacacacauuuagggggagaagauuuugacaacagacugguaaaccauuuuguagaagaauuuaaaagaaaacacaagaaagacauuucacaaaauaaaagggcaguuagaagacuaagaacugcaugugagagggcaaaaaggacguuaagcaguaguacccaagcaucacuagagauagacucauuauuugaaggaauugauuuuuauacuucaaucacgagagcgagauuugaagaauuauguagugaucucuuuagaucgacauuagaaccugucgaaaaagcacuaagagaugcgaaacuagacaaagcacaaauacaugacuuaguucuaguaggaggaucaaccagaauaccaaaaguacaaaaacuacuacaagauuucuucaacggaagggacuuaaauaaaucaauaaacccagaugaagcugucgcuuacggugcagcuguccaagcagcaauacuaaugggagauaaaagcgagaaugugcaagacuuauuauuauuagacguugcaccucuaucgcuaggacuagaaacagcaggaggaguaaugacagcacuuauaaaaagaaacagcacaauaccgacuaaacaaacgcaaauauuuacaaccuauucagauaaccaaccuggcguccuuauacagguuuaugaaggugaaagagcaaugacaaaagauaacaaucuacuaggaagauuugagcuaaguggaauaccaccagcaccucgaggaguaccacaaauagaaguuacauucgacauagacgcuaauggcauucuaaaugugacagcuacugacaaaaguaccggaaaagcaaauaaaauaacuauuacaaacgauaaaggaagacuaagcaaggaagagauagaacgcaugguacaggaagcagaaaaauacaaagcggaagacgagguccagcgagaaagaguaagcgcuaaaaacgcauuagaaucauaugcauucaacaugaaaagcgcaguagaagaugaaggacuaaaagguaaaauaagcgaagcagauaaaaagaaaguacuagauaaaugucaagaaguuauaaguugguuagaugcaaauacuuuagcggaaaaagaugaauuugaacauaaaagaaaagaacuagaacagguaugcaauccuauuauaucaggauuauaccaaggagcuggaggaccaggaccaggaggcuucggagcacaaggaccgaaaggaggauccggaucagggccaacaauagaagaaguagauuaa

SEQ ID NO: 1328 - RNA, 1926 nt, Artificial Sequence
  derived and/or modified CDS sequence (opt13) from Homo sapiens__NP_005337.2 __HsHSPA1B
auggcaaaagcugcagcaauaggaauagaccuaggaacaacauacuccugcguaggaguauuucagcaugguaaaguugaaauaauagcuaacgaccaaggcaacagaacaacccccucauacgucgcauucacagauaccgaaagauuaaucggagaugcggcuaaaaaccaaguggcacucaauccacaaaacacaguauuugacgcaaaaagacugauaggaagaaaauucggcgauccagugguucaaucagauaugaaacauuggccauuccagguaauaaaugauggagauaaaccaaaaguacaaguaucauauaaaggagaaacaaaagcauuuuauccagaggaaauaaguaguaugguauuaacaaaaaugaaagaaauagcugaagcauaucucggauacccaguaacaaacgccguaauaacaguuccagcauauuucaacgacagucaaagacaagcaacaaaagaugcaggaguaauagcuggccuaaauguacuuagaauaauaaaugaaccuacugcugcugccauagcauacggacuagaucgaacaggcaaaggagaaagaaauguuuuaauauucgaccuuggaggaggaacauucgacguaagcauuuuaacaauagaugauggaauauuugaaguuaaagccacugcaggggauacucaccuaggaggagaagauuucgauaacaggcuaguuaaucauuuuguagaagaauuuaaaagaaaacauaagaaagacauaagucaaaacaaaagagcaguaagaagauugagaacagcaugugaaagagcuaaaagaacgcuaagcucaagcacacaagcaaguuuagaaauagauaguuuauuugaaggaauagauuuuuauacuucgauaacgagagcaagauuugaagaauuauguucagauuuauuuagaucaacguuagaaccaguugaaaaagcacuaagagacgcaaaauuagauaaagcucaaauacaugaccuagucuuggucggaggcucaacacgaaucccuaaaguacaaaaauuacuucaagauuucuuuaacgguagagaucuaaauaaaucaauaaaucccgacgaagcuguagcauauggagcagcuguacaagccgcaauucuuaugggagauaaaucagaaaauguacaagauuugcuacuuuuagacguggcaccacuuagccuaggacuagaaacagcuggaggaguaaugaccgcauuaauaaaacgcaacucgacuauaccaacaaaacaaacacaaaucuuuacaacauacagugauaaucaaccaggaguacuaauacaaguauaugaaggagaaagagcaaugacuaaagacaauaaucuacuaggacgguucgaacuaagcggcauuccaccagcaccucgaggaguaccacaaauugaaguaacauuugauauagacgcaaacgggauauuaaacguuacagcaaccgauaaaagcacaggcaaagcaaacaaaauaacaauuacaaaugauaaaggaagacuuucaaaagaagaaauagagagaaugguacaagaagcugagaaauacaaagccgaagacgaaguccaaagagaaagaguuagcgcuaaaaacgcacuggaaucauaugcuuucaauaugaaaucagcaguagaggacgaaggacuaaaaggcaaaauuucagaagcagacaaaaagaaaguacuagauaaaugucaagaaguaauuagcugguuagaugcaaauacccuggcagagaaagaugaauuugaacauaaaagaaaagaauuagaacaaguaugcaaucccauaauaucaggucuguaucaaggagcaggcgggccaggaccaggaggauuuggagcacagggaccaaaagguggauccgguagcggcccaacaaucgaagaaguagauuaa

SEQ ID NO: 1329 - RNA, 1926 nt, Artificial Sequence
  derived and/or modified CDS sequence (opt13) from Homo sapiens__NP_005518.3 __HsHSPA1L
auggcaacagcaaaaggaauagcaauaggaauagacuuagggacaacuuacaguuguguuggaguauuucagcacgggaaagucgaaauaauagcaaacgaucaagguaauaggaccaccccuucguacguagcauuuacagauacugaaagacuaauaggugaugcagcgaaaaaccaagucgcaaugaacccgcaaaauacaguauuugacgcaaaacgguuaauuggaagaaaguuuaacgacccaguuguacaagcagauaugaaauuauggccauuccaaguaauaaacgaaggaggaaaaccuaaaguguugguauccuauaaaggcgaaaacaaagcauuuuauccggaagaaauaucaucaaugguacuaacaaaacuuaaagaaacggcagaagcauuucuaggacauccagucacaaacgcaguaauaacaguuccagcauacuuuaacgauagucaaagacaagcaacgaaagaugcaggaguuauagcaggucuaaauguacuuaggauaaucaacgaaccaacggcagcagcaauagcauacggacuagauaaaggaggacaaggagaaagacauguacuaauauuugauuuaggcggaggaacauucgacguaaguauauuaaccauagaugauggaauauucgaaguaaaagcaacagcaggggacacacacuuaggaggcgaagacuucgauaacaggcuaguaagccauuuuguagaagaguucaaaagaaaacacaagaaagauauaucacaaaauaaacgcgcaguacgaagacucagaacagcuugcgaaagggcaaaaagaaccuuaagcucuaguacacaagcaaaccuggaaaucgauaguuuauacgaaggaauagauuucuauacaucaaucacuagagcuagauuugaagaacucugugcagaucuauuuagaggaacauuagaacccguagaaaaagcgcuuagagacgccaaaauggacaaagcaaaaauacaugacauaguccuaguagguggaaguacgcguauaccaaaaguacaaagauuauuacaggauuauuucaacggaagagaucuuaacaaaaguauaaaucccgaugaagcaguagcauacggugcagcaguacaggcagcaauacuaaugggagauaaaucugaaaaaguacaagacuuacuacuguuagacguagcaccacuuucacuaggacuagaaacagcuggagguguaaugacagcauuaauaaaaagaaauucaacuauaccaacuaaacaaacacaaauauuuacaaccuauagugacaaucaaccaggaguacuaauacaaguauaugaaggagaaagagcaaugacaaaagauaacaaucugcuaggaagauuugaucuaacgggaauaccaccagcaccaagaggaguaccacaaauagaaguaacguuugacauugaugcaaauggaauacuaaacgugaccgccacagauaaaaguacuggaaaagucaauaaaauaacuaucacaaacgauaaagggagacuaagcaaagaagagauagaaagaaugguuuuagaugcagaaaaauacaaagcagaagacgagguacaaagagagaaaauagcagcuaaaaaugcauuagaaucauaugcauuuaauaugaaaagcguaguaucagacgaaggauuaaaaggaaaaauaagcgaaagugauaaaaacaaaauacuagacaaaugcaaugaacuauuaucaugguuagaaguaaaucagcuagcagaaaaagaugaauuugaccauaaaagaaaggaacuagaacaaauguguaauccaauaauaacaaaauuauaccaaggggguugcacaggaccugcauguggaacaggauaugucccaggcagaccagcaacaggaccaacgaucgaagaaguggauuaa

SEQ ID NO: 1330 - RNA, 1920 nt, Artificial Sequence
  derived and/or modified CDS sequence (opt13) from Homo sapiens__NP_068814.2 __HsHSPA2
augucagcacgugggcccgcgauagguauagaucuagggacaacauacagcugcguugggguguuucaacacggaaaaguagaaauaauagcaaaugaucaagguaacagaaccacaccaaguuacguugcauuuacagauacugaaagguuaauaggagacgcagcgaaaaaccaaguagccaugaacccaacaaauacgaucuuugacgcaaaacgucuuauaggacguaaauuugaggacgcgaccguccaaagcgauaugaaacacuggccauuuagaguaguaagcgaaggaggaaaacccaagguacaaguagaauacaaaggagaaacaaaaaccuuuuucccugaagaaauaucaucaaugguauuaacaaaaaugaaagaaauagcagaagccuaccuugggggaaaaguccacucagcaguaauaacgguaccagcauacuuuaacgauagccagagacaagccacaaaagaugcagggacaauaacaggacucaauguauuaagaauaauuaaugagccuacagcagcagcaauagcauauggauuagauaagaaaggaugugcggguggggaaaagaacguauuaauauuugaccuagguggaggaacauucgacguaaguauacuaacaauagaagauggaaucuucgaagugaaaaguacagcaggagauacucaccugggcggagaagauuuugauaaucgaaugguuucacauuuagcagaagaguucaaacgaaagcacaagaaagauauaggaccaaacaaaagagcaguacgaagauugcgaacagcgugcgaaagagcgaaaagaacacugaguucaucaacacaagcgagcauagaaauagacucacuuuaugaaggaguagauuuuuauacaaguauaacacgcgcaagauuugaagaguuaaaugcagauuuauucagaggaacguuagaaccgguugagaaagcacuaagagacgcaaaacuugacaaaggccaaauacaagaaauaguauuagucggcggaucaacuagaauaccaaaaauacaaaaacuacugcaagacuucuuuaauggaaaagaacucaacaaaagcauaaauccagacgaagcagucgcauauggugcagcaguacaagcagcaauauuaauaggggauaaaucagaaaacgugcaagaucuacuguuacuagaugucacaccacuaucacuagguauagaaacagcaggggguguaaugacaccucuaauaaaaagaaauacaaccauuccaacaaaacaaacacaaacauuuacaaccuacucagauaaucaaucaagcguucuaguacaaguauaugaaggugaaagagcaaugacgaaggauaauaauuuauuaggaaaauucgaucucacagguauaccaccagcgccccgaggaguaccacaaauugaaguaacuuuugacauagaugcaaacggaaucuuaaauguuacagcagcagauaaaagcaccggaaaagaaaauaaaaucacuauaacgaaugauaaaggaagauuaagcaaagaugauauagauagaaugguacaagaagcggaaagauacaaaagugaagacgaagcaaauagagauagaguggcagccaaaaaugcacuagaaagcuauacauauaauaucaaacaaacagucgaagaugaaaaacuaagaggaaagauaucagaacaagauaaaaacaaaauauuggacaaaugucaagagguaauaaacugguuagauagaaaucaaauggcugaaaaggaugaauaugaacauaaacaaaaagaauuagaaagaguaugcaauccuauaauaucaaaacuauaucaaggaggaccaggaggaggaagcggaggaggaggaagcggcgcaucagguggaccaaccauagaggaaguagauuaa

SEQ ID NO: 1331 - RNA, 2523 nt, Artificial Sequence
  derived and/or modified CDS sequence (opt13) from Homo sapiens__NP_002145.3 __HsHSPA4
augaguguuguugguauugauuuaggcuuccaaagcugcuauguggcaguugcacgagcgggaggcauagaaacaauagcaaaugaauacagcgaucgaugcacccccgcauguaucucauucggaccuaaaaacagaucaaucggagcagcggcaaaaucacaaguaauuucaaaugcgaaaaacacuguacagggauucaaaagauuucauggaagggcauucagugacccauuuguagaagcugaaaagaguaacuuggcuuaugauauagugcaacuaccaaccggcuuaacaggaauaaaaguaacauacauggaagaagaaagaaacuuuacaacagaacaaguuaccgcaauguuacuuaguaaauuaaaagaaacugcagaaagcguguuaaagaaaccaguaguagauuguguugugaguguacccugcuuuuacacagaugcggaaaggagaucuguaauggacgcuacacaaauagcgggacuaaacugcuuaagacuaaugaaugaaacaacagcagucgcauuagccuacggcauuuauaaacaagacuuacccgcauuagaagaaaaaccaagaaacguaguuuuuguggacaugggacacucagcauaucaaguaucagugugugcauuuaauagaggcaaacuaaaaguauuagcaacagcauuugacaccacacuaggaggaaggaaauucgaugaaguacuuguaaaccauuucugugaagaguucggcaagaaauauaaacuagauauaaaaucaaaaauaagagccuuauuacgacuuucacaagaaugugaaaaauuaaagaaacugaugucagcaaaugccuccgaucugccacuaaguauagaaugcuucaugaaugauguagaugucucaggaacgaugaaccgcgguaaauuuuuagaaaugugcaaugaucuauuggcaaggguagaaccaccgcuuagaagcguccuagaacaaaccaaacuaaagaaagaagauauauaugcuguagaaauugucggaggagcaacaagaaucccagcaguaaaagagaaaauaaguaaauucuuuggaaaagaauuaucaacaacgcuaaaugcagacgaagccguaacacgaggaugcgcauuacagugugccauacuaaguccagcauucaaaguaagagaguucaguauaaccgacguuguaccauacccuauaaguuuaagguggaauagucccgcagaagaagguagcucagauugugaaguauuuucuaaaaaucacgcagcaccauuuucaaaaguauuaacauucuacagaaaagagccuuuuacacuagaggcuuauuauucaucaccccaagaccuaccauacccugauccagcuauagcacaauucagcguacaaaaagugacaccacaaagcgaugggaguagcucaaaaguaaaaguaaaaguaagagucaacguacauggaauauuuucaguaaguagugcaagccuaguagaaguacauaaaucagaagaaaaugaagaaccuauggaaacagaucaaaacgcgaaagaagaagagaaaaugcaaguugaucaagaagaaccccaugucgaagaacaacaacaacaaacaccagcugaaaauaaagcagaaagcgaggaaauggaaaccagccaagcuggauccaaagacaagaaaauggaucaaccaccccaagcaaagaaagcaaaaguaaaaacuagcacagucgacuuaccaauagaaaaccaacuccuauggcagaucgacagggaaaugcuaaaucucuauauagaaaaugagggaaaaaugauaaugcaggacaaacuagaaaaagagaggaacgacgcuaaaaacgcaguagaagaauacguauacgaaaugagagauaaacuaucaggggaauaugaaaaauuuguaucugaagaugauagaaacaguuuuacauuaaaauuggaagauacugaaaacugguuauacgaagauggcgaagaccaaccaaaacaaguauacgucgacaaacuagcugaacuaaagaaucuaggucaaccaauaaaaauaagauuccaagaaucagaagaaagaccaaaauuauucgaagaacuaggaaaacaaauacaacaauauaugaaaauaaucucaucauuuaaaaauaaagaagaccaauacgaccaucuagaugcagcagauaugacaaaaguagaaaaaucuacuaacgaagcaauggaauggaugaauaauaaauuaaaccuccaaaauaaacaaucacugacgauggaucccguuguuaaaagcaaagaaauagaggcaaaaauaaaagaacuaacaagcacguguagucccauaauaucaaaaccaaaaccaaaaguagaacccccaaaagaagaacagaaaaaugccgaacaaaaugguccaguagauggacaaggagacaauccaggcccacaagcagcagaacaaggaacagauacagccgugccaucagauagugacaagaaauuaccagaaauggauauugauuaa

SEQ ID NO: 1332 - RNA, 2520 nt, Artificial Sequence
  derived and/or modified CDS sequence (opt13) from Homo sapiens__NP_055093.2 __HsHSPA4L
augagcguuguuggcauagaucucggauuccuaaacugcuauauagccguagcuagaagcgguggaauagaaacaauagcgaacgaauacucggaccgcugcacaccagcuuguaucagcuuaggaucccgcaccagagcaauaggcaaugcagcgaaaagccaaauagugacaaacguacgaaauacuauacauggauuuaaaaaacuacacggaaggaguuucgaugacccuauaguacaaacggaaagaauacgacucccauaugaacuacaaaagaugccgaauggaagugcaggaguaaaaguaagauaccucgaagaagaaagacccuuugcaauugaacaaguaacuggaauguuacuagcaaaauuaaaagaaacaucggaaaacgcauuaaaaaaaccgguugccgacugcguaauauccaucccaaguuuuuuuacggaugcagaaagaagaaguguaauggcggcagcacaaguagcaggauuaaauugccuaaggcucaugaacgaaacgacagcaguagcuuuagcauacggaauuuauaaacaagauuugccaccauuagaugagaaacccagaaauguaguauucauagacaugggacacucugccuaucaaguacucguuugugcauucaauaaaggcaaauuaaaaguuuuagccacaacauucgaucccuaccucggcggaaggaauuucgacgaagcauuaguagauuauuuuugcgaugaauucaaaacaaaauacaaaauaaaugugaaagaaaacuccagagcauuacucagacuauaccaagaaugugaaaaacuaaaaaaacuaaugagcgcaaaugcaagcgaccucccccuaaacauagaaugcuuuaugaaugacuuggacguaucuucaaaaaugaacagagcccaauucgagcaauuaugcgcgucauuacuagcccgaguagaaccuccacuuaaagcaguaauggaacaagcaaacuuacaacgagaagauauaucaucuauagagauuguaggaggagcaacaagaauccccgcaguaaaagaacagaucacuaaguuuuuuuuaaaagacauuucuacaacacucaaugccgaugaagccguugcacgaggaugugcauuacaaugcgccauauuauccccagcauuuaagguaagagaauucagcauuacagaccugguuccauauucaauaacauuaagauggaaaacaaguuuugaagacggaucaggugaaugcgaaguauucugcaaaaaccauccagcaccauucucuaaaguaauuacauuccauaaaaaagaaccauuugaacuagaagcuuuuuauacuaaccuacacgaaguaccauacccagaugcaaggaucgguucauuuacaauacaaaacguguucccgcaaagcgacggagacucuaguaaagugaaaguuaaaguaagagucaauauacauggaauauuuucagucgccucagccucagugauagaaaaacagaacuuagaaggagaccauagugacgcuccuauggaaacugaaacauccuucaaaaaugaaaauaaagacaauauggauaaaaugcaaguagaccaggaagaaggacaucagaaaugccaugccgaacauacuccugaggaagaaauagaucauacaggagcaaaaacaaaaucggcaguaucagauaaacaagacagauuaaaucaaacucuaaaaaaagggaaaguuaaaucaauagacuuaccaauacaaucgagcuuaugcagacaguuaggacaagaccuacuuaacucauauauugaaaaugaaggcaaaaugauuaugcaagacaaauuagaaaaggagaggaacgaugccaaaaacgcagucgaagaauacguauaugacuucagagauagacuaggaacuguauaugaaaaauuuauuaccccagaagacuuaucgaaacuaagcgccguucuagaagauacagaaaacuggcuguaugaggauggagaagaucaacccaaacaaguauacguugacaaacuacaagaauugaaaaaauacggacaaccaauccaaaugaaauacauggaacacgaagaaagaccaaaagcauuaaaugaucucggaaaaaaaauccaauuaguaaugaaaguaauagaagccuaucguaauaaagaugaaagauacgaucaucuagacccuacagaaauggaaaaaguagaaaaauguauaucagaugcaaugaguugguuaaauucaaaaaugaacgcacaaaauaaacuaaguuuaacgcaagacccuguaguaaaagucucugaaaucguagcaaaaagcaaagaacuggacaacuucugcaaccccauaauauacaaacccaaaccuaaagcagaggugccagaagacaaacccaaagcaaauucugaacauaacgguccaauggacggacaaagcggaacagaaacaaaaucagacucaacaaaagauaguucacaacauacaaagucaucuggcgaaauggaaguugacuaa

SEQ ID NO: 1333 - RNA, 1965 nt, Artificial Sequence
  derived and/or modified CDS sequence (opt13) from Homo sapiens__NP_005338.1__HsHSPA5
augaaauuaucuuuaguagcggcaaugcuauuacuacuaagcgcagcaagggcagaggaagaagauaaaaaagaagacgucggaacaguagucgguauagaccuaggaaccacauauucaugcgucggaguuuuuaaaaacggaagaguugaaaucauagcaaacgaucaaggaaacagaaucacaccaucauacguagcguucacaccugaaggagaacgacucauaggagaugcagcaaaaaaucaauuaacaucuaacccugaaaacacagucuuugacgcaaaaagauugauaggaagaaccuggaacgacccuucaguucaacaagacauaaaauuucuaccauuuaaaguaguagaaaaaaaaacaaaaccauauauacaaguugauauuggaggcggucaaacaaaaacauucgcaccagaagaaauauccgcaaugguacuuacaaaaaugaaagaaacagcugaagcauaccuaggaaaaaaaguaacacaugccguaguaacaguaccagcauauuuuaaugacgcccaaagacaagcaacaaaggaugcaggaacaauagcuggucuaaacgucaugagaauaauaaacgaaccaacagcagcagcuaucgcauacggacuagauaaaagagaaggagaaaaaaauauacuaguauuugaucuaggaggaggaacauucgauguaagcuuauuaacaauagacaacggagucuuugaaguaguagcuacaaacggugacacacauuuaggaggagaagacuuugaucaaagaguuauggaacacuuuauaaaacuauauaaaaaaaaaaccgggaaagacguaaggaaagauaacagggccguacagaaacucagaagagaagucgaaaaagcaaaacgagcauuaucaucacaacaccaagcaagaauagaaauagaaaguuucuaugaaggagaagauuuuagcgaaacucuaacgcgagcaaaauuugaagagcugaacauggauuuauuuagaaguaccaugaaaccaguacaaaaaguacucgaagacagugauuuaaaaaaaagugacauagacgaaauaguccuaguaggagguucaacccgaauccccaaaauacaacaacucgucaaagaauuuuucaacggaaaagaaccgagccgaggaauaaacccugacgaagcaguagcauauggcgcagcaguucaagcaggcguauuaagcggagaucaagauacaggagauuuaguacuacuagacguauguccacuaacucuaggaauagaaacagucggaggaguaaugaccaaauuaauaccuagaaacacaguaguaccgacaaaaaaaucacaaauuuucuccacagcaagcgacaaucaaccaacaguaaccauaaaaguauacgaaggcgaaagaccauuaacaaaagauaaccauuuauuaggaacauuugauuuaacagguaucccaccugccccacgaggagucccacaaauagaaguuacauuugaaauagauguaaaugguauccucagagucacagcggaagauaaaggcacuggaaauaagaauaaaauuacuauaacaaacgaccaaaauagauuaacucccgaagaaauagaaagaaugguaaaugaugcggaaaaauucgccgaagaggacaaaaaacuaaaagagagaauagauaccagaaacgaguuagaaucauacgcauacucccuuaagaaucaaauuggagauaaagaaaaauuaggcggcaaauugagcucagaagacaaagaaaccauggaaaaagcaguagaagaaaaaauagaauggcuugaaagccaccaggaugcagauauagaagauuucaaagcaaaaaaaaaagagcuagaggaaaucguacaaccaauaauuucaaaacuauacggaagugcagggccaccaccaacaggagaagaagacaccgcagaaaaagaugaacuuuaa

SEQ ID NO: 1334 - RNA, 1932 nt, Artificial Sequence
  derived and/or modified CDS sequence (opt13) from Homo sapiens__NP_002146.2__HsHSPA6
augcaagcaccacgugaacuugcagucgguauagaucuaggaacaacauauuccuguguaggaguauuucaacaagggagaguagaaauauuagcaaacgaucaaggcaauagaacaacaccaucauauguagcauuuacugacacagaaagauugguaggagaugcagccaaaagucaagcagcauuaaauccacauaacacaguguucgacgcgaaaagacuaauugguagaaaauuugcggauacaacaguccaaagugacaugaagcauuggccauuuaggguagugucugaagguggaaaaccaaaaguaagaguaugcuauagaggugaagauaaaacauuuuauccagaagaaauuucaucaaugguauuaagcaaaaugaaagagacagcagaagcauaccuuggacaaccaguaaaacaugcuguaauaacaguucccgcauacuucaaugauagccaaagacaagcaacaaaagaugcuggagcaauagcuggauuaaacgugcuaagaauuauaaaugaaccaaccgccgcggcaauugcauauggauuagauagaagaggagcaggagaaagaaacguauuaauauucgaucuaggaggaggaacauuugacguaucagucuuaucaauagacgcaggcguauucgaaguaaaagcaacagcuggugauacucacuuaggaggagaagauuucgauaacagauuaguuaaucacuucauggaagaauuucgacgaaaacauggcaaagaucuauccggcaauaaaagagcauuaagaagacuacgaacagcgugugaaagagcaaaaagaacauuauccucaucuacccaagcuacauuagaaauagauagccuauucgaagggguagauuuuuacacuuccauaacaagagcucgcuucgaggaacuaugcucagauuuauuuagaucuacuuuagaaccuguagaaaaagccuuacgugacgcaaaauuagauaaagcacaaauacaugacgucguauuaguagguggaaguacccgaauaccaaaaguacaaaaacuauuacaagauuucuuuaacggaaaagaacuaaacaaaucaauuaauccagaugaagcaguugcuuacggcgcagcaguacaggcagcaguauuaaugggagauaaaugugaaaaaguacaagauuuguuacuucuagacguggcaccccuaagccuaggauuagaaacagcaggaggaguaaugaccacauuaauacaaagaaaugcaacaauaccuacuaaacaaacacaaacauuuacaacauauagugacaaucaaccugggguauucauacaaguauaugaaggugaaagagcaaugacaaaagauaauaauuuacuagguagauuugaauuaucagggauuccaccagcaccacgaggaguaccgcaaauagaggugacuuuugacauagacgcaaauggcaucuuaagcguaacagcaacagauagaagcacaggaaaagcaaacaaaauaacaauaacaaaugacaaaggaagguuaagcaaagaggaggucgaaaggaugguacaugaagcagagcaauauaaggccgaagaugaagcccaaagagacagaguagcagcuaaaaauucacuagaagcacauguguuucacguaaaagggagcuuacaagaagagaguuuaagagauaaaauaccagaagaagauagacgaaaaaugcaagauaaaugcagagaaguauuagcauggcuagaacauaaucaacuggcagaaaaagaagaauaugaacaucaaaaacgagaauuagaacaaauaugcagaccaauauucucaaggcuauauggcggaccaggaguaccaggaggaaguucuuguggaacucaagcuagacaaggagacccuucuacaggaccaauaauugaagaaguagauuaa

SEQ ID NO: 1335 - RNA, 1104 nt, Artificial Sequence
  derived and/or modified CDS sequence (opt13) from Homo sapiens__P48741__HsHSPA7
augcaagcacccagagaauuagccguaggaauagaccuaggaacuacauauagcugugucggaguauuucaacaaggaagaguugaaauauuagcaaaugaccaaggaaauagaacaacaccuucauauguagcauucacagacacagaaagguuaguaggagaugccgcgaaaagccaagcagcauuaaacccacacaauacaguauucgaugcaaaaagacucaucggaagaaaauuugcagauacaacaguacaaucagauaugaaacauuggccauuucaaguagucucagaaggcggaaaaccaaaaguaagaguauguuacagaggagaagauaaaacauuuuauccagaagaaauaucaaguaugguauuaucaaagaugaaagaaacagcagaagcauaucuaggccaaccaguaaaacaugcaguaauaacaguaccaacuuauuucucaaauucacaaagacaagcaacaaaagaugcuggagcaauugcaggucuaaaaguauuaccaaucauaaaugaagcuacagcugcagcaauagcauauggccuagauagaagaggagcaggaaaaagaaauguauuaauauuugauuuaggaggaggaaccuuugacguaucaguauuaucaauagaugcaggaguauuugaaguaaaagcaacagccggagauacacaucuaggaggagaagauuucgacaacagauuaguuaaucacuucauggaagaauuuagaagaaaacacggaaaagacuuaucagguaauaaaagagcacuuagaagauuaagaacagcaugugaaagagccaaaagaacaccaucaagcucaacacaagcgacauuagaaaucgauucacuauucgaaggaguagauuuuuauaaaucaauaacuagagcccgauuugaagaauuauguucagacuuauuucgaagcacacuagaaccaguagaaaaagcacuaagagaugcaaaacuagacaaagcacaaauacacgacuucguauuaggaggaggacuacacagucauccacaaggagcugaaguagcugcaggauuauuacaaagacaaggagcagaacaagaacaccaaccuuaa

SEQ ID NO: 1336 - RNA, 1941 nt, Artificial Sequence
  derived and/or modified CDS sequence (opt13) from Homo sapiens__NP_006588.1 __HsHSPA8
augucaaaagguccugcuguaggaauugacuuaggaacgacauauucguguguuggugucuuccaacaugggaaaguagaaauuauagcaaacgaucaaggaaaccgaacaacaccaucauacguagcuuuuacagauacagaaagauuaaucggagacgcggcuaaaaaucaaguagcaaugaauccaacaaacacagucuuugacgcaaaacgacuaauaggaagaagauuugaugaugcaguaguucaaagcgauaugaaacacuggccauuuaugguaguaaaugacgcaggaaggccaaaaguacaaguagaauacaaaggagaaacaaagagcuucuauccggaagaaguaucaagcaugguauuaacaaaaaugaaagagauagcagaggcauacuuaggaaaaacaguaacaaacgcaguagucacaguuccagcauauuucaacgauagccaaagacaagcaacaaaagacgcagguacaauagcaggauuaaauguacuccggauaauaaacgaaccaacagcugcugcaaucgcguauggacuagauaagaaaguaggcgcagaaagaaauguauuaaucuucgacuuaggaggaggaacauucgauguaucuauucuaacaauagaagacggcauauucgaaguaaaaagcacagccggcgacacacacuuaggaggagaagauuucgauaaccgaaugguaaaccauuucauagccgaguucaaaaggaaacacaagaaagacauaagugaaaauaaaagagcaguacgccgauuaagaaccgcaugugaaagagcaaaaagaacucuaaguucaagcacacaagcgaguauagaaauagacaguuuauaugaagguauagauuuuuauacaucaauaacaagagcaagauucgaagaacuuaacgcagaccuauuuagaggaacacuagacccaguagaaaaagcacuaagagaugcaaaauuagacaaaagccaaauacaugauauaguauuggucggaggaucgacuagaaucccaaaaauacaaaaacuauuacaagacuucuuuaacggaaaagaacucaauaaaucgauuaauccagaugaagcagucgcauauggagcugcgguacaagccgcgauauuaagcggagacaaauccgaaaacguccaagaucuauuacucuuagacguaacaccucugucgcuaggaauugaaacagccggugggguaaugacaguacuaauaaaaagaaacaccacaauaccaacuaaacaaacacaaacauuuacuacauacucagauaaucaaccaggaguccuaauucaaguuuacgaaggggaacgugcaaugacaaaagacaauaauuuacucggaaaauuugaacuaacaggaauaccaccagcaccaagaggaguaccacaaauagaaguaacauuugauauagaugcaaauggaauacuaaacguaagugcgguagauaaaagcacagguaaagaaaacaaaauaacaauaacuaacgacaaaggcagauuaucaaaagaagauauagaaagaauggugcaagaagcagaaaaauauaaagcagaagacgaaaaacaaagagauaaaguaaguaguaaaaauucauuagaaucauacgcauuuaauaugaaagcaacgguagaagaugaaaaauugcaaggaaaaauaaacgaugaagauaagcagaaaauuuuagacaaauguaacgaaauuauaaauugguuagauaaaaaucaaacagcagagaaagaggaauuugaacaucaacaaaaagaauuggaaaaggucugcaauccuauaauaaccaaauuauaccaaucugcgggaggaaugccaggcggaaugccaggaggauucccagguggaggagcuccaccaagcggaggagcaagcaguggaccaacaauagaagaagucgauuaa

SEQ ID NO: 1337 - RNA, 2040 nt, Artificial Sequence
  derived and/or modified CDS sequence (opt13) from Homo sapiens__NP_004125.3 __HsHSPA9
augaucagugcaagcagagcugccgcagcaagauuaguaggagcggcagcaagcagaggaccaaccgcugcuagacaucaagauaguuggaauggauuaucacacgaagcauuuagacucguaaguagacgagacuaugcaagcgaggcaauaaaaggcgcaguaguagggaucgauuuagggacgacaaacucaugcguagcagucauggaaggaaaacaagcaaaaguacuagaaaaugcagaaggagcgagaacaacaccaucaguaguagcguuuacugcagauggagaaaggcuaguaggcaugcccgcuaaaagacaagcaguaacaaauccaaauaauacauuuuaugcaacaaaaagauuaauaggaagaagauaugaugacccagagguacagaaagacaucaaaaauguaccuuuuaaaauaguaagagcaaguaacggagacgcauggguagaagcacaugguaaacuauauaguccgucgcaaauaggagcauuuguucuuaugaaaaugaaagaaacggcagaaaauuaucuagggcauacagccaagaacgcaguaauaacaguacccgcauauuucaacgauucacagcgucaagcaacgaaagaugcgggacaaauuagugggcugaauguauuaagaguaauaaacgaacccacagcugcagcccuagcguauggacucgauaaaucagaagacaaaguaaucgcaguauaugauuuaggugggggaaccuuugacauuucaauauuagaaauacaaaaaggcguauuugaaguaaaaaguacaaauggagauacauucuuaggaggagaagacuucgaucaagcucuauuacgacauauagugaaagaguucaaaagagaaacaggaguugacuuaacaaaagauaacauggcacuacaaagaguaagagaagcagcugaaaaagcgaaaugcgaacuaaguaguaguguacaaacagacauaaacuuaccauacuuaacaauggacucaucagggccaaaacaucuuaacaugaaacugacuagagcacaauucgaaggaauagucaccgaucuaauacguaggaccauugcaccaugccagaaagcaaugcaggacgcagaaguaucgaaaagcgauauaggagaaguaauauuaguugggggaaugacaagaaugccuaaaguacaacaaacaguacaagauuuauuuggaagggcaccaucaaaagcaguaaacccagacgaagcaguggcgauaggagccgcaauacaaggaggaguacuagcaggagacguaacugauguuuuauuacuagauguaaccccacuaaguuugggaauagaaacauuaggaggaguauuuacaaaacuaauaaauagaaauaccacaauaccuacaaagaaaucucaaguauuuucaacagcagcagacggccaaacacaaguggaaauaaaaguaugucaaggcgaaagagaaauggcaggagacaauaaacuguuaggacaauuuacuuuaauagguauaccaccagcaccaaggggaguaccucaaauugaaguaacauucgacauagacgcaaauggaauaguccauguaucagcgaaagauaagggcacagggagggaacaacaaauaguaauacaaaguagcggaggacugaguaaagacgauauagaaaauauggucaaaaaugcugaaaaauaugcugaagaggauaggaggaagaaagaaaggguagaagcgguaaauauggcagaaggaauaauacaugacacagaaacaaaaauggaagaauuuaaagaucaauuaccagcggaugaauguaauaaacucaaagaagaaauaaguaaaaugagagaguuacuugcaagaaaagauucagaaacgggagaaaauauacgacaagcagcaaguucacuacaacaagcuagucuaaaauuauucgaaauggccuauaagaaaauggcaucggaacgagaaggaucaggaucaucugguacaggggaacaaaaagaagaucaaaaagaagaaaaacaauaa

SEQ ID NO: 1338 - RNA, 2028 nt, Artificial Sequence
  derived and/or modified CDS sequence (opt13) from Homo sapiens__NP_079291.2__HsHSPA12A
auggcugauaaagaagccggaggaucugauggcccuagagaaaccgcaccaacuucagcauauagcagccccgccagaucauuaggagauacaggcauaacucccuuaucaccaucccauauaguaaacgauacagauaguaaugucuccgaacaacaaucauuuuugguuguuguagcagucgauuucgguacaacaagcuccggauacgcauauuccuucacaaaagaaccggaauguauacauguuaugagaagaugggaaggcggcgacccaggaguuaguaaccaaaagacuccaacuacaauccucuuaacaccggaaaggaaauuccauucauucggauaugccgcacgcgauuuuuaccacgauuuagacccaaacgaagcgaaacaaugguuauaucuagaaaaauuuaaaaugaaacuacauaccacaggagaccuuacuauggauacagaccuaacagcugcaaauggaaagaaaguaaaagcauuagaaaucuuugcauacgcguuacaauacuuuaaagaacaagccuuaaaagaauuaagcgaccaagcuggaucagaauuugaaaauuccgacguacgaugggucauaacgguaccugcaauauggaaacaaccagcaaaacaauucaugagacaagccgccuaucaagcuggacuagcgucaccagaaaacagcgaacaacuaauaauagcacuagaaccagaagcagcaucaaucuauuguagaaaacuaagauuacaucaaaugauagaacuaucaucaaaagcugcaguaaauggauauucaggaagugacaccguaggugcaggauuuacucaagccaaagaacacauaagaagaaauagacaaucuagaaccuuucuagucgaaaauguaauuggcgaaauauggucugaauuagaagaaggagacaaauaugucguaguugacuccgguggaggaacaguggaucucaccguccaucaaauacgacuaccagaaggacaucuuaaagaacucuacaaagcuacaggaggaccauauggcucauuaggcguagauuaugaauuugaaaaacugcuauacaaaaucuucggagaagacuuuauagaacaauuuaaaaucaaaagaccagcagcauggguagauuuaaugauagcauucgaaucaagaaaaagagcugcagcaccagaucgaacuaauccguuaaauauaacguuaccauucucauucauugacuacuauaaaaaguuuagaggucauaguguugaacaugcacuaagaaaaucgaauguagauuuuguaaaauggucaagucaaggcauguuaagaaugucaccagaugccaugaaugcauuauuuaaaccaacuauagauucaauaauagaacauuuaagagacuuauuccaaaaaccagaaguaucuacaguuaaauucuuauuccuaguagggggauuugcagaagcuccacuucuacaacaagcagugcaagcagcauucggcgaccaaugucgaauaauaauaccucaagacguaggccucacaauacuaaaaggagcgguauuauuuggauuagauccugcagucauaaaaguaagaagaucaccucuaacauacgguguaggaguacuaaacagguacguagaaggaaaacacccaccugaaaaacuuuuagucaaagacggaacuagauggugcacagauguauuugauaaauucauaucagcagaucaaucaguagcauuaggagaacugguaaaacgaucauacacuccugcuaaacccagccaauuaguaaucguaauaaauauauauucaagugaacaugauaaugucucauuuauaacagauccaggaguaaagaaaugcggaacauugagauuggaccucacaggaacaucaggaacagcuguaccagcaagacgagaaauucaaacacuaaugcaauuuggagauaccgaaauaaaagcaacugcaauagauauagccaccagcaaaaguguaaaagugggaaucgauuucuuaaauuauuaa

SEQ ID NO: 1339 - RNA, 2061 nt, Artificial Sequence
  derived and/or modified CDS sequence (opt13) from Homo sapiens__NP_443202.3 __HsHSPA12B
augcuagcaguaccugaaaugggauuacaaggucuauauauagguagcucgccagaacgaucaccaguaccaaguccgccgggaucaccucgcacacaagaaagcuguggaauugcaccacuaaccccuucucaaucaccaaagccagaaguuagagcaccccaacaggcuucauuuucuguaguaguagcaauagacuuuggcaccacauccucaggcuaugccuucagcuuugcaucagacccagaagcgauacauaugaugaggaaaugggaaggaggagauccagggguagcacaucagaaaacaccuacuugcuuauuacuaacaccagaaggcgcauuucauaguuuuggauauacagcaagagacuauuaucaugaucuggauccugaagaagcgcgugauugguuauauuuugaaaaauuuaaaaugaaaauccauucagcaacagaucuaacuuuaaaaacacaauuagaagcugucaauggcaaaacaaugccagcauuagaaguauuugcccaugcacuaagauuuuuccgagaacaugcacuacaagaacuuagagaacaauccccaaguuuaccugagaaagauacaguaagauggguauuaacagugccggcaauauggaaacaaccugcuaaacaauucaugagggaagccgccuauuuagcaggauugguuucacgagaaaacgcagaacaacuauugauagcuuuagagccagaggcggcaaguguauauuguagaaaacuaagauuacaucaacuacuagauuuaucaggcagagcuccaggaggagguagauuaggagaaagacgauccauugauucuaguuuuagacaagcuagagaacaacuaagaagaagcagacauucaagaacauuccuuguagaaaguggaguaggagaauuaugggcagaaaugcaagcaggagauagauauguaguugcagacuguggaggaggaacuguagaccucacaguucaucaacuagaacaaccacaugguacccuaaaagaauuauauaaagcgaguggcggcccauacggagcaguaggcguagauuuagcauuugaacaauuacucugucgaauauuuggagaagauuucauagcuacuuuuaaaagacaaagaccagcugcauggguagaucuaacuauagcuuucgaagcaagaaaaagaacagccggaccucauagagcaggagcauuaaauauaucucuaccauuuaguuuuauagauuuuuacagaaaacaacggggacauaacguagaaacggcauuacgaagaucaagugucaacuucguaaaauggucaucacaagguauguuaagaauguccugugaagcaaugaaugaacuauuucaacccacuguaagcggaauaauacaacacauagaagcauuauuagcaagacccgaaguucaaggaguaaaauuacuauuucuaguaggaggguuugccgaaucggcaguucuacaacaugcaguacaagcugcguuaggcgcacgaggauuacgaguaguaguaccccacgauguugggcuuacaauucugaaaggagcuguauuauuuggacaggcaccaggaguagucagaguuagaagaagcccacuaacauaugggguaggaguacuuaacagauuuguaccaggcaggcauccuccagaaaaauuauuaguacgagacggaagacguugguguacagauguauucgaaagauucguugcagcugaacaaagcguugcauuaggagaagaaguaagacgaucauauugcccagcuagaccaggucaaagaagaguucuaauaaacuuauauuguugcgccgcagaagaugcaagguuuauuacugauccuggaguucgaaaauguggugcacuuagccuagaacuagaaccggccgauuguggacaagauacagccggagcaccaccagguagaagagaaauaagagcugcuaugcaauucggagacaccgaaauaaaagucacagcaguagaugucagcacaaauagaucagugcgagcuaguauagacuuucuaucaaauuga

SEQ ID NO: 1340 - RNA, 1416 nt, Artificial Sequence
  derived and/or modified CDS sequence (opt13) from Homo sapiens__NP_008879.3__HsHSPA13
auggcacgagaaaugaccauauuaggaagcgccguauuaacauuauuacuagcgggauauuuagcacaacaauaucuaccccuacccacaccaaaaguaaucggaauagacuuaggaacaacauauuguaguguaggaguuuucuucccaggaaccggaaaagucaaaguaauaccagacgaaaacggacacauaucaauuccaucaaugguaucauuuacugauaacgacguauauguaggauacgaaucaguagaauuagccgauagcaauccacaaaacacuauauaugacgcaaaaagauucauaggcaaaauauuuacagcagaagaacuugaagcugaaauaggaagauaucccuuuaaaguacuaaauaaaaacggaaugguagaauucucaguuacaucaaaugaaacaauaacagucaguccagaauacguagguagcagauuacuacuaaaacuaaaagaaauggcagaagcauacuuaggaaugccaguagcaaaugccguaauaucuguaccagcagaauucgauuuaaaacaacgaaauucaacaauagaagcagcuaaucuagcaggacuaaaaauauuaagaguuauaaacgaacccacagcagcagcaauggccuauggauuacacaaagcugacguauuucauguacuaguaauagaucuagguggagguacauuagacguaagcuuacuaaauaaacaaggaggcauguuucuuacacgagcaaugucaggcaacaacaaauuaggaggucaagacuuuaaccaaagacuacuacaauaucucuacaaacaaauuuaccaaacuuauggauuuguuccuucaagaaaagaagaaauacaucgauuacgacaagcaguagagaugguaaaacuaaauuuaacacuacaucagagugcacaacuuuccgucuuauuaacaguugaagaacaagaucgaaaagaaccacacaguucagacaccgaacuuccaaaagauaaauuaagcucagcagaugaccauagaguuaacagcggcuuuggaagaggauuaucagacaaaaaaagcggagaaagccaagugcuguuugaaaccgaaauaagcagaaaauuauucgauacacuuaacgaagaccuauuccaaaaaauauuaguaccaauccaacaaguacuaaaagaaggucaucuagaaaaaacagaaauagaugagguaguauuaguaggaggaucaacacguauacccagaauaagacaaguaauacaggaauuuuucggaaaagauccaaauacaucaguagacccagauuuagcgguuguuacaggagucgcaauacaagcaggaauagauggcggaagcuggccauuacaaguauccgcacuagagaucccaaacaaacaucuacaaaaaaccaauuucaauuaa

SEQ ID NO: 1341 - RNA, 1530 nt, Artificial Sequence
  derived and/or modified CDS sequence (opt13) from Homo sapiens__NP_057383.2__HsHSPA14
auggcagcaauaggaguacauuuaggauguacaagugcauguguagcaguauauaaagauggaagagcaggaguaguagccaaugaugcaggggauagaguaacaccagcgguaguagcuuauucagaaaaugaagaaauaguaggauuagcugcaaaacaaucaagaauaagaaauauuaguaacaccguaaugaaagugaaacaaauacuaggaagaucuucaucagauccccaagcacaaaaauauauagcagaaucaaaaugucuaguaauagaaaaaaauggcaaacuaagauaugaaauagauacaggcgaagaaacaaaauuuguaaacccugaagaugucgcuagacuaauauucucaaaaaugaaagaaacagcacauucaguacuaggaucagaugcaaaugacguaguaauaaccguaccauuugauuuuggagaaaaacaaaaaaaugcauuaggagaagcagcaagagcagcaggauuuaacguguuacgacuuauacaugaacccucagcagcauuauuagccuauggaauaggucaagacucaccaacaggcaaaucaaauauauuaguauuuaaauuaggaggaacuagucuaucacucucaguaauggaaguaaauucaggaauauacagaguuuuaucaacuaauacagaugauaauauuggaggagcacauuuuacagaaacauuagcucaauaccuugcaagugaauuucaaagaaguuuuaaacacgaugucagaggaaaugcaagagcaaugaugaaacuaacgaauucagcagaaguagcaaaacauucauuaucaacauuagggucugccaauuguuuccuagauagucuuuaugaagggcaagacuuugacuguaauguaagucgagcaagauuugaacuacuguguucaccccuguuuaacaagugcauagaagcaauaaggggauuacuagaucaaaauggcuucaccgcagaugacaucaauaaaguaguacuauguggaggaagcucaagaauaccaaaacuccaacaauuaauaaaagauuuauuucccgcuguagaacuacuaaauaguauacccccagaugaaguaauaccaauaggugccgcaauagaagcaggcauauuaauaggcaaagagaaucuacuaguggaagacagucuaaugauagaauguagugcaagagacauauuaguaaaagggguagaugaaaguggagcaagcagauuuacaguauuauuccccagcggaacaccucuaccagcaagaagacaacauacucuacaagcgccagguucaauaucaucaguuugccuagaacuauacgaaucagacgguaaaaacucagcaaaagaagaaacaaaauucgcucaaguaguacuacaagauuuggacaaaaaagagaauggacuaagagauauucuagccguauugacuaugaaaagagauggaucacuacacguaacauguacagaccaagaaacaggaaaaugugaagcaaucucuauagaaauagccucauaa

SEQ ID NO: 1342 - RNA, 2577 nt, Artificial Sequence
  derived and/or modified CDS sequence (opt13) from Homo sapiens__NP_006635.2 __HsHSPH1
augaguguuguggggcuagacguagggagccaaaguugcuauauagcaguagccagagccggaggaauagaaacgauagcaaaugaauucucagauagaugcaccccaaguguaauaucauucggaucaaaaaacaggacgauaggaguggcagccaaaaaucaacagauaacgcacgcaaauaacacagucagcaacuuuaaaagauuucacggaagagcauuuaacgacccauuuauacaaaaagaaaaagagaaucuaaguuacgacuuagucccccuaaaaaauggaggagugggaauaaaaguaauguauaugggcgaagaacaccuuuuuucaguugaacaaauaacugcgaugcuauuaacaaaacuaaaagaaacagcagaaaacucauuaaaaaaaccaguaacagacugcguaauaucaguaccaucauucuuuacagacgcugaacgacgaaguguucuagacgcagcacagauaguagguuugaauugucuaagacugaugaacgacaugacagcaguagcguuaaacuacggaauauacaaacaggaccuaccaagcuuggacgagaaaccuagaauaguaguauucguagacauggggcacucugcauuccaaguuagugcaugcgcauucaauaaagguaaacucaaaguauuaggaacagcauuugacccauucuuaggaggcaaaaacuuugacgaaaaacuuguugaacauuucugcgcggaauucaaaacaaaauauaaauuggacgccaaaagcaaaauaagagcccuuuuacgacuauaccaagagugcgaaaaacuaaaaaaacuaaugaguaguaauucaacugaccuaccacucaauauugaguguuucaugaaugauaaagauguaaguggcaaaaugaacagaucucaauucgaagaauuaugcgccgaauugcuacagaaaauagagguaccacuauauagccuccuagaacaaacacaucuaaaaguagaagauguuagugcaguggaaauaguaggaggcgcuacaagaauaccugcaguuaaagaaagaaucgcuaaauucuucggaaaagauauauccacaacacuuaaugcagacgaagcaguagcucgcggcugcgcucuccaaugugccauucuaaguccagccuucaaagucagagaauucucuguaacugacgcaguuccguucccuauaucacuuauauggaaccacgacagugaagauacugaaggagugcaugaaguauucagcaggaaccaugccgcuccuuucagcaaaguauuaacuuucuuacgaaggggaccauucgaauuagaagcauuuuacucagauccacaaggaguaccauacccugaagcaaaaauaggccgauucguaguacaaaacgucagcgcacaaaaagauggagaaaaaucaagagucaaaguaaagguacguguaaauacccacgguauuuucacaauaucaacagcauccaugguagaaaaaguaccuacagaagaaaaugaaaugucaagcgaagcagauauggaaugcuuaaaucaaagaccaccagaaaacccagauacagacaaaaacguacaacaagauaacucagaagcaggaacacaaccacaaguacaaaccgaugcucaacaaaccucacaaucaccuccaagcccagaacuuacuucugaagaaaacaaaaucccagacgcagauaaagccaacgaaaaaaaagucgaccaaccaccagaagcuaaaaaaccaaaaauaaaaguaguaaacguagaacugcccauagaagcaaaccuaguauggcaacuaggaaaagauuuauuaaacauguacauagaaacugaaggcaaaaugaucaugcaagauaaacuagaaaaagaacgcaaugacgcaaaaaacgcaguagaagaauauguauaugaauuuagagacaaauuauguggaccauaugaaaaauucauaugcgaacaagaucaccaaaauuuccuacgacuacucacugaaacagaagacugguuauaugaagaaggagaagaccaagcaaaacaagcuuacguagacaaacuggaagaacuaaugaaaauagguacgccuguaaaaguacguuuccaagaagcagaagaaagaccgaaaauguuugaagaauuaggacagagacuccaacacuaugcaaaaauagcugcagacuuccgaaacaaagaugaaaaauauaaccacauagaugaaagcgaaaugaaaaaaguugaaaaaucagucaacgaaguaauggaauggaugaacaacguaaugaaugcacaagcaaaaaaaagucuagaccaagacccaguagucagggcgcaagagauaaaaacgaaaaucaaagaauuaaauaacacuugcgaacccgucguaacgcaaccaaaaccuaaaauagaaucaccaaaacuagagcgcacgccuaaugguccaaacauagacaaaaaagaagaggaccuagaagauaaaaauaacuuuggugcagaacccccccaucaaaacggagaaugcuauccaaacgaaaaaaauaguguaaauauggaucuagacuaa

SEQ ID NO: 1343 - RNA, 3000 nt, Artificial Sequence
  derived and/or modified CDS sequence (opt13) from Homo sapiens__NP_006380.1 __HsHYOU1
auggcugauaaaguaagaagacaaagacccagaaggagaguuuguugggcucuaguagcaguauuacuggcagauuuauuagccuuaucagauacccuugcaguaauguccguagaccuaggaagugaaaguaugaaaguagcaauaguuaaacccggaguaccaauggaaauaguccuuaacaaagaaucuagaaggaaaacuccaguuauaguaacacuaaaagaaaaugaacgauucuucggcgacagugcagcaucaauggccaucaaaaauccaaaagcaacauuaagauacuuucaacaucuucuuggcaaacaagcugauaauccucaugucgcauuauaucaagcaagauuccccgaacacgaacuaacuuuugacccacaacgucaaacuguacacuuucaaauaaguucacaacuacaauuuaguccagaagaaguacucggaaugguccugaauuauucaagaucauuagcagaagauuucgcagaacaaccuauaaaagacgcaguaauaaccguuccuguguucuuuaaccaagccgaaaggcgagcaguauuacaagcagcucgaauggcaggauuaaaagucuuacaauugauaaaugauaauacagcaacagcacuuaguuacgggguauuuagacgaaaagauaucaauacgacagcucaaaauauaauguuuuaugacaugggaaguggcucaacagucugcacaauaguaacauaucaaauggucaaaacaaaagaagccgggaugcaaccacaacugcaaauacgagguguaggauucgauagaaccuuagggggacuagaaauggaauuaagauuacgagaaagauuagcaggauuauuuaacgaacaaaggaaaggccaacgugcaaaggauguaagagaaaauccaagagcgauggcaaaacuccugagagaggcuaauaggcuaaaaacggugcuaagcgcaaaugcggaccauauggcacaaauagaaggguuaauggaugacguagacuuuaaagccaaaguaacacgcguagaguucgaagaauuaugugcugaucuauuugaaagaguaccggguccaguucaacaagcguuacaaucggcagaaaugucacuugaugaaauagaacaaguaauuuuaguagggggcgcuaccaggguuccuaggguacaagaaguccuauugaaagccguggggaaagaagaauuagguaagaauauaaacgcagaugaagcugcugcaaugggugcaguguaucaagcagcagcacuaagcaaggcauuuaaggugaaaccguucguuguaagggaugcuguagucuauccaauauuaguagaauuuacucgcgaaguagaagaagaaccaggaauacauuccuuaaaacauaauaaaagagucuuauucagcaggaugggacccuauccucagagaaaaguaauaaccuucaaccgauacagucaugacuucaauuuccacauaaacuauggagauuuaggauuucuugguccggaagacuuaagaguauuuggaagucaaaaucuaacaaccguaaaauuaaaaggcgugggagacucauuuaagaaguaucccgauuacgaaucaaaaggaauuaaggcacauuuuaacuuagacgagagcggagucuuaagccuggacagaguggaaucaguauucgaaacguugguugaagauucagcugaagaagaaaguacacuaacgaaauugggaaacaccauaaguucucuauucggaggaggcacaacuccagaugcaaaagaaaaugguacagauacuguccaagaagaagaagaaucaccagcagaaggauccaaggacgaaccaggagagcaaguugaacuuaaagaagaagcagaagcacccguugaagauggaucacaaccuccaccacccgaaccgaaaggagacgccacgccggaaggagaaaaagcaacugaaaaagaaaauggagauaaaucagaagcacaaaaaccaucugaaaaagccgaggcaggaccagaagguguagcucccgcuccggaaggugaaaagaaacaaaaaccagcacgaaaaagacgcauggucgaagaaauaggaguagaauuaguaguuuuagacuuaccugaucucccagaagacaaacucgcacaaucaguacaaaaacuacaagaucuaacauugagagaucuggagaaacaagaaagagaaaaagcagcuaauagucuagaggcuuucauuuucgaaacccaagacaaauuauaccaaccugaauaccaggaaguuuccacagaagaacaaagggaagaaaucagugguaaauugagcgcagcuaguacaugguuagaagaugaaggaguuggagcaacgacaguaauguuaaaagaaaaauuagcagaauuaaggaaauuaugucaaggacucuucuuuagagucgaagaaagaaagaaauggcccgagagauugucagcauuagacaauuuauuaaaccauuccagcauguucuuaaaaggugccagacuuauaccagaaauggaucagauauuuacagaaguggaaaugacuacacuagaaaaaguaauuaacgaaaccugggcauggaaaaaugcaacacuagcagaacaagccaaauuaccggcgacggagaaaccaguacuauuaucgaaagauauagaagcaaaaaugauggcucuagaccgagaaguccaauaccuuuuaaacaaagccaaauuuacaaaaccaaggccaagaccuaaagacaaaaauggaacaagagcggaaccaccacuaaacgcgagcgcaagugaccaaggugaaaaaguaauuccaccagcuggacaaacagaagacgcugaacccauaagugaaccagaaaaaguagaaacaggaucagaacccggagauacugaaccacuagaguugggaggaccaggggcugagcccgaacaaaaagaacaaucaacaggccagaaaagaccgcucaaaaacgaugaacuauaa

SEQ ID NO: 1344 - RNA, 2199 nt, Artificial Sequence
  derived and/or modified CDS sequence (opt13) from Homo sapiens__NP_005339.3 __HsHSP90AA1
augccagaagaaacgcaaacacaggaccaaccaauggaagaagaagaaguugaaacauuugccuuccaagcugaaaucgcucaacuaaugucccucauaauaaacacauuuuacaguaauaaggaaauauuccuacgagaauuaauaucaaauaguagugacgcauuagauaaaauacguuacgaaagccuaacagauccgaguaaacuagacucaggaaaagaacuacacauaaacuuaauaccaaacaaacaagaccgaacacucacaauaguagacacagguauaggcaugacgaaagccgauuuaauaaacaaccucggaaccauugcaaaaagcggaaccaaggcauucauggaagcucuacaagcaggagcggacaucagcaugauaggccaguucggaguggguuucuauucagcauaccucguagcagaaaaaguaaccgucauaacgaagcacaacgacgaugaacaauaugcaugggaaucauccgccggaggaaguuucacaguccgaacugacacaggugaacccaugggaagagguacuaaaguaauccuucaucugaaagaagaucaaaccgaauaccucgaagaacgacgaauaaaagaaauuguaaaaaagcauucacaauucaucggauacccuauaacacucuucguagaaaaagaaagggauaaagaaguaagcgaugaugaagcagaagaaaaggaagacaaagaagaagaaaaagaaaaagaagaaaaagaaucagaagauaaaccagaaauagaagacguaggauccgacgaagaagaagaaaaaaaagacggugacaaaaaaaaaaaaaaaaagauaaaagaaaaauacauagaccaagaagaauuaaauaaaaccaaaccgauauggacgagaaaucccgacgacauaaccaacgaagaauacggagaauucuauaaaagccugaccaacgacugggaagaccaucuggcagucaaacacuucaguguagaaggacaauuagaauucagagcacuacuauuuguaccgagacgagcaccauucgacuuauucgaaaauagaaaaaaaaaaaacaacauaaaauuguacguaagaagggucuucauaauggacaauugugaagaacuaauacccgaauaucuaaacuucauuagaggcguuguagacucagaagaccuuccacucaauauaucaagagaaauguuacaacaaaguaaaauacugaagguaauaaggaaaaauuuaguaaaaaaaugcuuggaacuauucacagaacuagcagaagacaaagaaaacuacaaaaaauuuuaugaacaauucucaaaaaacauaaaguuaggaauucacgaagauagccaaaauagaaagaaacuaucugaauuguuacgauauuauacauccgcaucaggugacgaaauggugucguuaaaagauuacugcacacgaaugaaagaaaaccaaaaacauauauauuacauaacaggagaaacaaaagaucaaguagcaaacagcgcauucgucgaacgacugagaaagcacggauuagaaguaauauacaugauagaaccaauagaugaauauuguguacaacaauuaaaagaauucgaaggaaaaacucucguaucaguaacaaaggaaggacuugaacuaccagaagaugaagaagaaaaaaaaaaacaagaagaaaaaaagacaaaauuugaaaaccucugcaaaauaaugaaagacauacuggaaaaaaaaguagaaaaaguaguagucucaaacagacuagugaccucaccuuguuguauagucacaagcacauauggauggaccgcaaacauggaaagaauaaugaaagcacaagcauuaagagauaacucaacaauggguuacauggcagcuaaaaaacaucucgaaauaaauccagaucauucuauaauagaaacucuuagacaaaaagcagaagcagauaaaaacgacaagaguguaaaagacuuagucauacuauuauacgaaacggcacuacucagcaguggauuuaguuuagaagauccacaaacacacgcgaacaggaucuacagaaugauuaaacuaggauuaggaaucgaugaagaugacccaacagcagacgacacaucagcagcaguaacagaagaaaugccaccacuagaaggggacgaugacacuagccgaauggaagaaguagacuaa

SEQ ID NO: 1345 - RNA, 339 nt, Artificial Sequence
  derived and/or modified CDS sequence (opt13) from Homo sapiens__NG_005218__HsHSP90AA3P
auggacagcucaaaacuagacucaggaaaaggacuacacauaaaccuaguaccaaacaaacaaaaccaaacacuaacaauaguagacacaagaauaggaaugacaaaaacagaccuaauaaacaaccuaggaacaguaacaaaaagcggaacaaaagcauucauggaagcacuacaagcagacgcagacauaagcaugauaggacacuucggaguaggauucuacucagcauaccuaguagcaaaaaaaguaacaguaauaucaaaacacaacaacgacgaacaauacacaugggaaucaagcgcaggaggaagcuucacaguaagaacagacgaauaa

SEQ ID NO: 1346 - RNA, 2175 nt, Artificial Sequence
  derived and/or modified CDS sequence (opt13) from Homo sapiens__NP_031381.2__HsHSP90AB1
augccagaagaaguacaucauggagaagaagaagucgaaacguuugcuuuccaagcggaaauagcgcaacuaaugagccuaauaauaaacacauucuauaguaacaaagaaaucuucuugagggaauuaauuucaaacgccuccgaugcauuagacaaaauaagauacgaaagcuuaacagacccaucaaaauuagauagcggaaaagagcuaaaaaucgacauaauaccuaacccacaagaacguacacugacacuuguagauacaggaauaggaaugacaaaagcagaccuaauaaacaaccuaggaacuauagcuaaaucaggcacgaaagccuucauggaagccuuacaagcaggagcagauauaucaaugauaggacaauuuggagugggauucuacagcgcauaccuaguagcagaaaaaguagucguaauaaccaaacauaaugacgacgaacaauacgcaugggaaagcucggcaggaggcagcuuuacaguaagagcagaucauggcgaaccuauaggaaggggcaccaaagucauccuacaucucaaagaagaucaaacagaauauuuagaagaaagacgagugaaagagguagucaaaaagcauucccaauuuauaggcuauccaauaaccuuauaccuagaaaaagaaagagaaaaagaaauaucagacgacgaagccgaagaagaaaaaggagaaaaagaagaagaagauaaagacgaugaagaaaaaccaaaaauagaagauguaggaagcgaugaagaagacgacucaggaaaagacaaaaaaaaaaagacaaaaaaaauaaaagaaaaauauaucgaucaagaagaacucaacaaaacaaaacccauauggacaagaaauccagacgacauaacacaggaagaauacggagaauucuauaaaagccuuacgaaugacugggaagaucaucuagcaguaaaacacuucucuguagaaggacaacuagaauuccgagcccuacuauucauaccaagacgcgcaccauucgaccuauucgaaaauaaaaaaaaaaaaaacaauauaaaauuauauguacggagaguguucauaauggacaguugcgaugaacuaauaccagaauacuuaaacuuuauaagaggagugguagacucagaagaccuaccccuaaauauaagccgggagauguuacaacaaagcaaaauauuaaaaguaaucaggaagaacauuguaaaaaaaugucuggaacuauuuucagaguuagcagaagauaaagaaaacuacaaaaaauucuacgaagcauucucaaaaaauuuaaaauuagggauacaugaagacagcacaaacagaagaagacugagcgaacuacuaagauaucauacaagucaaaguggagacgaaaugacuucacuaagugaauacguaucaagaaugaaagaaacacaaaaaucuauuuacuacauaacuggagaaucaaaagaacagguagcaaacagcgcauuugucgaacgaguaagaaaacgaggauucgaaguaguuuauaugacagaaccuaucgaugaauauugcguccaacaacuaaaagaauuugacggaaaaucacuugucaguguaacaaaagaaggacuagaacugcccgaagacgaagaagaaaaaaaaaaaauggaagaaucaaaggcuaaauucgaaaaucuaugcaaauuaaugaaagaaauacucgacaaaaaaguagaaaaaguaaccauaagcaaucgacuaguaucaaguccuugcuguauagucacaucaacauauggauggacagcgaauauggaaaggauaaugaaagcccaagcacuuagagacaauaguacaaugggauacaugauggccaaaaagcaucuagaaauaaauccugaccacccaaucguagaaacacuaagacaaaaagcagaagcagauaaaaacgacaaagcaguuaaagacuuaguugucuuauuauucgaaacagcacuacucucaaguggauucucacuagaagacccccaaacacauaguaacagaauauaccgaaugauuaaauugggauuaggaaucgacgaagacgaaguggcagccgaagaaccaaaugccgcaguacccgaugaaauaccaccccuagaaggagacgaagacgcaaguagaauggaagaaguagauuaa

SEQ ID NO: 1347 - RNA, 2412 nt, Artificial Sequence
  derived and/or modified CDS sequence (opt13) from Homo sapiens__NP_003290.1__HsHSP90B1
augagggcauuauggguucuaggacuauguugcguacuacuaacguucggaucaguaagagcagacgaugaaguagaugucgauggcacaguagaggaagaccuaggaaaaucaagagaaggaagccguacagacgacgaaguagugcaaagagaagaggaagcaauccaguuggauggacuaaaugcaagucaaauaagagaacuaagagaaaaaucagaaaaauucgcauuucaagcagaagugaacagaaugaugaaacuaauaaucaauucauuauauaaaaacaaagaaauauuccugagagaacuaauaagcaacgcaagugaugcuuuagauaaaauacgacuaauuagcuuaacagacgaaaaugcauuaagcggaaaugaagaguuaacaguaaaaauaaaaugugacaaagaaaaaaacuuacuccaugugacagacacaggaguaggaaugacccgcgaggaauugguaaaaaaucuaggaacgauagcuaaaagcggaacaagugaauuucuuaauaaaaugacagaagcacaagaagacggccaaucaacaagugaacuaauaggacaauucggaguugguuuuuauagugcuuuuuuaguugcugacaaaguaauagucacgucgaaacauaauaacgacacacaacacaucugggaaagugacucgaaugaauuuucaguuauagcagauccaagaggaaauacgcuaggcagagggacaacaauaacauuaguacuuaaagaagaagcaucagauuauuuagaauuagauacaauaaaaaaccuaguaaaaaaauauagucaauucauaaauuuccccauauauguauggaguaguaaaacagaaacgguagaagaaccaauggaagaagaagaagcagcuaaagaagaaaaagaggaaagugacgaugaagcagcaguugaagaagaagaagaagaaaaaaagccgaaaacuaaaaaagucgaaaaaacgguaugggacugggaacuuaugaacgauauaaagcccauauggcagagaccgagcaaagaaguagaagaagaugaauauaaagcauuuuacaaaucauuuaguaaagaaucagacgauccaauggcuuacauacauuuuacagccgagggagaaguaacauucaaaucaauuuuguuuguaccaacaagugcucccagagggcuauucgaugaauacggaucaaaaaaaagcgacuauauaaaacucuauguaagaagaguauucaucaccgacgacuuccacgauaugaugccuaaauaccuaaauuucguaaaaggagucguagauagugaugacuuaccauuaaauguaagcagagaaacucuccaacaacauaaauuacuaaaagugauacguaaaaaauuaguaagaaaaacacucgacaugauaaaaaaaauagcggaugauaaauauaaugauacauucuggaaagaauucggaacaaauauaaaacuuggcguaauagaagaucacucuaauagaacaagacuagcaaaacucuuaagguuccaaagcucacaucacccaaccgauauaacuucauuagaucaauauguagaaaggaugaaagaaaaacaagauaaaauauauuuuauggcaggaucaucaagaaaagaagcugaaaguagcccauucgucgaaagacuucuuaaaaaaggguaugaaguuauauauuugacagaaccaguagaugaauauuguauacaggcacuaccagaauucgaugguaaaagauuccaaaacguagcaaaagaaggcguaaaauucgacgaaagugagaaaacuaaggaaucacgagaagcgguagaaaaagaauucgagcccuuacucaauuggaugaaagacaaagcacuaaaagauaaaaucgaaaaagcuguggucagucaaagauuaacagaaucaccaugcgcauuaguugcaagucaauauggguggucaggaaauauggaaagaauaaugaaagcgcaagcauaucaaacuggaaaggauauaucgacuaacuacuacgcaucgcaaaagaaaacauucgaaauaaauccuagacacccauuaauaagagacaugcuacgaagaaucaaagaagaugaagacgacaagacaguacuagaucuagcaguaguauuauuugaaacagcaacauuaagaucggguuaccuucuuccggauacaaaagcauacggcgacagaauagaaagaaugcucagacuaucacucaacaucgacccagaugcaaaaguggaagaggaaccagaagaagaaccagaagaaacagcagaagauacgacagaagacacugaacaagaugaggacgaagaaauggacgugggaacugacgaagaagaagaaacugcaaaagaaagcacugcugagaaagaugaacuauaa

SEQ ID NO: 1348 - RNA, 2115 nt, Artificial Sequence
  derived and/or modified CDS sequence (opt13) from Homo sapiens__NP_057376.2__HsTRAP1
auggcaagagaacuaagagcucuauuacucuggggaagaagacuacgaccauuauuaagagccccugcauuagcagcugucccaggcgguaaaccuauccuauguccaagaaggacgacagcgcaauuaggaccuagaagaaauccagcuuggagcuuacaagcagguagauuauuuaguacacaaacagcagaagauaaagaagaaccucuacauagcauaaucaguaguacagaaucuguacaaggaaguacaaguaaacacgaauuucaagccgaaacaaagaaacuccuugacaucguagcuagaagucuauauucagaaaaagaaguauucaucagggaauuaauuucaaaugcaucagaugccuuagaaaaacuaagacacaaacugguauccgauggacaagcccuaccagaaauggagauacauuuacaaacaaacgcagaaaaagguaccaucacaauccaggauacagguauaggcaugacucaagaagaacuuguuucuaaccuaggaacuauagcaagaucuggcaguaaagcauuccuagaugcuuuacaaaaccaagcagaagcaucuucaaaaauaauaggacaauuugguguaggauucuauagugcauuuaugguggcugaucguguagaaguuuauucacggucagcagcuccaggaucauuaggauaccaauggcuaucugaugguucaggagucuucgagauugcagaagcauccggaguaagaacaggcacaaaaaucauaauacaccuaaaaucugauugcaaagaauuuucuagcgaagcaagaguaagagauguagucacaaaauacuccaacuucgucucauucccacuauacuuaaauggcagacgaaugaauacucuacaagcuauauggaugauggauccaaaagauguccgggaauggcaacaugaagaguucuauagauacguugcucaagcucacgacaaaccacgauauacacuucauuacaaaaccgaugcaccacuuaauauaagaucaauauuuuauguaccagacaugaaaccaucuauguucgauguauccagagaauuaggaucaucuguagcauuauacucaagaaaaguguuaauacaaacuaaagcaacagauaucuuaccaaaauggcuucgauucauaagaggaguuguagauucagaagacaucccacuaaacuuaucgagagaauuacuacaagaaucagcacuuauuagaaaacuaagagauguccuacaacaaagauuaauaaaauucuuuauagaucaaucaaagaaagaugcagaaaaauacgcaaaauucuucgaagacuauggacuauuuaugagggaaggcauaguaacugcaacagaacaagaaguuaaagaagacauugcaaaacuacuaagauaugaaaguuccgcguuaccuucaggccaacucacgagucuaagcgaauaugcaagccgcaugcgugcaggaacuagaaacauauacuaccuaugugcgccuaacaggcaucucgcagaacauuccccuuacuacgaagcaaugaaaaagaaagauacagaaguacucuucugcuucgaacaauuugaugaacucacauuauuacaucuacgcgaguucgacaaaaagaaauuaauauccguagaaacagacaucgucguagaccacuauaaagaagaaaaauuugaagacagaucccccgcagcagaauguuuaagugaaaaagaaacagaagaauuaauggcauggaugagaaacguacuuggcucaagaguuacuaacguuaaaguaacucuacgacuagacacacauccugccaugguaacggucuuagaaaugggagcagcaagacacuuccuuagaaugcaacaauuagcaaaaacccaagaagaaagagcacaauuacuacaaccaacauuagaaaucaauccuaggcaugcauuaauaaagaaacuaaaccagcuuagagcaagcgaacccggucuugcacaacuauuaguagaucaaaucuaugaaaacgccaugauagcagcaggucuaguugacgaccccagagcaaugguagguagacuuaacgaacuacucgucaaagcauuagaaaggcauuaa

SEQ ID NO: 1349 - RNA, 462 nt, Artificial Sequence
  derived and/or modified CDS sequence (opt13) from Homo sapiens__NP_000609.1__HsIGF1
augggaaaaauaucaucacuaccuacacaacuauucaaaugcugcuucugcgacuuccuaaaaguaaaaaugcacacaaugucauccucacaccuauucuaccuagcacuaugccuacuaacauucacaucaucagcaacagccggaccagaaacacuaugcggagcagaacuaguagacgcauuacaauucguaugcggagacagaggauucuacuucaacaaaccaacaggauacggaucaucaucaagaagagcaccacaaacaggaauaguagacgaaugcuguuucagaucaugcgacuuaagaagacuagaaauguacugcgcaccauuaaaaccagcaaaaagcgcaagaucaguaagagcacaaagacauacagacaugccaaaaacacaaaaagaaguacaccuaaaaaacgcaucaagaggaucagcaggaaacaaaaacuacagaauguaa

SEQ ID NO: 1350 - RNA, 543 nt, Artificial Sequence
  derived and/or modified CDS sequence (opt13) from Homo sapiens__NP_000603.1__HsIGF2
augggaauaccaaugggaaaaucaaugcuaguacuauuaacauuucuagccuucgcaucauguugcauagcagcauacagaccaagugaaacucuauguggaggagaauuaguagauacacuacaauuuguauguggagauagagguuucuauuucaguagaccagcaagcagaguaucaagaagaaguagaggaauaguagaagaaugcuguuucagaucaugugaccuagcacuacuagaaacauauugcgcaacaccagcaaaaucagaaagagauguaucaacaccaccaacaguauuaccagauaacuuuccaagauacccuguaggaaaauuuuuccaauacgauacauggaaacaaucaacacaaagacuaagaagaggacuaccagcacuacuaagagcaagaagaggacacguacuagcaaaagaacuagaagcauuuagagaagcaaaaagacauagaccauuaauagcauuaccaacacaagauccagcacacggaggagcaccaccagaaauggcaucaaacagaaaauaa

SEQ ID NO: 1351 - RNA, 639 nt, Artificial Sequence
  derived and/or modified CDS sequence (opt13) from Homo sapiens__NP_000591.1__HsIL6
augaacucauuuucaacaucagcauucggaccaguagcauucucacuaggauuacuacuaguacuaccagcagcauucccagccccaguaccacccggagaagacuccaaagacguagccgccccacacagacaaccacuaacaucauccgaaagaauagauaaacaaauaagauacauacuagacggaaucucagcacuaagaaaagaaacaugcaacaaaucaaacaugugcgaaucaucaaaagaagcacuagcagaaaacaauuuaaaccuaccaaaaauggcagaaaaagacggcugcuuccaaucaggauucaaugaagaaaccugccuaguaaaaauaauaacaggauuacucgaauucgaaguauacuuagaauaccuacaaaacagauucgaaucaucagaagaacaagcaagagcaguacaaaugagcacaaaaguacucauacaauuccuacaaaaaaaagcaaaaaaucuagacgcaauaacaacaccagacccaacaacaaacgcaucacuacuaacaaaacuacaagcacaaaaccaauggcuacaagacaugacaacucaccuaauacucagauccuucaaagaauuucuacaauccucacuaagagcacuaagacaaauguaa

SEQ ID NO: 1352 - RNA, 1281 nt, Artificial Sequence
  derived and/or modified CDS sequence (opt13) from Homo sapiens__NP_002183.1__HsINHBA
augccauuacuaugguuaagagguuuucuauuagcaucaugcuggauaauaguaagaucaaguccaacaccaggaagugaaggucauagugcagcaccugacuguccuaguugcgcauuagcagcauuaccaaaagacguaccaaacagccagccagaaaugguagaagcaguaaaaaaacauauauuaaauaugcuacaucuaaaaaaaaggccagacguaacacaaccaguaccaaaagcggcuuuauuaaaugcaauaagaaaauuacauguagguaaaguaggagaaaacgguuacguagaaauagaggaugacauaggccgaagagcagaaaugaaugaacuaauggaacaaacaagugaaauaauaacauuugcagaaucaggaacagcaagaaaaacgcuacacuucgaaauaagcaaagaaggaagcgaucuuagugugguagaaagagcagaaguaugguuauuccugaagguacccaaagccaaucgaacgagaacaaaaguaacaauaagauuauuucaacaacaaaaacauccacaagguucacuagauacaggagaggaagccgaagaaguagguuuaaaaggagaaagaucugaauuauuauuguccgaaaaaguaguagaugccagaaaaaguaccuggcauguauuuccagugaguucaucaauacaaagauuacuagaucaagguaaaucaucacuagauguaagaauagcaugugaacaaugucaagaaaguggagcuaguuuaguacuauuaggaaagaaaaaaaaaaaggaggaagaaggagaaggaaaaaaaaaaggaggaggagaaggaggagcgggagcagaugaagaaaaagaacaaagucauagaccauucuuaauguuacaagcaagacaaagcgaagaucauccacacagaagaagacgacgaggacuagaaugcgauggaaaagucaauauauguuguaaaaaacaauuuuuuguaucauuuaaagacauaggauggaacgauuggauaauagcgccaucaggauaucacgcuaacuauugugaaggagaauguccaagccauauagcaggaacgaguggaagcucauuaucauuucacagcacgguaauaaaccauuauagaaugagaggacauagcccauuugcaaauuuaaaaucauguuguguaccuacaaaacuacguccaaugagcaugcuauauuacgacgacggacaaaauauuauaaagaaagauauccaaaauaugauaguagaagagugcggauguagcuaa

SEQ ID NO: 1353 - RNA, 1224 nt, Artificial Sequence
  derived and/or modified CDS sequence (opt13) from Homo sapiens__NP_002184.2__HsINHBB
auggauggauuaccagggagagcauuaggagcagcaugucuauuauuauuagcagcagguugguuaggcccagaagcauggggaucuccaacaccaccaccaacaccagcagcacccccaccaccaccaccaccaggaaguccaggaggaagccaagauacauguacaagcugugguggauuuagaagaccagaagaauuaggaagaguagauggagacuuuuuagaagccguaaaaagacacauacuuucaagauuacaaaugagaggaaggccaaauauaacacaugcaguaccaaaggcagcaaugguuacagcauuaagaaaauuacacgcaggaaaaguaagagaagaugguagaguagaaauaccacauuuagacgggcacgcaucaccaggugcagaugggcaagaaagaguaagugagauaauuagcuuugcagaaacagauggauuagcaucaucaagaguacgauuauauuucuuuauaaguaacgaaggaaaucaaaaucuauucguagugcaagcaucacuaugguuauauuuaaaauuauugccauauguacuagaaaaaggaagcagaagaaagguaagaguuaaaguuuauuuucaagaacaaggucauggagaucgauggaauaugguagaaaaacgaguagauuuaaaaagaucaggauggcauacauuuccacuaacagaagcaauacaagcauuauucgaaagaggcgaaagaagacugaauuuagacgugcaaugugacucaugccaagaauuagcagugguuccagucuuuguagacccaggagaagaaagccauagaccauuuguaguaguacaagcaagacuaggagauaguagacauagaauaagaaaaagagguuuagaaugugacggaagaacaaauuuauguugcagacaacaauucuuuauugauuuuagguuaauagguuggaaugauuggauaauagcaccaacaggauauuauggaaauuauugugaaggaagcuguccagcauauuuagcugguguaccagguucagcuaguaguuuucacacagcaguagucaaucaauaucguaugcgaggauuaaauccugguacuguaaauagcuguuguauaccaacaaaacuaaguacaaugucaauguuauauuuugaugaugaauauaauauaguuaaaagagauguuccaaauaugauaguagaagaauguggaugcgcuuaa

SEQ ID NO: 1354 - RNA, 3459 nt, Artificial Sequence
  derived and/or modified CDS sequence (opt13) from Homo sapiens__NP_000623.2__HsITGAM
auggcauuacgagucuuacuuuuaacagcauuaacucugugccacggauuuaaucuugauacagaaaaugcaaugacauuucaagaaaacgcacgaggauuuggccagucgguaguacaguuacaggguagcaggguuguugucggugccccacaagaaauaguagcagccaaucaaagagguucacuauaccaaugugauuacucuacaggaaguugugagcccauaagauuacaaguacccgucgaagcagucaauaugucccuaggacuaaguuuagcagcaacaacuagcccaccacaauuacuagcuugcggcccaaccguacaccagacauguucugaaaauaccuaugucaaagguuuaugcuucuuauucgguaguaauuuaagacagcaaccacaaaaauuuccugaagcacuacgcggauguccucaagaagacuccgacauagcauuucuaauagacggaaguggcaguauaauaccccaugacuuuaggagaaugaaagaauuuguguccacaguaauggaacaacuaaagaaaucuaagacacuuuucucauuaaugcaauauagugaagaauuuagaauacauuucaccuucaaagaauuucaaaacaacccgaauccaagaucccuaguuaaaccaauaacccaguuacuaggaagaacacauacugccacaggcauucgaaaaguaguacgagaacuauuuaacauuacuaauggagcuagaaagaacgcuuucaaaauucuaguaguuauaacugauggagagaaauucggagacccucuuggauacgaagauguuauaccagaagccgauagagaaggagucauaagauauguaauaggaguaggcgaugccuuccgaagcgaaaaauccagacaggaacuaaauacaauagcuagcaaaccaccgagggaccacguuuuucaagucaauaauuuugaagcauuaaaaaccauucaaaaccaacuaagggagaaaauauucgcuauagaaggaacacaaaccggaucuaguaguagcuuugaacaugaaaugucccaagaagguuuuucugcugcgauaacuucaaauggcccacuacuaucaacagucgguaguuaugauugggccggaggaguauuccuuuauacaaguaaagaaaaaucaacauucauaaauaugacaagaguagacucugauaugaaugaugccuauuuaggauacgcagcagcaaucauacuacgcaacagaguccaaucacucguacuaggugcccccagauaccaacauaucggucuggucgcuauguuucgucaaaauacagguaugugggaaaguaaugcaaauguaaaagguacucaaauaggcgcauauuuuggugcuucauuaugcagcguugacguggauucgaacgguaguacagacuuaguguuaauaggcgcaccccacuacuacgaacaaacaagaggugggcagguaucaguaugcccucuacccagaggccgugccagauggcaaugugacgcaguacuauauggagaacaagggcaaccaugggguagauuuggggcugcauugacaguuuuaggagacguaaauggagauaaacuaacggauguugcuauaggagccccuggugaggaagauaauagaggagcgguauaccuauuucauggaacaucuggaaguggaauuucaccuagucacucacaaaggauagcaggauccaagcucuccccacgauuacaauauuuuggacagagccuaucgggaggucaagaucuaacuauggaugguuugguggaucucaccguaggcgcucaaggucaugugcuacuauuacgaucacaaccuguacuuagaguaaaagccauaauggaguucaacccaagagaaguagcucguaauguauucgaaugcaacgaucaaguuguaaaaggcaaagaagcaggagaagugcgugucugucuucauguucagaaaagcacacgugaucgauuaagagagggccaaauucaaucuguaguuacauacgacuuagccuuagacuccggacgaccacacucucgcgcagucuuuaaugaaacgaaaaacucaacacgaaggcaaacacaaguacuaggauuaacucaaacaugcgaaacccuuaaacuacaauuaccuaacuguaucgaagacccaguaucuccaaucguauugagacuaaauuuuuccuuaguaggcacaccacuuagugcuuuuggaaaucuaagaccggucuuagcagaagaugcucaaagauuauuuaccgcacuguucccauucgagaaaaacuguggaaacgauaauauaugccaagacgacuuaucuauuacauucucauucaugucguuagauugucuaguaguaggaggacccagagaauuuaauguaaccgucacaguucgaaaugacggagaagacucauauagaacccaaguaacauucuucuuuccguuagaucucagcuaucggaaaguaucaacauuacaaaaccaacgaagccaacgaucauggaggcucgcaugugaaagcgcuuccaguacggaaguaaguggagcacucaaaucuacaucuugcucuauuaaccacccaauauuuccggaaaacagugaggucacuuuuaauaucaccuucgacguagauagcaaagccaguuuaggaaauaaacuucuucucaaggcaaacguaacuucugaaaauaauaugccaagaaccaacaaaacagaguuccaacuagaauuaccagucaaauacgcaguauauaugguaguaacaagucauggaguuuccacgaaauaccuaaacuuuacugcaucagaaaacacaagcagaguaaugcaacaucaauaccaaguaucaaauuuaggacaacgaaguuuaccaauaucguuaguuuuccuggucccagucagauugaaucaaacaguaaucugggauagaccacaaguaacauuuucagaaaaucucucaucaaccugucauaccaaggaaagauuaccuucacauucagauuuucuagcagaacuacgcaaagcuccaguaguuaauugcucaaucgcaguaugucaaagaauacaaugugacaucccauucuuuggcauucaagaagaauuuaacgcuacauuaaaaggaaaucuuaguuuugauugguacaucaaaaccagucauaaccauuuacuaauagucucuacugcugaaauacuauuuaaugauucuguauuuacucuauuaccaggacaaggagcuuuuguucgaucacaaacagaaacuaaaguagaaccauucgaagucccaaauccauuaccauuaaucguggguucuucuguaggcggcuuauuacuuuuagcauuaauaacugcugccuuguauaaauuaggauuuuucaaaaggcaauauaaagauaugaugucugaaggagguccacccggagccgaaccacaauaa

SEQ ID NO: 1355 - RNA, 1404 nt, Artificial Sequence
  derived and/or modified CDS sequence (opt13) from Homo sapiens__NP_002415.1__HsMMP8
auguucucccucaaaacacuaccauucuuacuacuacuccauguacaaauauccaaagcauucccuguaucaucaaaagaaaaaaacacaaaaacaguacaagacuaccuagaaaaauucuaccaauuaccuucaaaccaauaccaaucaacaagaaaaaacggaacaaacguuauaguagaaaaacuaaaagaaaugcaacguuucuuugguuuaaauguaacagguaaaccaaacgaagaaacauuagacaugaugaaaaaaccaagauguggaguaccagacuccggcggauuuauguuaacaccaggaaauccaaaaugggaaagaacaaauuuaacuuaccgaauaagaaacuacacaccucaauuaagcgaagcagaaguagaaagagcaauaaaagaugccuucgaacuaugguccguagcaucaccucuaauuuucacaagaauaucacaaggagaagcagacaucaacauagcuuuuuaucaaagagaucacggagacaauucaccauuugauggaccaaacggaauccuagcacaugcauuucaacccggucaaggaauaggaggagacgcacacuucgaugccgaagaaacauggaccaacacuucagcaaacuacaaccuauuucuaguagcagcacaugaauucggccacucauuaggacucgcucauuccucagacccuggagcccuaauguaucccaacuaugcauucagagaaacaucaaacuauucacuaccucaagacgacauagauggaauucaagcuaucuacggauuaucaucaaacccaauucaaccaacaggaccaucaacacccaaaccuugugacccaucccuaacauuugacgcuauaacaacacuaagaggagaaauauuauucuucaaagacagauacuuuuggagaagacacccucaacuacaaagaguugaaaugaacuuuauaucauuauucuggccaucacuaccaacaggaauacaagcagcauacgaagacuucgauagagacuuaauauuccuuuucaaaggaaaccaauacugggcccuaaguggauacgacauauuacaagguuauccuaaagacauaucaaacuacggauuuccaucuucaguacaagcaauagacgcagcagucuucuauagaucaaaaacauacuuuuucguaaacgaccaauucuggagauaugacaaccaacgacaauuuauggaaccaggauauccaaaaucaauaucaggagcauucccuggaauagaauccaaaguagacgcaguauuucaacaagaacacuucuuccauguuuuuucaggaccaagauacuacgcuuuugacuuaauagcacaaagaguaacaagaguagcaagaggaaacaaauggcuaaacugccgauauggauaa

SEQ ID NO: 1356 - RNA, 2124 nt, Artificial Sequence
  derived and/or modified CDS sequence (opt13) from Homo sapiens__NP_004985.2__HsMMP9
augucauuauggcaaccauuaguuuugguacuuuuaguauuaggauguuguuuugcugcaccacgucaaagacaaaguacauuaguccuauuuccaggcgauuuaagaacaaauuuaacagacagacaacuugcagaagaauaucuauauagauaugguuauacaagaguagcugaaaugagaggugaaucaaaaucucuaggaccagcauuauuacuacuacaaaaacaguuaucacuaccagaaaccggggaacuagacucagcuacacuuaaagcaaugagaacuccacgguguggagucccagaucucggucgguuucaaacauuugaaggagaccuuaaauggcaucaucacaauauaacauauuggauacagaauuauucagaagaccuaccaagagcgguuauagacgacgcauucgcccgagcauuugcacuauggagugcuguaacaccauugacuuuuacaaggguauauagucgagaugcagauaucguaauacaauuugguguagcagagcauggggauggauacccuuuugacgguaaagacggacuucuagcacaugcauuuccaccaggaccuggaauacaaggagaugcccauuuugaugacgacgaacuauggagucuuggaaaaggagucguaguaccuacaagauuugguaaugcugauggugcagcaugucauuuuccuuuuauauuugaaggacgaucuuacucugcaugcacuacagauggacguucagauggauuaccaugguguucuacuacagccaauuaugauacagaugauagauuugguuuuuguccuucagaacgauuauauacgcaagauggaaaugcagauggaaaaccuugucaauucccauuuauauuucaaggacaaucauauucagcauguacaacagauggacgaagcgauggauaucgauggugugcaacaacagcuaacuacgacagagauaaauuauuugguuuuuguccaacucgcgcugacucaacagucaugggugguaauagcgcuggugaauuauguguauuuccauuuacuuuccuuggcaaagaauacucaacaugcacaucggaaggaagaggagauggacgauuauggugugcaacuacuaguaauuucgacagugacaaaaaauggggauuuuguccggaccaaggguauucacuuuucuuaguugcagcacacgaauucggucaugcacuuggccuagaccauucaucaguaccugaagcucuuauguacccaauguauagauuuacagaaggaccuccacuccauaaagacgaugucaacggcauacgccaucuauaugguccacguccagagccugaaccaaggccucccacaacaacaacaccacaaccuacugcuccaccuacaguaugcccgacuggcccaccaacaguacauccaucugaaagaccaacggccggaccaacgggaccuccuucagcggguccaacaggaccaccaacagcaggccccagcacugccacuacaguaccauuaucaccuguggacgaugcuuguaauguuaauauauuugaugcaauagcugaaauugguaaucaacuguauuuauuuaaagauggaaaauauuggcgauuuagugaaggacgcggaucuagaccccaaggaccauuucuaauugccgauaaauggccagcccuaccuagaaaauuagauucuguauuugaagaaagauuaucaaaaaaauuauuuuuuuucucaggaagacaaguauggguuuauacaggagcaucaguacuaggaccuagaagacuagauaaacuagguuuaggagccgacgucgcacaaguuacaggcgcccuaagaucaggaagaggaaaaauguuauuauucagcgguagaagauuauggagauuugaugugaaagcacaaaugguugauccaagaucagcuagcgaagucgaucgaauguucccagguguaccauuggauacucaugauguuuuucaauauagagaaaaagcauauuuuugucaagauagauuuuauuggcguguuucaucuaggagugaauuaaaccaaguggaucaaguaggauauguaacauacgauauacuacaauguccagaagauuaa

SEQ ID NO: 1357 - RNA, 1416 nt, Artificial Sequence
  derived and/or modified CDS sequence (opt13) from Homo sapiens__NP_002418.1__HsMMP13
augcacccaggaguauuagcagcauuccucuucuuaucauggacacacugccgagcauuaccauuaccaucaggaggagacgaagacgaucuaucagaagaagaccuucaauucgcagaaagauacuuaagaucauacuaccacccaacaaacuuagcagguauacuaaaagaaaacgcagccucuucaaugacagaaagacuuagagaaaugcaaucauucuucggauuagaaguaacaggaaaauuagaugacaauacacuagauguaaugaaaaaaccuagaugcggaguuccugacguaggagaauauaacgucuuuccaagaacauuaaaaugguccaaaaugaaccuaacauauagaauaguaaacuauacaccagauaugacccauucagaagucgaaaaagcauucaaaaaagcauucaaaguauggucagauguaacaccucuaaacuucacaagacuacaugacggaauagcagacaucaugauaagcuuuggaauaaaagaacacggagauuucuacccauucgacggaccaucuggauuauuagcccacgcauuucccccaggaccaaauuauggaggagacgcacauuucgaugacgaugaaacauggacaucaucaucaaaaggauacaaccuauucuuaguagcagcacacgaauucggacacucuuuaggcuuagaccauucaaaagaccccggagcacuaauguucccaauauauacauauacaggaaaaagccacuucauguuaccagacgaugacguccaagguauacaaagucuauacggaccaggagaugaagauccuaacccaaaacauccaaaaaccccagacaaaugugauccaucauuaucauuagaugccauaacaucauuacgaggagaaacaaugauuuucaaagaccguuucuucuggcgucuucacccacaacaagucgacgcagaacucuuuuuaacaaaaucguuuuggccugaacuaccaaacagaauagaugcagcauacgaacacccuagucacgacuuaauauuuauuuuucgaggacgaaaauucugggcccuaaauggauacgauauauuagaaggauacccuaaaaaaauaucugaacuaggauuaccaaaagaaguaaaaaaaauaucagccgcaguccacuuugaagauacaggaaaaacacuucuauuuucaggcaaucaagucuggagauacgacgacacaaaccacauaauggacaaagacuaccccagauuaauagaagaagacuucccaggcauaggugacaaaguagacgcaguauacgaaaaaaacggauauauauauuucuucaacggaccaauacaauuugaauacucuauauggucaaacagaauaguaagaguaaugccagcaaacuccauuuuauggugcuaa

SEQ ID NO: 1358 - RNA, 1068 nt, Artificial Sequence
  derived and/or modified CDS sequence (opt13) from Homo sapiens__NP_001286.1__HsCCR1
auggaaacaccaaacacaacagaagacuacgauacaaccacagaauuugauuauggagacgcaacaccaugucaaaaaguaaacgaaagagccuuuggcgcgcaacuacuacccccauuauacucacuagucuucgucauaggacuaguagguaauauacuaguaguacuaguauuaguccaauacaaaagauuaaaaaauaugacaucaauauauuuacuaaacuuagcaauaucagauuuacuauuccuauucacauuaccauucuggaucgacuacaaacuaaaagacgacuggguauuuggagacgcaaugugcaaaauacucucaggauucuacuacacaggccuauacucugaaaucuucuucauaauacuacuaacaauagauagauaccuagcaauaguucaugcaguauucgcauuaagagccagaaccgucacauucggagucauaacaucaauaauaauaugggccuuagcaauauuagcaucaaugccaggacuauacuuuucuaaaacacaaugggaauucacacaucauacaugcucacuucacuucccucacgaaucccuaagagaauggaaacucuuccaagcauuaaaacucaaucuuuucggacuaguacuaccccuacucguaaugaucauaugcuacacaggaauaauaaaaauacuacuacgacgaccaaacgaaaaaaaaucaaaagcaguaagauuaauauucguaauaaugaucaucuucuuccuuuuuuggaccccuuacaaccucacaauacuaauaucaguauuccaagacuuuuuauucacacacgaaugugaacaauccagacaucucgacuuagcaguacaagucaccgaaguaauagcauacacacacuguugcguuaaccccguaauauacgcuuuuguaggagaaagauuccgaaaauaucuaagacaacuauuucacagacgaguugcaguacacuuagucaaaugguuaccauuucuaucaguagauagauuagaaagagucucauccacaucaccaucaaccggagaacacgaauuaucagcaggauucuaa

SEQ ID NO: 1359 - RNA, 636 nt, Artificial Sequence
  derived and/or modified CDS sequence (opt13) from Homo sapiens__NP_002598.4__HsPDGFA
augagaacacuagcaugccuacuauuacuaggaugcggauaccuagcacauguacuagcugaagaagcagaaauaccaagagaaguaauagaaagacuagcaagaucacaaauacacucaauaagagaccuacaacgacuacuagaaauagacucagucggaagugaagacucacucgacacaagucuaagagcacacggaguacacgcaacaaaacacguaccagaaaaaagaccacuacccauaagaagaaaaagaagcauagaagaagcaguaccagcaguaugcaaaacacgaacaguaauauacgaaauaccaagaucacaaguagacccaacaucagcaaacuuccuaauauggcccccaugcguagaaguaaaaagaugcacaggaugcugcaacacaucaagcguaaaaugccaaccaagcaggguacaccacagaagcgucaaaguagcaaaaguagaauacguaagaaaaaaaccaaaacuaaaagaaguacaaguaagacuagaagaacaccuagaaugcgcaugugcaacaacaagccuaaauccagauuacagagaagaagacacaggaagaccaagagaaagcggaaaaaaaagaaaaagaaaaagacuaaaaccaacauaa

SEQ ID NO: 1360 - RNA, 726 nt, Artificial Sequence
  derived and/or modified CDS sequence (opt13) from Homo sapiens__NP_002599.1__HsPDGFB
augaacagaugcugggcauuauucuuaucauuaugcuguuaccuaagauuaguaucagcagaaggagauccaauaccagaagaacuauacgaaaugcuaagcgaucacaguauaagaagcuuugacgaucuacaaagauuacuucacggcgauccaggagaagaagacggagcagaauuagaccuaaauaugacaagaucacacucaggaggagaauuagaaucacuagcacguggaagaagaagccuaggaagucuaacaauagcagaaccugcaaugauagcagaauguaaaacacgaacagaaguauucgaaauaucaagaagauuaauagauagaacaaaugcaaauuucuuaguauggccaccauguguagaaguacaaagaugcaguggaugcugcaauaacagaaacguacaauguagaccaacacaaguacaauuaagaccaguacaaguaagaaaaauagaaauaguaagaaaaaaaccaauauuuaaaaaagcaacagucacauuagaggaccaccucgcaugcaaaugugaaaccguagcagcagcaagaccaguaacaagaagcccaggcggaagccaagaacaaagagcaaaaacaccacaaacuagaguuacaauaagaacaguaagaguacgaaggcccccaaaaggaaaacauagaaaauucaaacacacacacgacaaaacagcacuaaaagaaacacuaggagcguaa

SEQ ID NO: 1361 - RNA, 1038 nt, Artificial Sequence
  derived and/or modified CDS sequence (opt13) from Homo sapiens__NP_057289.1__HsPDGFC
augucauuauuuggauuauuacuacuuacaucagcauuagcaggacaaagacaagguacacaagcagaaagcaaucuaucaagcaaauuccaauuuucauccaauaaagaacaaaauggaguacaagacccacaacacgaaagaauaauaaccgucagcacaaacggcucaauacauaguccacgauucccacauacauauccaagaaacaccguacucgucuggagauuaguagcaguugaagaaaauguauggauccaauuaacauucgacgaaagauuuggauuagaagacccugaagacgacauaugcaaauacgacuuuguagaaguagaagaaccaucagacggaacaauauuaggacgauggugcggaucagguacaguaccugguaaacaaaucucaaaaggcaaccaaauaagaauaagauucguaagcgaugaauacuucccaagugaaccaggauucuguauacauuacaauaucgucaugccacaauucacagaagcaguaucaccaucaguacuaccaccaucagcucuaccauuagacuuacuaaauaacgcuauaacagcauuuucaacauuagaagacuuaauacgauacuuagaaccagaaagauggcaacuagaccuagaagaccuauacaggccaacauggcaacuucuaggaaaagcauuuguauuuggaagaaaaucacgaguugucgaucuaaaccuauuaacagaagaaguaagacuuuacucaugcacaccaagaaacuuuucaguauccauaagagaagaacuaaaaagaacagauacaauauucuggccaggaugccuacuaguaaaaagaugcggcggaaauugcgcaugcugcuuacacaacuguaacgaaugccaaugcguaccaucaaaaguuacaaaaaaauaccacgaaguacuacaauuaagacccaaaacuggaguuagaggacuacauaaaucucuaacagacguagcacuagaacaucacgaagaaugugacugcguuugccgaggaagcacaggaggcuaa

SEQ ID NO: 1362 - RNA, 1095 nt, Artificial Sequence
  derived and/or modified CDS sequence (opt13) from Homo sapiens__NP_149126.1__HsPDGFD
augcacagauuaauauuuguauacacacuaauaugugcaaacuucugcucaugcagagacacauccgcaacuccacaaucagcaucaauaaaagcuuuaagaaacgcaaaucuaagaagagacgaucuauacagaagagacgaaaccauacaaguaaaaggaaacggcuacguacaaagcccacgauucccuaacucauacccaagaaaucuauuauuaacauggcgacuacacucccaagaaaacacaagaauacaacuaguauucgauaaccaauucggauuagaagaagcagaaaacgacauauguagauaugauuucguagaaguagaagacauaucagaaacaucaacuauaauacgaggaagauggugcggacacaaagaaguaccaccacgaauaaaaucaagaacaaaccaaauaaaaauaacuuucaaaucagaugacuacuucguugcaaaacccggauucaaaauauauuauagccuacuagaagacuuccaaccagcagcagcuucagaaacaaauugggaaucagucacaagcucaauaucaggaguaucauauaauagcccaucaguuacagacccaacacuaaucgccgacgcauuagacaaaaaaauagcagaauucgauacaguagaagaucuacuaaaauacuuuaacccugaaucauggcaagaagaucuagaaaacauguaucuagacacacccagauacagaggaagaagcuaccacgacagaaaaucaaaaguagacuuagacagacuaaaugaugacgcaaaaagauacucaugcacaccaagaaacuacagcguaaauauaagagaagaacuaaaauuagcaaacguaguauucuucccaagaugucuauuaguacaacgcugcggaggaaacuguggaugcggaacaguaaacuggcgaagcuguacaugcaauuccggaaaaacagucaaaaaauaccacgaaguacuacaauucgaacccggacauauaaaaagaagagguagagcaaaaacaauggcacuaguagauauacaauuagaccaccaugaaagaugcgauuguauaugcagcucuagaccuccaagauaa

SEQ ID NO: 1363 - RNA, 678 nt, Artificial Sequence
  derived and/or modified CDS sequence (opt13) from Homo sapiens__NP_003946.3__HsSOCS3
auggucacccauucaaaauucccagcagcaggaaugucaagaccauuagacacaucauuacgauuaaaaacauucucaucaaaaucagaauaccaacuaguaguaaaugcaguaagaaaacuacaagaaucaggauucuauuggucagcaguaacaggaggagaagcaaauuuauuacuaucagcagaaccagcaggaacuuuccuaauacgagacucaucagaccaacgacacuucuuuacucuaucaguaaaaacacaaucaggaacaaaaaaccucagaauacaaugugaaggaggaucauucucccuacaaucagaccccagaucaacacaacccguaccaagauucgacugcguacuaaaacuaguacaccacuacaugccaccacccggagcaccauccuucccaucuccaccaacagaaccaucaucugaaguaccugaacaaccaucagcacaaccacuaccuggaucaccaccaagaagagcauacuacauauacucaggaggagaaaaaauaccacuaguacuuucaagaccacuaucaucuaauguagcaacacuacaacacuuaugccgaaaaacaguaaacggccaccuagacucauacgaaaaagucacacaacuaccaggaccaauaagagaauucuuagaucaauacgacgcaccacuauaa

SEQ ID NO: 1364 - RNA, 483 nt, Artificial Sequence
  derived and/or modified CDS sequence (opt13) from Homo sapiens__NP_003227.1__HsTGFA
augguaccaucagcaggacaauuagcauuauuugcacuaggaauaguacuagcagcaugucaagcauuagaaaacucaacaucaccacuaucagcagacccaccaguagcagcagcaguaguaucacauuuuaaugauugcccagacucacacacacaauucugcuuucacggaacauguagauuucuaguacaagaagacaaaccagcauguguaugucauucaggauauguaggagcaagaugugaacaugcagauuuauuagcaguaguagcagcaucacaaaaaaaacaagcaauaacugcauuaguaguaguaaguauaguagcauuagcaguauuaauaauaacauguguauuaauacauugcugucaaguaagaaaacauugugaauggugcagagcauuaauauguagacaugaaaaaccuucagcauuacuaaaaggaagaacagcaugcugucacucagaaacaguaguauaa

SEQ ID NO: 1365 - RNA, 1173 nt, Artificial Sequence
  derived and/or modified CDS sequence (opt13) from Homo sapiens__NP_000651.3__HsTGFB1
augccaccaucaggucuacgacuacuaccucucuuacuaccuuuacuauggcuccucguacuaaccccaggccgaccagcagcuggccuaucaacaugcaaaacaauagacauggaauuagucaaaagaaaaagaauagaagcaauuagaggacaaauacuaucaaaauuaagauuagccuccccaccuucucaaggagaaguaccaccagguccacuaccugaagcaguccuagcacuauacaacucaacaagagacagaguagcaggagaauccgcagaaccagaacccgaaccagaagcagacuauuaugcaaaagaagucaccagaguacuaaugguagaaacacauaaugaaaucuacgauaaauuuaaacaaucaacacauucaauauacauguuuuucaacacaagugaacuaagagaagcaguaccagaaccaguauuacuaucacgagccgaauuaagacuccuaagacuuaaacuaaaaguagaacaacacguugaauuauaccaaaaauacucuaacaacucauggagauacuuaucuaaucgacuacuagcacccucagacucaccagaauggcucucauucgacguaaccggaguaguacgacaauggcuaucccguggcggugaaauagaaggauucagacuauccgcacacugcucuugcgacucaagagacaauacauuacaaguagauauaaacggauucacaacaggaagaagaggagacuuagcuacaauccacggaaugaaccgccccuuccuacuauuaauggcaacuccucuagaaagagcacaacacuuacaauccucaagacacagaagagcacuagacacaaacuauuguuucucaagcacugaaaaaaacugcugcguccgacaauuauacauagacuuccgaaaagaucucggauggaaauggauacacgaaccaaaaggauaccacgccaacuucugccucgguccauguccauauaucuggucacuagauacacaauacuccaaaguacuagcauuauauaaccaacauaauccaggagcaucagcagcgccaugcugcguaccacaagcauuagaaccacucccaauaguauacuaugucggaagaaaaccaaaaguagaacaacuaucaaacaugauagucagaucaugcaaauguucuuaa

SEQ ID NO: 1366 - RNA, 1245 nt, Artificial Sequence
  derived and/or modified CDS sequence (opt13) from Homo sapiens__NP_003229.1__HsTGFB2
augcacuauugcguacuuucagcauuucuaauauuacaccuaguaacagucgcuuuaaguuuaagcacaugcucaaccuuagacauggaccaauuuaugagaaaacgaauagaagcaauaagaggacaaauauuauccaaacuaaaacuaacaucaccacccgaagauuauccagaaccagaagaagucccaccagaaguaauaucaauauauaacagcacaagagaccuccuacaagaaaaagcaucaagaagagcagcagcaugcgaacgagaaagaucagaugaagaauauuacgcuaaagaaguauacaaaauagacaugccccccuucuuuccaucagaaaaugcaauaccaccaaccuuuuacagacccuauuuucgaauaguaagauucgauguaucagccauggaaaaaaacgcaucaaaccuagucaaagcggaauucagaguauuccgacuucaaaacccaaaagcuagaguucccgaacaacgaaucgaacuauaucaaauacuaaaaucaaaagaccuaaccucacccacacaaagauacauagacucaaaaguaguaaaaaccagagcagagggcgaaugguuaucauucgacguaacagacgcaguacacgaauggcuacaucacaaagaccgaaaucucggauucaaaauaucacuacacugcccaugcugcacauucgucccaucaaacaacuauauaauaccaaauaaaucagaagaacuugaagcaagauuugcuggaauagacggaacaaguacauacaccucuggagaccaaaaaacuauaaaaucaacaagaaaaaaaaacucuggcaaaacaccucaccuacuauuaaugcuacuacccucauacagacuagaaucacaacaaacaaaccgaagaaaaaaaagagcacuagacgcagcauacuguuucagaaacguacaagauaacugcugccucagaccacuauauauagacuucaaaagagaccuaggauggaaauggauacaugaaccaaaaggcuacaacgccaacuucugcgcaggagcaugcccauacuuauggucaucugacacacagcacucaagaguacuaucacuauacaacacaauaaauccagaagcuucagcaagucccugcugcguaucacaagacuuagaacccuuaacuauauuauauuauaucggaaaaacaccaaaaauagaacaacuaucaaacaugauaguaaaaucauguaaauguaguuaa

SEQ ID NO: 1367 - RNA, 1239 nt, Artificial Sequence
  derived and/or modified CDS sequence (opt13) from Homo sapiens__NP_003230.1__HsTGFB3
augaaaaugcaccuccaaagagcccucgucguucucgcacuacuaaacuucgcaaccguaucacuaucccuaucaacaugcacaacccuagacuucggacacauaaaaaaaaaaagaguagaagcaauccgaggccaaauuuuaucaaaacuaagacuaacaucaccaccagaacccacagucaugacacacguaccauaccaaguccuagcacuauacaacucaacacgagaacuauuagaagaaaugcacggagaaagagaagaaggauguacacaagaaaacacugaaagugaauacuaugcaaaagaaauacacaaauucgauaugauacaaggacuagcagaacacaacgaacuagcaguaugcccaaaaggaauaacaucaaaaguauuucgauucaacguaucaucaguagagaaaaaucgaacaaaccuauuuagagccgaauuuagaguccuaagaguccccaauccaucaucaaaaagaaacgaacaacgcauagaacuauuucaaauacuacgcccagacgaacacauagcaaaacaaagauacauagguggaaaaaaccucccaaccagaggaacagccgaauggcuaucauucgacguaacagacaccgucagagaauggcuacuccgcagagaaucaaacuuaggucuagaaauaucaauacacugcccaugccauacauuucaaccaaauggagacauauuagaaaacauacaugaaguaauggaaaucaaauucaaaggaguagacaacgaagacgaccacggacgaggcgaccucggcagacuaaaaaaacaaaaagaucaccacaauccacaccuaauccuaaugaugauacccccccacagacuagacaacccaggacaaggaggacaacgaaaaaaaagagcacucgacacaaauuauuguuuccgaaaucuagaagaaaacugcugcguccguccacuuuacauagacuucagacaagaccuaggauggaaauggguucacgaaccaaaaggauauuaugccaacuucugcucaggacccugcccauacuuaagaucagcagacacaacacacucuacaguacuaggacuauacaacacacuaaacccagaagccucagcaucacccugcugugucccacaagaccuagaaccuuuaaccauacuauacuacguaggaagaacuccuaaaguagaacaacuuucaaauaugguaguaaaaucaugcaaaugcucauaa

SEQ ID NO: 1368 - RNA, 1386 nt, Artificial Sequence
  derived and/or modified CDS sequence (opt13) from Homo sapiens__NP_001057.1__HsTNFRSF1B
auggcaccaguagcaguaugggcagcacuugcaguaggacucgaauuaugggcagcagcacaugcauuaccugcacaaguugcauucacacccuacgcacccgaaccaggcucaaccuguagauuaagagaauauuacgaucaaacagcucaaaugugcuguucuaaaugcucaccuggccaacaugcaaaaguauuuugcacuaaaacaucugauaccguaugugauucuugugaagacucaacauauacacaacuauggaacuggguuccagaaugucuaucaugcggaucaagauguucaucagaccaaguugaaacacaagcauguacucgugaacaaaaucgaauuugcacauguagaccaggaugguauugcgcuuuaucgaaacaagaaggauguagacuaugcgcaccucuuagaaaaugcagaccaggcuuuggagucgcucgacccggaacugaaacaucagacguaguaugcaaaccuugugcaccagguacauucucuaacacaacaaguucaacagauauuuguagaccacaccaaauauguaacguaguugcuauaccaggaaacgcaucuauggaugcaguauguacaucuacgucaccuaccagaucaauggcaccaggagcaguucacuuaccacaaccaguaucaacaagaagucaacacacacaaccaacaccugaacccucaacugcaccaagcacuucauuucuacuaccaaugggucccucaccaccugcugaaggaucaacaggagacuucgcauuaccugucggacuuaucguaggaguuacagcauuaggacuauuaauaaucgguguaguaaauuguguuauuaugacacaaguaaaaaaaaaacccuuauguuuacaaagagaagccaaaguaccucauuuaccagcagauaaagccagaggaacccaagguccagaacaacaacauuuauuaaucacagcucccucaucaucaucaucaucuuuagaaucaucagcaagugcucuagauagaagagcucccacaagaaaccaaccucaagcaccaggugucgaagcaucaggagcuggugaagcucgugcuucuacgggaucuucagauucaucacccggaggacacggaacacaaguaaauguaacaugcauaguaaaugucuguuccaguucggaucauucaucacaauguucaucacaagcaucaucuacuaugggagauacagauaguucaccaucagaauccccaaaagacgaacaaguaccauuuucaaaagaagaaugcgcauuuagaucacaauuagaaacaccagaaacauuauuaggaucaacugaagaaaaaccacuaccacuaggcguaccagaugcaggaaugaaacccucauaa

SEQ ID NO: 1369 - RNA, 513 nt, Artificial Sequence
  derived and/or modified CDS sequence (opt13) from Homo sapiens__NP_002623.2__HsPGF
augccaguaaugagauuauuuccauguuucuuacaauuauuagcaggauuagcauuaccagcaguaccaccacaacaaugggcguuaucagcaggaaauggaaguagugaaguagaaguaguaccauuucaagaaguauggggaagaucauauuguagagcacuagaaagacuaguagauguaguaagugaauauccaagcgaaguagaacauauguuuucaccaucauguguaaguuuauuaagauguacgggaugcuguggagaugaaaauuuacauuguguaccaguagaaacagcaaauguaacaaugcaauuauuaaaaauaagaaguggagauagaccaucauauguagaauuaacauuuagccaacauguaagaugugaauguagaccauuaagagaaaaaaugaaaccagaaagaagaagaccaaaaggaagaggaaaaagaagaagagaaaaacaaagaccaacagauugucauuuauguggagaugcaguaccaagaagauaa

SEQ ID NO: 1370 - RNA, 1239 nt, Artificial Sequence
  derived and/or modified CDS sequence (opt13) from Homo sapiens__NP_001020537.2__HsVEGFA
augacagauagacaaacagauacagcgccaaguccaucauaccauuuauuaccaggaagaagaagaacaguagaugcagcagcgaguagaggacaaggaccagagccagcaccaggaggaggaguagaaggaguuggagcaagaggaguagcgcuaaaauuauuuguacaacuauuaggaugcaguagauucgguggagcaguaguaagagcuggagaagcagaaccauccggugcagccagaagcgcaaguaguggaagagaagaaccacaaccagaagaaggagaagaagaagaagaaaaagaagaggaaagaggaccacaauggagacuuggcgcuagaaaaccugggagcuggacaggagaagcagcuguaugcgcagauagugcaccagcagcaagagcaccacaagcauuagcaagagcaucaggacgaggaggaagaguagcaagaaggggagccgaagaaaguggaccuccacauaguccaaguagaagaggaucagcaaguagagcugggccaggaagggcaucugaaacaaugaauuuuuuauuaaguuggguacauuggaguuuagcuuuauugcuauauuuacaucacgcaaaauggagucaagcagcaccaauggcagaaggagggggacaaaaucaucacgaaguaguaaaauuuauggauguuuaucaaaggaguuauugucauccuauagaaacguuaguagauauauuucaagaauacccagaugaaauagaguauauauuuaaaccgaguuguguaccauuaaugagauguggaggauguuguaaugacgaaggacuagaauguguaccaacagaagaaagcaauauaacuaugcagauaaugagaauaaaaccucaucaaggacaacauauaggagaaaugaguuuuuugcaacacaauaagugcgaauguagaccaaaaaaagaucgagcaagacaagaaaaaaaaagcguaagagguaaagguaaaggacaaaaaagaaaaagaaaaaaaaguagauauaaaagcuggaguguauacguaggggcaagauguuguuugaugccauggagccucccaggaccucauccguguggaccauguucagagagaagaaaacaucuguuuguacaagauccacaaacauguaaaugcaguugcaaaaauacggauucaagauguaaagcgagacaauuagaauuaaaugaaaggacauguagaugcgauaagccgagaagauaa

SEQ ID NO: 1371 - RNA, 699 nt, Artificial Sequence
  derived and/or modified CDS sequence (opt13) from Homo sapiens__NP_001165094.1__HsVEGFA
augaacuucuuacuaucauggguacauuggagcuuagcacuauuacuauaccuacaccacgcaaaauggucacaagcagcaccaauggcagaaggaggaggacaaaaccaccaugaaguaguaaaauucauggauguauaccaaagaucauacugccacccaauagaaacacuaguagacauauuccaagaauacccagacgaaauagaauacauauucaaaccaucauguguaccauuaaugagaugcggaggaugcugcaacgacgaaggacuagaauguguaccaacagaagaaaguaacauaacaaugcaaauaaugagaauaaaaccacaucaaggacaacacauaggagaaaugagcuuccuacaacacaauaaaugcgaaugcagaccaaaaaaagacagagcaagacaagaaaaaaaaaguguaagaggaaaaggaaaaggacaaaaaagaaaaagaaaaaaaucaagauacaaaucauggucaguauacguaggagcaagaugcugccuaaugccauggucacuaccaggaccacacccaugcggaccaugcucagaaagaagaaaacaccuauucguacaagacccacaaaccugcaaaugcaguugcaaaaacacagacagcagaugcaaagcaagacaauuagaacuaaacgaaagaacaugcagaugcgauaaaccacgaagauaa

SEQ ID NO: 1372 - RNA, 624 nt, Artificial Sequence
  derived and/or modified CDS sequence (opt13) from Homo sapiens__NP_003368.1__HsVEGFB
augucaccacuauuaagaagauuauuacuagcagcauuacuacaauuagcacccgcacaagcaccuguaucacaaccagaugcaccaggacaucaaagaaaaguaguaucauggauagacguauacacaagagcaacaugucaaccaagagaaguaguaguaccauuaacaguagaacuaaugggaacagucgcaaaacaacuaguaccaucaugcguaacaguacaaagaugcggaggcuguuguccagacgauggauuagaauguguuccaacaggacaacaucaaguaagaaugcaaauacuaaugauaagauacccaucaucucaacuaggagaaauguccuuagaagaacauagucaaugcgaaugcagaccaaaaaaaaaagauucagcaguaaaaccagaccgagcagcaacaccacaucauagaccacaaccacgaucaguaccaggcugggacucagccccaggagcaccaucaccagcagauauaacccaucccacaccugcaccaggaccaucugcacaugcagcaccuucaacaacaucagcauuaacaccaggaccagcagcagcagccgcagacgcagcugcaucaucaguagcaaaaggaggagcauaa

SEQ ID NO: 1373 - RNA, 1260 nt, Artificial Sequence
  derived and/or modified CDS sequence (opt13) from Homo sapiens__NP_005420.1__HsVEGFC
augcaccucuuaggauucuucucaguagcuugcucauuauuagccgccgccuuauuaccaggaccaagagaagcaccagcagcagccgcagcauuugaaucaggauuagacuuaagugaugcugaaccagacgcaggagaagcuacagcauaugccaguaaagacuuagaagaacaauuaagaucaguaaguuccguagacgaauuaaugacaguacucuauccagaauacuggaaaauguauaaaugucaacuaagaaaaggcggauggcaacauaauagggaacaagcaaaucuaaauucaagaacagaagaaacuauaaaauucgcagccgcacacuauaacacggaaauacuaaaaaguauagauaacgaauggagaaaaacacaaugcaugccaagagaaguaugcauagauguaggaaaagaauuuggaguagcaacaaacacauuuuucaaaccaccauguguaagcguauacagauguggcgguugcugcaauagcgaaggauuacaauguaugaacacuagcacuucauacuuaucaaaaacacuauuugaaauuacaguaccauuaagucaaggaccuaaaccaguaacgauaaguuuugcaaaccacacaucauguagauguaugucaaaacuagauguauauagacaaguacacucaauaauaagaagaucacuaccagcaacacuuccacaaugccaagcagcaaauaaaacauguccaacaaacuauauguggaacaaccacauaugcagaugucuagcacaagaagauuucauguuuaguucagacgcaggagacgacagcacagauggauuucaugacauaugcggacccaacaaagaauuagacgaagaaacuugucaaugcguauguagagcaggacuacgaccagcaucauguggaccacauaaagaauuagacagaaacaguugccaaugcguaugcaaaaauaaacuauucccaucacaauguggagcaaaucgagaauuugaugaaaacacaugucaauguguaugcaaaagaacaugcccaagaaaucaaccauuaaauccagguaaaugcgcaugugaauguacagaaucaccacaaaaaugccuauuaaaaggaaagaaauuucaccaucaaacaugcaguuguuauagaagaccauguacaaauagacaaaaagccugugaaccaggauucuccuacucagaagaaguauguagauguguaccaaguuacuggaaaagaccacaaaugucauaa

SEQ ID NO: 1374 - RNA, 1065 nt, Artificial Sequence
  derived and/or modified CDS sequence (opt13) from Homo sapiens__NP_004460.1__HsVEGFD
auguaccgagaauggguaguaguaaacguauucaugaugcuuuacguacaacuaguacaaggaucaucaaaugaacacggaccaguaaaaagaucaagccaaucaacauuagaaagaucagaacaacaaauacgagcagcaucaucacucgaagaacuccuaagaauaacacacuccgaagacuggaaacuauggcgaugcagacuaagauuaaaaucauucacaucaauggauucacgcuccgcaucccacagaucaacaagauuugccgccacauuuuacgacauagaaacauuaaaagucaucgacgaagaauggcaacgaacacaaugcucaccuagagaaacaugcguagaaguagcaucagaacuagguaaauccacaaauaccuuuuuuaaaccaccuugcguaaacguauucagaugcggaggcuguugcaacgaagaaucacuaauuuguaugaacacaucuacauccuacauaucaaaacaacuauucgaaauaucaguaccacuaacaagcguacccgaacuaguccccguaaaaguagcaaaccacacaggaugcaaaugccuaccaacagcaccaagacauccauacuccauaauacgaagaucaauacaaauaccagaagaagacagaugcucacacucaaaaaaacuaugcccuauagauaugcuaugggacagcaacaaaugcaaaugcguacuacaagaagaaaacccucuagcaggaaccgaagaccacagccaucuacaagaaccagcauuaugcgguccacauaugauguucgacgaagacagaugcgaaugcguaugcaaaacaccaugccccaaagaccuuauacaacacccuaaaaacuguagcugcuuugaaugcaaagaaucacuagaaacaugcugccaaaaacacaaauuauuucacccagacacaugcucaugcgaagacagaugcccauuccacaccagaccaugcgcauccgguaaaacagcaugugcaaaacacugcagauuccccaaagaaaaaagagcagcccaaggaccacacucaagaaaaaauccauaa

SEQ ID NO: 1375 - RNA, 847 nt, Artificial Sequence
  mRNA product Design1 comprising derived and/or modified sequence from Homo sapiens__NP_061986.1__HsFGF21 (wt)
gggagaaagcuuaccauggacucggacgagaccggguucgagcacucaggacuguggguuucugugcuggcuggucuucugcugggagccugccaggcacaccccaucccugacuccaguccucuccugcaauucgggggccaaguccggcagcgguaccucuacacagaugaugcccagcagacagaagcccaccuggagaucagggaggaugggacgguggggggcgcugcugaccagagccccgaaagucuccugcagcugaaagccuugaagccgggaguuauucaaaucuugggagucaagacauccagguuccugugccagcggccagauggggcccuguauggaucgcuccacuuugacccugaggccugcagcuuccgggagcugcuucuugaggacggauacaauguuuaccaguccgaagcccacggccucccgcugcaccugccagggaacaaguccccacaccgggacccugcaccccgaggaccagcucgcuuccugccacuaccaggccugccccccgcacucccggagccacccggaauccuggccccccagccccccgaugugggcuccucggacccucugagcauggugggaccuucccagggccgaagccccagcuacgcuuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1376 - RNA, 847 nt, Artificial Sequence
  mRNA product Design1 comprising derived and/or modified sequence from Homo sapiens__NP_061986.1__HsFGF21 (wt)
gggagaaagcuuaccauggacucggacgagaccggguucgagcacucaggacuguggguuucugugcuggcuggucuucugcugggagccugccaggcacaccccaucccugacuccaguccucuccugcaauucgggggccaaguccggcagcgguaccucuacacagaugaugcccagcagacagaagcccaccuggagaucagggaggaugggacgguggggggcgcugcugaccagagccccgaaagucuccugcagcugaaagccuugaagccgggaguuauucaaaucuugggagucaagacauccagguuccugugccagcggccagauggggcccuguauggaucgcuccacuuugacccugaggccugcagcuuccgggagcugcuucuugaggacggauacaauguuuaccaguccgaagcccacggccucccgcugcaccucccagggaacaaguccccacaccgggacccugcaccccgaggaccagcucgcuuccugccacuaccaggccugccccccgcacucccggagccacccggaauccuggccccccagccccccgaugugggcuccucggacccucugagcauggugggaccuucccagggccgaagccccagcuacgcuuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1377 - RNA, 1627 nt, Artificial Sequence
  mRNA product Design1 comprising derived and/or modified sequence from Homo sapiens__NP_002412.1__HsMMP1 (wt)
gggagaaagcuuaccaugcacagcuuuccuccacugcugcugcugcuguucugggguguggugucucacagcuucccagcgacucuagaaacacaagagcaagauguggacuuaguccagaaauaccuggaaaaauacuacaaccugaagaaugaugggaggcaaguugaaaagcggagaaauaguggcccagugguugaaaaauugaagcaaaugcaggaauucuuugggcugaaagugacugggaaaccagaugcugaaacccugaaggugaugaagcagcccagauguggagugccugauguggcucaguuuguccucacugaggggaacccucgcugggagcaaacacaucugaccuacaggauugaaaauuacacgccagauuugccaagagcagauguggaccaugccauugagaaagccuuccaacucuggaguaaugucacaccucugacauucaccaaggucucugagggucaagcagacaucaugauaucuuuugucaggggagaucaucgggacaacucuccuuuugauggaccuggaggaaaucuugcucaugcuuuucaaccaggcccagguauuggaggggaugcucauuuugaugaagaugaaagguggaccaacaauuucagagaguacaacuuacaucguguugcagcucaugaacucggccauucucuuggacucucccauucuacugauaucggggcuuugauguacccuagcuacaccuucaguggugauguucagcuagcucaggaugacauugauggcauccaagccauauauggacguucccaaaauccuguccagcccaucggcccacaaaccccaaaagcgugugacaguaagcuaaccuuugaugcuauaacuacgauucggggagaagugauguucuuuaaagacagauucuacaugcgcacaaaucccuucuacccggaaguugagcucaauuucauuucuguuuucuggccacaacugccaaaugggcuugaagcugcuuacgaauuugccgacagagaugaaguccgguuuuucaaagggaauaaguacugggcuguucagggacagaaugugcuacacggauaccccaaggacaucuacagcuccuuuggcuucccuagaacugugaagcauaucgaugcugcucuuucugaggaaaacacuggaaaaaccuacuucuuuguugcuaacaaauacuggagguaugaugaauauaaacgaucuauggauccagguuaucccaaaaugauagcacaugacuuuccuggaauuggccacaaaguugaugcaguuuucaugaaagauggauuuuucuauuucuuucauggaacaagacaauacaaauuugauccuaaaacgaagagaauuuugacucuccagaaagcuaauagcugguucaacugcaggaaaaauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1378 - RNA, 1627 nt, Artificial Sequence
  mRNA product Design1 comprising derived and/or modified sequence from Homo sapiens__NP_002412.1__HsMMP1 (wt)
gggagaaagcuuaccaugcacagcuuuccuccacugcugcugcugcuguucugggguguggugucucacagcuucccagcgacucuagaaacacaagagcaagauguggacuuaguccagaaauaccuggaaaaauacuacaaccugaagaaugaugggaggcaaguugaaaagcggagaaauaguggcccagugguugaaaaauugaagcaaaugcaggaguucuuugggcugaaagugacugggaaaccagaugcugaaacccugaaggugaugaagcagcccagauguggagugccugauguggcucaguuuguccucacugaggggaacccucgcugggagcaaacacaucugaccuacaggauugaaaauuacacgccagauuugccaagagcagauguggaccaugccauugagaaagccuuccaacucuggaguaaugucacaccucugacauucaccaaggucucugagggucaagcagacaucaugauaucuuuugucaggggagaucaucgggacaacucuccuuuugauggaccuggaggaaaucuugcucaugcuuuucaaccaggcccagguauuggaggggaugcucauuuugaugaagaugaaagguggaccaacaauuucagagaguacaacuuacaucguguugcagcucaugaacucggccauucucuuggacucucccauucuacugauaucggggcuuugauguacccuagcuacaccuucaguggugauguucagcuagcucaggaugacauugauggcauccaagccauauauggacguucccaaaauccuguccagcccaucggcccacaaaccccaaaagcgugugacaguaagcuaaccuuugaugcuauaacuacgauucggggagaagugauguucuuuaaagacagauucuacaugcgcacaaaucccuucuacccggaaguugagcucaauuucauuucuguuuucuggccacaacugccaaaugggcuugaagcugcuuacgaauuugccgacagagaugaaguccgguuuuucaaagggaauaaguacugggcuguucagggacagaaugugcuacacggauaccccaaggacaucuacagcuccuuuggcuucccuagaacugugaagcauaucgaugcugcucuuucugaggaaaacacuggaaaaaccuacuucuuuguugcuaacaaauacuggagguaugaugaauauaaacgaucuauggauccagguuaucccaaaaugauagcacaugacuuuccuggaauuggccacaaaguugaugcaguuuucaugaaagauggauuuuucuauuucuuucauggaacaagacaauacaaauuugauccuaaaacgaagagaauuuugacucuccagaaagcuaauagcugguucaacugcaggaaaaauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1379 - RNA, 1387 nt, Artificial Sequence
  mRNA product Design1 comprising derived and/or modified sequence from Homo sapiens__NP_002412.1__HsMMP1(1-19,100-469) (wt)
gggagaaagcuuaccaugcacagcuuuccuccacugcugcugcugcuguucugggguguggugucucacagcuuuguccucacugaggggaacccucgcugggagcaaacacaucugaccuacaggauugaaaauuacacgccagauuugccaagagcagauguggaccaugccauugagaaagccuuccaacucuggaguaaugucacaccucugacauucaccaaggucucugagggucaagcagacaucaugauaucuuuugucaggggagaucaucgggacaacucuccuuuugauggaccuggaggaaaucuugcucaugcuuuucaaccaggcccagguauuggaggggaugcucauuuugaugaagaugaaagguggaccaacaauuucagagaguacaacuuacaucguguugcagcucaugaacucggccauucucuuggacucucccauucuacugauaucggggcuuugauguacccuagcuacaccuucaguggugauguucagcuagcucaggaugacauugauggcauccaagccauauauggacguucccaaaauccuguccagcccaucggcccacaaaccccaaaagcgugugacaguaagcuaaccuuugaugcuauaacuacgauucggggagaagugauguucuuuaaagacagauucuacaugcgcacaaaucccuucuacccggaaguugagcucaauuucauuucuguuuucuggccacaacugccaaaugggcuugaagcugcuuacgaauuugccgacagagaugaaguccgguuuuucaaagggaauaaguacugggcuguucagggacagaaugugcuacacggauaccccaaggacaucuacagcuccuuuggcuucccuagaacugugaagcauaucgaugcugcucuuucugaggaaaacacuggaaaaaccuacuucuuuguugcuaacaaauacuggagguaugaugaauauaaacgaucuauggauccagguuaucccaaaaugauagcacaugacuuuccuggaauuggccacaaaguugaugcaguuuucaugaaagauggauuuuucuauuucuuucauggaacaagacaauacaaauuugauccuaaaacgaagagaauuuugacucuccagaaagcuaauagcugguucaacugcaggaaaaauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1380 - RNA, 3574 nt, Artificial Sequence
  mRNA product Design1 comprising derived and/or modified sequence from Clostridium histolyticum__BAA77453.1__ColG (wt)
gggagaaagcuuaccaugaaaaaaaauauuuuaaagauucuuauggauaguuauucuaaagaaucuaaaauucaaacuguacguaggguuacgaguguaucacuuuuagcgguauaucuuacuaugaauacuucaaguuuaguuuuagcaaaaccaauagaaaauacuaaugauacuaguauaaaaaauguggagaaauuaagaaaugcuccaaaugaagagaauaguaaaaagguagaagauaguaaaaaugauaagguagaacaugugaaaaauauagaagaggcaaagguugagcaaguugcacccgaaguaaaaucuaaaucaacuuuaagaagugcuucuauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaauucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcuuuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaauucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacuaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacuaguagaggcaaaaauucaguacaugcuuacaaaaaagcaggaacauauaauguuacauuaaaaguaacugacgauaagggugcaacagcuacagaaagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1381 - RNA, 3574 nt, Artificial Sequence
  mRNA product Design1 comprising derived and/or modified sequence from Clostridium histolyticum__BAA77453.1__ColG (wt)
gggagaaagcuuaccaugaaaaaaaauauuuuaaagauucuuauggauaguuauucuaaagaaucuaaaauucaaacuguacguaggguuacgaguguaucacuuuuagcgguauaucuuacuaugaauacuucaaguuuaguuuuagcaaaaccaauagaaaauacuaaugauacaaguauaaaaaauguggagaaauuaagaaaugcuccaaaugaagagaauaguaaaaagguagaagauaguaaaaaugauaagguagaacaugugaaaaauauagaagaggcaaagguugagcaaguugcacccgaaguaaaaucuaaaucaacuuuaagaagugcuucuauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaguucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcauuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaguucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacaaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacaaguagaggcaaaaauucaguacaugcuuacaaaaaagcaggaacauauaauguuacauuaaaaguaacugacgauaagggugcaacagcuacagagagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1382 - RNA, 3298 nt, Artificial Sequence
  mRNA product Design1 comprising derived and/or modified sequence from Clostridium histolyticum__BAA77453.1__HsALB(1-18)_ColG(111-1118) (wt)
gggagaaagcuuaccaugaaguggguaaccuuuauuucccuucuuuuucucuuuagcucggcuuauuccauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaauucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcuuuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaauucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacuaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacuaguagaggcaaaaauucaguacaugcuuacaaaaaagcaggaacauauaauguuacauuaaaaguaacugacgauaagggugcaacagcuacagaaagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1383 - RNA, 3298 nt, Artificial Sequence
  mRNA product Design1 comprising derived and/or modified sequence from Clostridium histolyticum__BAA77453.1__HsALB(1-18)_ColG(111-1118) (wt)
gggagaaagcuuaccaugaaguggguaaccuuuauuucccuucuuuuucucuuuagcucggcuuauuccauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaguucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcauuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaguucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacaaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacaaguagaggcaaaaauucaguacaugcuuacaaaaaagcaggaacauauaauguuacauuaaaaguaacugacgauaagggugcaacagcuacagagagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1384 - RNA, 3646 nt, Artificial Sequence
  mRNA product Design1 comprising derived and/or modified sequence from Clostridium histolyticum__BAA77453.1__HsALB(1-18)_ColG(1-110)_CS-F_ColG(111-1 118) (wt)
gggagaaagcuuaccaugaaguggguaaccuuuauuucccuucuuuuucucuuuagcucggcuuauuccaugaaaaaaaauauuuuaaagauucuuauggauaguuauucuaaagaaucuaaaauucaaacuguacguaggguuacgaguguaucacuuuuagcgguauaucuuacuaugaauacuucaaguuuaguuuuagcaaaaccaauagaaaauacuaaugauacuaguauaaaaaauguggagaaauuaagaaaugcuccaaaugaagagaauaguaaaaagguagaagauaguaaaaaugauaagguagaacaugugaaaaauauagaagaggcaaagguugagcaaguugcacccgaaguaaaaucuaaaucaacuuuaagaagugcuucuagaaggcggcgcaagagaauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaauucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcuuuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaauucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacuaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacuaguagaggcaaaaauucaguacaugcuuacaaaaaagcaggaacauauaauguuacauuaaaaguaacugacgauaagggugcaacagcuacagaaagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1385 - RNA, 3646 nt, Artificial Sequence
  mRNA product Design1 comprising derived and/or modified sequence from Clostridium histolyticum__BAA77453.1__HsALB(1-18)_ColG(1-110)_CS-F_ColG(111-1 118) (wt)
gggagaaagcuuaccaugaaguggguaaccuuuauuucccuucuuuuucucuuuagcucggcuuauuccaugaaaaaaaauauuuuaaagauucuuauggauaguuauucuaaagaaucuaaaauucaaacuguacguaggguuacgaguguaucacuuuuagcgguauaucuuacuaugaauacuucaaguuuaguuuuagcaaaaccaauagaaaauacuaaugauacaaguauaaaaaauguggagaaauuaagaaaugcuccaaaugaagagaauaguaaaaagguagaagauaguaaaaaugauaagguagaacaugugaaaaauauagaagaggcaaagguugagcaaguugcacccgaaguaaaaucuaaaucaacuuuaagaagugcuucuagaaggcggcgcaagagaauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaguucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcauuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaguucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacaaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacaaguagaggcaaaaauucaguacaugcuuacaaaaaagcaggaacauauaauguuacauuaaaaguaacugacgauaagggugcaacagcuacagagagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1386 - RNA, 3322 nt, Artificial Sequence
  mRNA product Design1 comprising derived and/or modified sequence from Clostridium histolyticum__BAA34542.1__ColH (wt)
gggagaaagcuuaccaugaauuuuuuaaaaauuauuuuaaauagggggaagacuaugaaaaggaaauguuuaucuaaaaggcuuauguuagcuauaacaauggcuacaauauuuacagugaacaguacauuaccaauuuaugcagcuguagauaaaaauaaugcaacagcagcuguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcuuucagacacuguacauucuaaauauggugcuaguuuugaauucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1387 - RNA, 3322 nt, Artificial Sequence
  mRNA product Design1 comprising derived and/or modified sequence from Clostridium histolyticum__BAA34542.1__ColH (wt)
gggagaaagcuuaccaugaauuuuuuaaaaauuauuuuaaauagggggaagacuaugaaaaggaaauguuuaucuaaaaggcuuauguuagcuauaacaauggcuacaauauuuacagugaacaguacauuaccaauuuaugcagcuguagauaaaaauaaugcaacagcagcuguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcugucagacacuguacauucuaaauauggugcuaguuuugaguucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1388 - RNA, 3283 nt, Artificial Sequence
  mRNA product Design1 comprising derived and/or modified sequence from Clostridium histolyticum__BAA34542.1__ColH (wt)
gggagaaagcuuaccaugaaaaggaaauguuuaucuaaaaggcuuauguuagcuauaacaauggcuacaauauuuacagugaacaguacauuaccaauuuaugcagcuguagauaaaaauaaugcaacagcagcuguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcuuucagacacuguacauucuaaauauggugcuaguuuugaauucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1389 - RNA, 3283 nt, Artificial Sequence
  mRNA product Design1 comprising derived and/or modified sequence from Clostridium histolyticum__BAA34542.1__ColH (wt)
gggagaaagcuuaccaugaaaaggaaauguuuaucuaaaaggcuuauguuagcuauaacaauggcuacaauauuuacagugaacaguacauuaccaauuuaugcagcuguagauaaaaauaaugcaacagcagcuguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcugucagacacuguacauucuaaauauggugcuaguuuugaguucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1390 - RNA, 3217 nt, Artificial Sequence
  mRNA product Design1 comprising derived and/or modified sequence from Clostridium histolyticum__BAA34542.1__HsALB(1-18)_ColH(41-1021) (wt)
gggagaaagcuuaccaugaaguggguaaccuuuauuucccuucuuuuucucuuuagcucggcuuauuccguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcuuucagacacuguacauucuaaauauggugcuaguuuugaauucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1391 - RNA, 3217 nt, Artificial Sequence
  mRNA product Design1 comprising derived and/or modified sequence from Clostridium histolyticum__BAA34542.1__HsALB(1-18)_ColH(41-1021) (wt)
gggagaaagcuuaccaugaaguggguaaccuuuauuucccuucuuuuucucuuuagcucggcuuauuccguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcugucagacacuguacauucuaaauauggugcuaguuuugaguucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1392 - RNA, 3355 nt, Artificial Sequence
  mRNA product Design1 comprising derived and/or modified sequence from Clostridium histolyticum__BAA34542.1__HsALB(1-18)_ColH(1-40)_CS-F_ColH(41-102 1) (wt)
gggagaaagcuuaccaugaaguggguaaccuuuauuucccuucuuuuucucuuuagcucggcuuauuccaugaaaaggaaauguuuaucuaaaaggcuuauguuagcuauaacaauggcuacaauauuuacagugaacaguacauuaccaauuuaugcagcuguagauaaaaauaaugcaacagcagcuagaaggcggcgcaagagaguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcuuucagacacuguacauucuaaauauggugcuaguuuugaauucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1393 - RNA, 3355 nt, Artificial Sequence
  mRNA product Design1 comprising derived and/or modified sequence from Clostridium histolyticum__BAA34542.1__HsALB(1-18)_ColH(1-40)_CS-F_ColH(41-102 1) (wt)
gggagaaagcuuaccaugaaguggguaaccuuuauuucccuucuuuuucucuuuagcucggcuuauuccaugaaaaggaaauguuuaucuaaaaggcuuauguuagcuauaacaauggcuacaauauuuacagugaacaguacauuaccaauuuaugcagcuguagauaaaaauaaugcaacagcagcuagaaggcggcgcaagagaguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcugucagacacuguacauucuaaauauggugcuaguuuugaguucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1394 - RNA, 793 nt, Artificial Sequence
  mRNA product Design1 comprising derived and/or modified sequence from Homo sapiens__NP_001133.1__HsAMELX (wt)
gggagaaagcuuaccauggggaccuggauuuuauuugccugccuccugggagcagcuuuugccaugccucuaccaccucauccugggcacccugguuauaucaacuucagcuaugaggugcuuaccccuuugaagugguaccagagcauaaggccaccguacccuuccuaugguuacgagcccauggguggauggcugcaccaccaaaucauccccgugcugucccaacagcaccccccgacucacacccugcagccucaucaccacaucccaguggugccagcucagcagcccgugaucccccagcaaccaaugaugcccguuccuggccaacacuccaugacuccaauccaacaccaccagccaaaccucccuccgcccgcccagcagcccuaccagccccagccuguucagccacagccucaccagcccaugcagccccagccaccugugcaccccaugcagccccugccgccacagccaccucugccuccgauguuccccaugcagccccugccucccaugcuuccugaucugacucuggaagcuuggccaucaacagacaagaccaagcgggaggaaguggauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1395 - RNA, 793 nt, Artificial Sequence
  mRNA product Design1 comprising derived and/or modified sequence from Homo sapiens__NP_001133.1__HsAMELX (wt)
gggagaaagcuuaccauggggaccuggauuuuauuugccugccuccugggagcagcuuuugccaugccucuaccaccucauccugggcacccugguuauaucaacuucagcuaugaggugcuuaccccuuugaagugguaccagagcauaaggccaccguacccuuccuaugguuacgagcccauggguggauggcugcaccaccaaaucauccccgugcugucccaacagcaccccccgacucacacccugcagccucaucaccacaucccaguggugccagcucagcagcccgugaucccccagcaaccaaugaugcccguuccuggccaacacuccaugacuccaauccaacaccaccagccaaaccucccuccgcccgcccagcagcccuaccagccccagccuguucagccacagccucaccagcccaugcagccccagccaccugugcaccccaugcagccccugccgccacagccaccucugccuccgauguuccccaugcagccccugccucccaugcuuccugaucugacucuggaagcauggccaucaacagacaagaccaagcgggaggaaguggauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1396 - RNA, 352 nt, Artificial Sequence
  mRNA product Design1 comprising derived and/or modified sequence from Homo sapiens__NP_001133.1__HsAMELX-TRAP (wt)
gggagaaagcuuaccaugccucuaccaccucauccugggcacccugguuauaucaacuucagcuaugaggugcuuaccccuuugaagugguaccagagcauaaggccaccguacccuuccuaugguuacgagcccauggguggaugguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1397 - RNA, 385 nt, Artificial Sequence
  mRNA product Design1 comprising derived and/or modified sequence from Homo sapiens__NP_001133.1__HsAMELX-LRAP (wt)
gggagaaagcuuaccaugccucuaccaccucauccugggcacccugguuauaucaacuucagcuaugaggugcuuaccccuuugaagugguaccagagcauaaggccaccucccaugcuuccugaucugacucuggaagcuuggccaucaacagacaagaccaagcgggaggaaguggauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1398 - RNA, 385 nt, Artificial Sequence
  mRNA product Design1 comprising derived and/or modified sequence from Homo sapiens__NP_001133.1__HsAMELX-LRAP (wt)
gggagaaagcuuaccaugccucuaccaccucauccugggcacccugguuauaucaacuucagcuaugaggugcuuaccccuuugaagugguaccagagcauaaggccaccucccaugcuuccugaucugacucuggaagcauggccaucaacagacaagaccaagcgggaggaaguggauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1399 - RNA, 424 nt, Artificial Sequence
  mRNA product Design1 comprising derived and/or modified sequence from Homo sapiens__NP_001133.1__HLA-A2-SP_HsAMELX(17-60) (wt)
gggagaaagcuuaccauggccgucauggcgccccgaacccucguccugcuacucucgggggcucuggcccugacccagaccugggcgaugccucuaccaccucauccugggcacccugguuauaucaacuucagcuaugaggugcuuaccccuuugaagugguaccagagcauaaggccaccguacccuuccuaugguuacgagcccauggguggaugguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1400 - RNA, 457 nt, Artificial Sequence
  mRNA product Design1 comprising derived and/or modified sequence from Homo sapiens__NP_001133.1__HLA-A2-SP_HsAMELX(17-47,168-191) (wt)
gggagaaagcuuaccauggccgucauggcgccccgaacccucguccugcuacucucgggggcucuggcccugacccagaccugggcgaugccucuaccaccucauccugggcacccugguuauaucaacuucagcuaugaggugcuuaccccuuugaagugguaccagagcauaaggccaccucccaugcuuccugaucugacucuggaagcauggccaucaacagacaagaccaagcgggaggaaguggauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1401 - RNA, 796 nt, Artificial Sequence
  mRNA product Design1 comprising derived and/or modified sequence from Homo sapiens__NP_001134.1__HsAMELY (wt)
gggagaaagcuuaccauggggaccuggauuuuguuugccugccuugugggagcagcuuuugccaugccucuaccaccucauccugggcacccugguuauaucaacuucagcuaugaggugcucaccccuuugaagugguaccagagcaugauaagaccaccauacucuuccuaugguuacgagcccauggguggauggcugcaccaccaaaucauccccguggugucccaacagcacccccugacucacacccugcagucucaucaccacaucccaguggugccagcucagcagcccaggguccgccagcaagcacugaugccuguuccuggccagcaauccaugacuccaacccaacaccaucagccaaaccucccucugccugcccagcagcccuuccagccccagccuguucagccacagccucaccagcccaugcagccccagccaccugugcaacccaugcagccccugcugccacagccaccucugccuccaauguucccccugcggccccugccccccauacuuccugaucugcaucuggaagcuuggccagcaacagacaagaccaagcaggaggaaguggauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1402 - RNA, 796 nt, Artificial Sequence
  mRNA product Design1 comprising derived and/or modified sequence from Homo sapiens__NP_001134.1__HsAMELY (wt)
gggagaaagcuuaccauggggaccuggauuuuguuugccugccuugugggagcagcuuuugccaugccucuaccaccucauccugggcacccugguuauaucaacuucagcuaugaggugcucaccccuuugaagugguaccagagcaugauaagaccaccauacucuuccuaugguuacgagcccauggguggauggcugcaccaccaaaucauccccguggugucccaacagcacccccugacucacacccugcagucucaucaccacaucccaguggugccagcucagcagcccaggguccgccagcaagcacugaugccuguuccuggccagcaauccaugacuccaacccaacaccaucagccaaaccucccucugccugcccagcagcccuuccagccccagccuguucagccacagccucaccagcccaugcagccccagccaccugugcaacccaugcagccccugcugccacagccaccucugccuccaauguucccccugcggccccugccccccauacuuccugaucugcaucuggaagcauggccagcaacagacaagaccaagcaggaggaaguggauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1403 - RNA, 355 nt, Artificial Sequence
  mRNA product Design1 comprising derived and/or modified sequence from Homo sapiens__NP_001134.1__HsAMELY-TRAP (wt)
gggagaaagcuuaccaugccucuaccaccucauccugggcacccugguuauaucaacuucagcuaugaggugcucaccccuuugaagugguaccagagcaugauaagaccaccauacucuuccuaugguuacgagcccauggguggaugguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1404 - RNA, 388 nt, Artificial Sequence
  mRNA product Design1 comprising derived and/or modified sequence from Homo sapiens__NP_001134.1__HsAMELY-LRAP (wt)
gggagaaagcuuaccaugccucuaccaccucauccugggcacccugguuauaucaacuucagcuaugaggugcucaccccuuugaagugguaccagagcaugauaagaccaccccccauacuuccugaucugcaucuggaagcuuggccagcaacagacaagaccaagcaggaggaaguggauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1405 - RNA, 388 nt, Artificial Sequence
  mRNA product Design1 comprising derived and/or modified sequence from Homo sapiens__NP_001134.1__HsAMELY-LRAP (wt)
gggagaaagcuuaccaugccucuaccaccucauccugggcacccugguuauaucaacuucagcuaugaggugcucaccccuuugaagugguaccagagcaugauaagaccaccccccauacuuccugaucugcaucuggaagcauggccagcaacagacaagaccaagcaggaggaaguggauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1406 - RNA, 427 nt, Artificial Sequence
  mRNA product Design1 comprising derived and/or modified sequence from Homo sapiens__NP_001134.1__HLA-A2-SP_HsAMELY(17-61) (wt)
gggagaaagcuuaccauggccgucauggcgccccgaacccucguccugcuacucucgggggcucuggcccugacccagaccugggcgaugccucuaccaccucauccugggcacccugguuauaucaacuucagcuaugaggugcucaccccuuugaagugguaccagagcaugauaagaccaccauacucuuccuaugguuacgagcccauggguggaugguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1407 - RNA, 460 nt, Artificial Sequence
  mRNA product Design1 comprising derived and/or modified sequence from Homo sapiens__NP_001134.1__HLA-A2-SP_HsAMELY(17-48,169-192) (wt)
gggagaaagcuuaccauggccgucauggcgccccgaacccucguccugcuacucucgggggcucuggcccugacccagaccugggcgaugccucuaccaccucauccugggcacccugguuauaucaacuucagcuaugaggugcucaccccuuugaagugguaccagagcaugauaagaccaccccccauacuuccugaucugcaucuggaagcauggccagcaacagacaagaccaagcaggaggaaguggauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1408 - RNA, 787 nt, Artificial Sequence
  mRNA product Design1 comprising derived and/or modified sequence from Sus scrofa__NP_999071.1__SsAMELX-001-1 (wt)
gggagaaagcuuaccauggggaccuggauuuuguuugcuugccuccugggagcagccuucucuaugccucuaccaccucauccugggcacccugguuauaucaacuucagcuaugaggugcuuaccccucugaagugguaccagaacaugauaagacauccguacacuuccuauggguacgaacccauggguggauggcugcaccaccaaaucauacccguggugucgcagcagacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcuuggccagcaacagacaagaccaagcgggaggaaguggauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1409 - RNA, 787 nt, Artificial Sequence
  mRNA product Design1 comprising derived and/or modified sequence from Sus scrofa__NP_999071.1__SsAMELX-001-1 (wt)
gggagaaagcuuaccauggggaccuggauuuuguuugcuugccuccugggagcagccuucucuaugccucuaccaccucauccugggcacccugguuauaucaacuucagcuaugaggugcuuaccccucugaagugguaccagaacaugauaagacauccguacacuuccuauggguacgaacccauggguggauggcugcaccaccaaaucauacccguggugucgcagcagacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcauggccagcaacagacaagaccaagcgggaggaaguggauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1410 - RNA, 355 nt, Artificial Sequence
  mRNA product Design1 comprising derived and/or modified sequence from Sus scrofa__NP_999071.1__SsAMELX-TRAP (wt)
gggagaaagcuuaccaugccucuaccaccucauccugggcacccugguuauaucaacuucagcuaugaggugcuuaccccucugaagugguaccagaacaugauaagacauccguacacuuccuauggguacgaacccauggguggaugguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1411 - RNA, 388 nt, Artificial Sequence
  mRNA product Design1 comprising derived and/or modified sequence from Sus scrofa__NP_999071.1__SsAMELX-LRAP (wt)
gggagaaagcuuaccaugccucuaccaccucauccugggcacccugguuauaucaacuucagcuaugaggugcuuaccccucugaagugguaccagaacaugauaagacauccgucucugcuuccugaccugccucuggaagcuuggccagcaacagacaagaccaagcgggaggaaguggauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1412 - RNA, 388 nt, Artificial Sequence
  mRNA product Design1 comprising derived and/or modified sequence from Sus scrofa__NP_999071.1__SsAMELX-LRAP (wt)
gggagaaagcuuaccaugccucuaccaccucauccugggcacccugguuauaucaacuucagcuaugaggugcuuaccccucugaagugguaccagaacaugauaagacauccgucucugcuuccugaccugccucuggaagcauggccagcaacagacaagaccaagcgggaggaaguggauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1413 - RNA, 427 nt, Artificial Sequence
  mRNA product Design1 comprising derived and/or modified sequence from Sus scrofa__NP_999071.1__HLA-A2-SP_SsAMEL(17-61) (wt)
gggagaaagcuuaccauggccgucauggcgccccgaacccucguccugcuacucucgggggcucuggcccugacccagaccugggcgaugccucuaccaccucauccugggcacccugguuauaucaacuucagcuaugaggugcuuaccccucugaagugguaccagaacaugauaagacauccguacacuuccuauggguacgaacccauggguggaugguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1414 - RNA, 460 nt, Artificial Sequence
  mRNA product Design1 comprising derived and/or modified sequence from Sus scrofa__NP_999071.1__HLA-A2-SP_SsAMEL(17-49,167-189) (wt)
gggagaaagcuuaccauggccgucauggcgccccgaacccucguccugcuacucucgggggcucuggcccugacccagaccugggcgaugccucuaccaccucauccugggcacccugguuauaucaacuucagcuaugaggugcuuaccccucugaagugguaccagaacaugauaagacauccgucucugcuuccugaccugccucuggaagcauggccagcaacagacaagaccaagcgggaggaaguggauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1415 - RNA, 751 nt, Artificial Sequence
  mRNA product Design1 comprising derived and/or modified sequence from Sus scrofa__P45561-2__SsAMELX-001-2 (wt)
gggagaaagcuuaccauggggaccuggauuuuguuugcuugccuccugggagcagccuucucuaugccucuaccaccucauccugggcacccugguuauaucaacuucagcuauauaagacauccguacacuuccuauggguacgaacccauggguggauggcugcaccaccaaaucauacccguggugucgcagcagacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcuuggccagcaacagacaagaccaagcgggaggaaguggauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1416 - RNA, 787 nt, Artificial Sequence
  mRNA product Design1 comprising derived and/or modified sequence from Sus scrofa__NP_998965.1__SsAMELX-001-3 (wt)
gggagaaagcuuaccauggggaccuggauuuucuuugccugccuuuugggagcaucccuugcuaugccucuaccaccucauccugggcacccugguuauaucaacuucagcuaugaggugcuuaccccucugaagugguaccagaacaugauaagacauccguacacuuccuauggguacgaacccauggguggauggcugcaccaccaaaucauacccguggugucgcagcagacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcuuggccagcaacagacaagaccaagcgggaggaaguggauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1417 - RNA, 436 nt, Artificial Sequence
  mRNA product Design1 comprising derived and/or modified sequence from Sus scrofa__K7GPB2__SsAMELX-002 (wt)
gggagaaagcuuaccauggggaccuggauuuuguuugcuugccuccugggagcagccuucucuaugccucuaccaccucauccugggcacccugguuauaucaacuucagcuaugaggugcuuaccccucugaagugguaccagaacaugauaagacauccgucucugcuuccugaccugccucuggaagcuuggccagcaacagacaagaccaagcgggaggaaguggauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1418 - RNA, 829 nt, Artificial Sequence
  mRNA product Design1 comprising derived and/or modified sequence from Sus scrofa__K7GLD0__SsAMELX-003 (wt)
gggagaaagcuuaccauggggaccuggauuuuguuugcuugccuccugggagcagccuucucuaugccucuaccaccucauccugggcacccugguuauaucaacuucagcuaugaggacuuauacuuggaggcuauccguauugacaggacugcauucgugcuuaccccucugaagugguaccagaacaugauaagacauccguacacuuccuaugguuacgaacccauggguggauggcugcaccaccaaaucauucccguggugucgcagcagacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcuuggccagcaacagacaagaccaagcgggaggaaguggauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1419 - RNA, 715 nt, Artificial Sequence
  mRNA product Design1 comprising derived and/or modified sequence from Sus scrofa__K7GPE9__SsAMELX-004 (wt)
gggagaaagcuuaccauggggaccuggauuuuguuugcuugccuccugggagcagccuucucuaugccucuaccaccucauccugggcacccugguuauaucaacuucagcuaugaggugcuuaccccucugaagugguaccagaacaugauaagacauccgacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcuuggccagcaacagacaagaccaagcgggaggaaguggauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1420 - RNA, 739 nt, Artificial Sequence
  mRNA product Design1 comprising derived and/or modified sequence from Sus scrofa__J9JIM4__SsAMELX-201 (wt)
gggagaaagcuuaccaugccucuaccaccucauccugggcacccugguuauaucaacuucagcuaugaggugcuuaccccucugaagugguaccagaacaugauaagacauccguacacuuccuauggguacgaacccauggguggauggcugcaccaccaaaucauacccguggugucgcagcagacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcuuggccagcaacagacaagaccaagcgggaggaaguggauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1421 - RNA, 3178 nt, Artificial Sequence
  mRNA product Design1 comprising derived and/or modified sequence from Homo sapiens__NP_006120.1__HsBMP1 (wt)
gggagaaagcuuaccaugcccggcguggcccgccugccgcugcugcucgggcugcugcugcucccgcgucccggccggccgcuggacuuggccgacuacaccuaugaccuggcggaggaggacgacucggagccccucaacuacaaagaccccugcaaggcggcugccuuucuuggggacauugcccuggacgaagaggaccugagggccuuccagguacagcaggcuguggaucucagacggcacacagcucguaaguccuccaucaaagcugcaguuccaggaaacacuucuacccccagcugccagagcaccaacgggcagccucagaggggagccugugggagauggagagguagaucccguagccggcgggcggcgacgucccgaccagagcguguguggcccgauggggucauccccuuugucauugggggaaacuucacugguagccagagggcagucuuccggcaggccaugaggcacugggagaagcacaccugugucaccuuccuggagcgcacugacgaggacagcuauauuguguucaccuaucgaccuugcgggugcugcuccuacgugggucgccgcggcgggggcccccaggccaucuccaucggcaagaacugugacaaguucggcauugugguccacgagcugggccacgucgucggcuucuggcacgaacacacucggccagaccgggaccgccacguuuccaucguucgugagaacauccagccagggcaggaguauaacuuccugaagauggagccucaggagguggagucccugggggagaccuaugacuucgacagcaucaugcauuacgcucggaacacauucuccaggggcaucuuccuggauaccauuguccccaaguaugaggugaacggggugaaaccucccauuggccaaaggacacggcucagcaagggggacauugcccaagcccgcaagcuuuacaagugcccagccuguggagagacccugcaagacagcacaggcaacuucuccuccccugaauaccccaauggcuacucugcucacaugcacugcguguggcgcaucucugucacacccggggagaagaucauccugaacuucacgucccuggaccuguaccgcagccgccugugcugguacgacuauguggagguccgagauggcuucuggaggaaggcgccccuccgaggccgcuucugcggguccaaacucccugagccuaucgucuccacugacagccgccucuggguugaauuccgcagcagcagcaauuggguuggaaagggcuucuuugcagucuacgaagccaucugcgggggugaugugaaaaaggacuauggccacauucaaucgcccaacuacccagacgauuaccggcccagcaaagucugcaucuggcggauccaggugucugagggcuuccacgugggccucacauuccaguccuuugagauugagcgccacgacagcugugccuacgacuaucuggaggugcgcgacgggcacagugagagcagcacccucaucgggcgcuacuguggcuaugagaagccugaugacaucaagagcacguccagccgccucuggcucaaguucgucucugacggguccauuaacaaagcgggcuuugccgucaacuuuuucaaagagguggacgagugcucucggcccaaccgcgggggcugugagcagcggugccucaacacccugggcagcuacaagugcagcugugaccccggguacgagcuggccccagacaagcgccgcugugaggcugcuuguggcggauuccucaccaagcucaacggcuccaucaccagcccgggcuggcccaaggaguacccccccaacaagaacugcaucuggcagcugguggcccccacccaguaccgcaucucccugcaguuugacuucuuugagacagagggcaaugaugugugcaaguacgacuucguggaggugcgcaguggacucacagcugacuccaagcugcauggcaaguucugugguucugagaagcccgaggucaucaccucccaguacaacaacaugcgcguggaguucaaguccgacaacaccguguccaaaaagggcuucaaggcccacuucuucucagacaaggacgagugcuccaaggauaacggcggcugccagcaggacugcgucaacacguucggcaguuaugagugccaaugccgcaguggcuucguccuccaugacaacaagcacgacugcaaagaagccggcugugaccacaaggugacauccaccagugguaccaucaccagccccaacuggccugacaaguaucccagcaagaaggagugcacgugggccaucuccagcacccccgggcaccgggucaagcugaccuucauggagauggacaucgagucccagccugagugugccuacgaccaccuagagguguucgacgggcgagacgccaaggcccccguccucggccgcuucugugggagcaagaagcccgagcccguccuggccacaggcagccgcauguuccugcgcuucuacucagauaacucgguccagcgaaagggcuuccaggccucccacgccacagagugcgggggccagguacgggcagacgugaagaccaaggaccuuuacucccacgcccaguuuggcgacaacaacuacccuggggguguggacugugagugggucauuguggccgaggaaggcuacggcguggagcucguguuccagaccuuugagguggaggaggagaccgacugcggcuaugacuacauggagcucuucgacggcuacgacagcacagcccccaggcuggggcgcuacuguggcucagggccuccugaggagguguacucggcgggagauucuguccuggugaaguuccacucggaugacaccaucaccaaaaaagguuuccaccugcgauacaccagcaccaaguuccaggacacacuccacagcaggaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1422 - RNA, 1408 nt, Artificial Sequence
  mRNA product Design1 comprising derived and/or modified sequence from Homo sapiens__NP_001191.1__HsBMP2 (wt)
gggagaaagcuuaccaugguggccgggacccgcugucuucuagcguugcugcuuccccagguccuccugggcggcgcggcuggccucguuccggagcugggccgcaggaaguucgcggcggcgucgucgggccgccccucaucccagcccucugacgagguccugagcgaguucgaguugcggcugcucagcauguucggccugaaacagagacccacccccagcagggacgccguggugccccccuacaugcuagaccuguaucgcaggcacucaggucagccgggcucacccgccccagaccaccgguuggagagggcagccagccgagccaacacugugcgcagcuuccaccaugaagaaucuuuggaagaacuaccagaaacgagugggaaaacaacccggagauucuucuuuaauuuaaguucuauccccacggaggaguuuaucaccucagcagagcuucagguuuuccgagaacagaugcaagaugcuuuaggaaacaauagcaguuuccaucaccgaauuaauauuuaugaaaucauaaaaccugcaacagccaacucgaaauuccccgugaccagacuuuuggacaccagguuggugaaucagaaugcaagcaggugggaaaguuuugaugucacccccgcugugaugcgguggacugcacagggacacgccaaccauggauucgugguggaaguggcccacuuggaggagaaacaaggugucuccaagagacauguuaggauaagcaggucuuugcaccaagaugaacacagcuggucacagauaaggccauugcuaguaacuuuuggccaugauggaaaagggcauccucuccacaaaagagaaaaacgucaagccaaacacaaacagcggaaacgccuuaaguccagcuguaagagacacccuuuguacguggacuucagugacgugggguggaaugacuggauuguggcucccccgggguaucacgccuuuuacugccacggagaaugcccuuuuccucuggcugaucaucugaacuccacuaaucaugccauuguucagacguuggucaacucuguuaacucuaagauuccuaaggcaugcugugucccgacagaacucagugcuaucucgaugcuguaccuugacgagaaugaaaagguuguauuaaagaacuaucaggacaugguuguggaggguugugggugucgcuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1423 - RNA, 1444 nt, Artificial Sequence
  mRNA product Design1 comprising derived and/or modified sequence from Homo sapiens__NP_001193.2__HsBMP4 (wt)
gggagaaagcuuaccaugauuccugguaaccgaaugcugauggucguuuuauuaugccaaguccugcuaggaggcgcgagccaugcuaguuugauaccugagacggggaagaaaaaagucgccgagauucagggccacgcgggaggacgccgcucagggcagagccaugagcuccugcgggacuucgaggcgacacuucugcagauguuugggcugcgccgccgcccgcagccuagcaagagugccgucauuccggacuacaugcgggaucuuuaccggcuucagucuggggaggaggaggaagagcagauccacagcacuggucuugaguauccugagcgcccggccagccgggccaacaccgugaggagcuuccaccacgaagaacaucuggagaacaucccagggaccagugaaaacucugcuuuucguuuccucuuuaaccucagcagcaucccugagaacgaggugaucuccucugcagagcuucggcucuuccgggagcagguggaccagggcccugauugggaaaggggcuuccaccguauaaacauuuaugagguuaugaagcccccagcagaaguggugccugggcaccucaucacacgacuacuggacacgagacugguccaccacaaugugacacggugggaaacuuuugaugugagcccugcgguccuucgcuggacccgggagaagcagccaaacuaugggcuagccauugaggugacucaccuccaucagacucggacccaccagggccagcaugucaggauuagccgaucguuaccucaagggagugggaauugggcccagcuccggccccuccuggucaccuuuggccaugauggccggggccaugccuugacccgacgccggagggccaagcguagcccuaagcaucacucacagcgggccaggaagaagaauaagaacugccggcgccacucgcucuauguggacuucagcgaugugggcuggaaugacuggauuguggccccaccaggcuaccaggccuucuacugccauggggacugccccuuuccacuggcugaccaccucaacucaaccaaccaugccauugugcagacccuggucaauucugucaauuccaguauccccaaagccuguugugugcccacugaacugagugccaucuccaugcuguaccuggaugaguaugauaaggugguacugaaaaauuaucaggagaugguaguagagggaugugggugccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1424 - RNA, 1759 nt, Artificial Sequence
  mRNA product Design1 comprising derived and/or modified sequence from Homo sapiens__NP_001709.1__HsBMP6 (wt)
gggagaaagcuuaccaugccggggcuggggcggagggcgcaguggcugugcugguggugggggcugcugugcagcugcugcgggcccccgccgcugcggccgcccuugcccgcugccgcggccgccgccgccggggggcagcugcugggggacggcgggagccccggccgcacggagcagccgccgccgucgccgcaguccuccucgggcuuccuguaccggcggcucaagacgcaggagaagcgggagaugcagaaggagaucuugucggugcuggggcucccgcaccggccccggccccugcacggccuccaacagccgcagcccccggcgcuccggcagcaggaggagcagcagcagcagcagcagcugccucgcggagagcccccucccgggcgacugaaguccgcgccccucuucaugcuggaucuguacaacgcccuguccgccgacaacgacgaggacggggcgucggagggggagaggcagcaguccuggccccacgaagcagccagcucgucccagcgucggcagccgcccccgggcgccgcgcacccgcucaaccgcaagagccuucuggcccccggaucuggcagcggcggcgcguccccacugaccagcgcgcaggacagcgccuuccucaacgacgcggacauggucaugagcuuugugaaccugguggaguacgacaaggaguucuccccucgucagcgacaccacaaagaguucaaguucaacuuaucccagauuccugagggugagguggugacggcugcagaauuccgcaucuacaaggacuguguuauggggaguuuuaaaaaccaaacuuuucuuaucagcauuuaucaagucuuacaggagcaucagcacagagacucugaccuguuuuuguuggacacccguguaguaugggccucagaagaaggcuggcuggaauuugacaucacggccacuagcaaucuguggguugugacuccacagcauaacauggggcuucagcugagcguggugacaagggauggaguccacguccacccccgagccgcaggccuggugggcagagacggcccuuacgacaagcagcccuucaugguggcuuucuucaaagugagugaggugcacgugcgcaccaccaggucagccuccagccggcgccgacaacagagucguaaucgcucuacccagucccaggacguggcgcgggucuccagugcuucagauuacaacagcagugaauugaaaacagccugcaggaagcaugagcuguaugugaguuuccaagaccugggauggcaggacuggaucauugcacccaagggcuaugcugccaauuacugugauggagaaugcuccuucccacucaacgcacacaugaaugcaaccaaccacgcgauugugcagaccuugguucaccuuaugaaccccgaguauguccccaaaccgugcugugcgccaacuaagcuaaaugccaucucgguucuuuacuuugaugacaacuccaaugucauucugaaaaaauacaggaauaugguuguaagagcuuguggaugccacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1425 - RNA, 1513 nt, Artificial Sequence
  mRNA product Design1 comprising derived and/or modified sequence from Homo sapiens__NP_001710.1__HsBMP7 (wt)
gggagaaagcuuaccaugcacgugcgcucacugcgagcugcggcgccgcacagcuucguggcgcucugggcaccccuguuccugcugcgcuccgcccuggccgacuucagccuggacaacgaggugcacucgagcuucauccaccggcgccuccgcagccaggagcggcgggagaugcagcgcgagauccucuccauuuugggcuugccccaccgcccgcgcccgcaccuccagggcaagcacaacucggcacccauguucaugcuggaccuguacaacgccauggcgguggaggagggcggcgggcccggcggccagggcuucuccuaccccuacaaggccgucuucaguacccagggccccccucuggccagccugcaagauagccauuuccucaccgacgccgacauggucaugagcuucgucaaccucguggaacaugacaaggaauucuuccacccacgcuaccaccaucgagaguuccgguuugaucuuuccaagaucccagaaggggaagcugucacggcagccgaauuccggaucuacaaggacuacauccgggaacgcuucgacaaugagacguuccggaucagcguuuaucaggugcuccaggagcacuugggcagggaaucggaucucuuccugcucgacagccguacccucugggccucggaggagggcuggcugguguuugacaucacagccaccagcaaccacuggguggucaauccgcggcacaaccugggccugcagcucucgguggagacgcuggaugggcagagcaucaaccccaaguuggcgggccugauugggcggcacgggccccagaacaagcagcccuucaugguggcuuucuucaaggccacggagguccacuuccgcagcauccgguccacggggagcaaacagcgcagccagaaccgcuccaagacgcccaagaaccaggaagcccugcggauggccaacguggcagagaacagcagcagcgaccagaggcaggccuguaagaagcacgagcuguaugucagcuuccgagaccugggcuggcaggacuggaucaucgcgccugaaggcuacgccgccuacuacugugagggggagugugccuucccucugaacuccuacaugaacgccaccaaccacgccaucgugcagacgcugguccacuucaucaacccggaaacggugcccaagcccugcugugcgcccacgcagcucaaugccaucuccguccucuacuucgaugacagcuccaacgucauccugaagaaauacagaaacauggugguccgggccuguggcugccacuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1426 - RNA, 517 nt, Artificial Sequence
  mRNA product Design1 comprising derived and/or modified sequence from Homo sapiens__NP_006264.2__HsCCL7 (wt)
gggagaaagcuuaccaugaaagccucugcagcacuucugugucugcugcucacagcagcugcuuucagcccccaggggcuugcucagccaguugggauuaauacuucaacuaccugcugcuacagauuuaucaauaagaaaaucccuaagcagaggcuggagagcuacagaaggaccaccaguagccacuguccccgggaagcuguaaucuucaagaccaaacuggacaaggagaucugugcugaccccacacagaaguggguccaggacuuuaugaagcaccuggacaagaaaacccaaacuccaaagcuuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1427 - RNA, 3841 nt, Artificial Sequence
  mRNA product Design1 comprising derived and/or modified sequence from Homo sapiens__NP_001954.2__HsEGF (wt)
gggagaaagcuuaccaugcugcucacucuuaucauucuguugccaguaguuucaaaauuuaguuuuguuagucucucagcaccgcagcacuggagcuguccugaagguacucucgcaggaaaugggaauucuacuuguguggguccugcacccuucuuaauuuucucccauggaaauaguaucuuuaggauugacacagaaggaaccaauuaugagcaauuggugguggaugcuggugucucagugaucauggauuuucauuauaaugagaaaagaaucuauuggguggauuuagaaagacaacuuuugcaaagaguuuuucugaaugggucaaggcaagagagaguauguaauauagagaaaaauguuucuggaauggcaauaaauuggauaaaugaagaaguuauuuggucaaaucaacaggaaggaaucauuacaguaacagauaugaaaggaaauaauucccacauucuuuuaagugcuuuaaaauauccugcaaauguagcaguugauccaguagaaagguuuauauuuuggucuucagagguggcuggaagccuuuauagagcagaucucgauggugugggagugaaggcucuguuggagacaucagagaaaauaacagcugugucauuggaugugcuugauaagcggcuguuuuggauucaguacaacagagaaggaagcaauucucuuauuugcuccugugauuaugauggagguucuguccacauuaguaaacauccaacacagcauaauuuguuugcaaugucccuuuuuggugaccguaucuucuauucaacauggaaaaugaagacaauuuggauagccaacaaacacacuggaaaggacaugguuagaauuaaccuccauucaucauuuguaccacuuggugaacugaaaguagugcauccacuugcacaacccaaggcagaagaugacacuugggagccugagcagaaacuuugcaaauugaggaaaggaaacugcagcagcacugugugugggcaagaccuccagucacacuugugcaugugugcagagggauacgcccuaagucgagaccggaaguacugugaagauguuaaugaaugugcuuuuuggaaucauggcuguacucuuggguguaaaaacaccccuggauccuauuacugcacgugcccuguaggauuuguucugcuuccugaugggaaacgaugucaucaacuuguuuccuguccacgcaaugugucugaaugcagccaugacuguguucugacaucagaaggucccuuauguuucuguccugaaggcucagugcuugagagagaugggaaaacauguagcgguuguuccucacccgauaaugguggauguagccagcucugcguuccucuuagcccaguauccugggaaugugauugcuuuccuggguaugaccuacaacuggaugaaaaaagcugugcagcuucaggaccacaaccauuuuugcuguuugccaauucucaagauauucgacacaugcauuuugauggaacagacuauggaacucugcucagccagcagaugggaaugguuuaugcccuagaucaugacccuguggaaaauaagauauacuuugcccauacagcccugaaguggauagagagagcuaauauggaugguucccagcgagaaaggcuuauugaggaaggaguagaugugccagaaggucuugcuguggacuggauuggccguagauucuauuggacagacagagggaaaucucugauuggaaggagugauuuaaaugggaaacguuccaaaauaaucacuaaggagaacaucucucaaccacgaggaauugcuguucauccaauggccaagagauuauucuggacugauacagggauuaauccacgaauugaaaguucuucccuccaaggccuuggccgucugguuauagccagcucugaucuaaucuggcccaguggaauaacgauugacuucuuaacugacaaguuguacuggugcgaugccaagcagucugugauugaaauggccaaucuggaugguucaaaacgccgaagacuuacccagaaugauguaggucacccauuugcuguagcaguguuugaggauuaugugugguucucagauugggcuaugccaucaguaaugagaguaaacaagaggacuggcaaagauagaguacgucuccaaggcagcaugcugaagcccucaucacugguugugguucauccauuggcaaaaccaggagcagaucccugcuuauaucaaaacggaggcugugaacauauuugcaaaaagaggcuuggaacugcuugguguucgugucgugaagguuuuaugaaagccucagaugggaaaacgugucuggcucuggauggucaucagcuguuggcagguggugaaguugaucuaaagaaccaaguaacaccauuggacaucuuguccaagacuagagugucagaagauaacauuacagaaucucaacacaugcuaguggcugaaaucauggugucagaucaagaugacugugcuccugugggaugcagcauguaugcucgguguauuucagagggagaggaugccacaugucaguguuugaaaggauuugcuggggauggaaaacuauguucugauauagaugaaugugagaugggugucccagugugccccccugccuccuccaagugcaucaacaccgaaggugguuaugucugccggugcucagaaggcuaccaaggagaugggauucacugucuugauauugaugagugccaacugggggagcacagcuguggagagaaugccagcugcacaaauacagagggaggcuauaccugcaugugugcuggacgccugucugaaccaggacugauuugcccugacucuacuccacccccucaccucagggaagaugaccaccacuauuccguaagaaauagugacucugaauguccccugucccacgauggguacugccuccaugauggugugugcauguauauugaagcauuggacaaguaugcaugcaacuguguuguuggcuacaucggggagcgaugucaguaccgagaccugaaguggugggaacugcgccacgcuggccacgggcagcagcagaaggucaucgugguggcugucugcgugguggugcuugucaugcugcuccuccugagccuguggggggcccacuacuacaggacucagaagcugcuaucgaaaaacccaaagaauccuuaugaggagucgagcagagaugugaggagucgcaggccugcugacacugaggaugggauguccucuugcccucaaccuugguuugugguuauaaaagaacaccaagaccucaagaaugggggucaaccaguggcuggugaggauggccaggcagcagaugggucaaugcaaccaacuucauggaggcaggagccccaguuauguggaaugggcacagagcaaggcugcuggauuccaguauccagugauaagggcuccuguccccagguaauggagcgaagcuuucauaugcccuccuaugggacacagacccuugaagggggugucgagaagccccauucucuccuaucagcuaacccauuauggcaacaaagggcccuggacccaccacaccaaauggagcugacucagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1428 - RNA, 727 nt, Artificial Sequence
  mRNA product Design1 comprising derived and/or modified sequence from Homo sapiens__NP_001423.1__HsEREG (wt)
gggagaaagcuuaccaugaccgcggggaggaggauggagaugcucugugccggcagggucccugcgcugcugcucugccuggguuuccaucuucuacaggcaguccucaguacaacugugauuccaucauguaucccaggagaguccagugauaacugcacagcuuuaguucagacagaagacaauccacguguggcucaagugucaauaacaaaguguagcucugacaugaauggcuauuguuugcauggacagugcaucuaucugguggacaugagucaaaacuacugcaggugugaaguggguuauacugguguccgaugugaacacuucuuuuuaaccguccaccaaccuuuaagcaaagaauauguggcuuugaccgugauucuuauuauuuuguuucuuaucacagucgucgguuccacauauuauuucugcagaugguacagaaaucgaaaaaguaaagaaccaaagaaggaauaugagagaguuaccucaggggauccagaguugccgcaagucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1429 - RNA, 685 nt, Artificial Sequence
  mRNA product Design1 comprising derived and/or modified sequence from Homo sapiens__NP_000791.1__HsFGF1 (wt)
gggagaaagcuuaccauggcugaaggggaaaucaccaccuucacagcccugaccgagaaguuuaaucugccuccagggaauuacaagaagcccaaacuccucuacuguagcaacgggggccacuuccugaggauccuuccggauggcacaguggaugggacaagggacaggagcgaccagcacauucagcugcagcucagugcggaaagcgugggggagguguauauaaagaguaccgagacuggccaguacuuggccauggacaccgacgggcuuuuauacggcucacagacaccaaaugaggaauguuuguuccuggaaaggcuggaggagaaccauuacaacaccuauauauccaagaagcaugcagagaagaauugguuuguuggccucaagaagaaugggagcugcaaacgcgguccucggacucacuauggccagaaagcaaucuuguuucucccccugccagucucuucugauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1430 - RNA, 1084 nt, Artificial Sequence
  mRNA product Design1 comprising derived and/or modified sequence from Homo sapiens__NP_001997.5__HsFGF2 (wt)
gggagaaagcuuaccauggugggugugggggguggagauguagaagaugugacgccgcggcccggcgggugccagauuagcggacgcggugcccgcgguugcaacgggaucccgggcgcugcagcuugggaggcggcucuccccaggcggcguccgcggagacacccauccgugaaccccaggucccgggccgccggcucgccgcgcaccaggggccggcggacagaagagcggccgagcggcucgaggcugggggaccgcgggcgcggccgcgcgcugccgggcgggaggcuggggggccggggccggggccgugccccggagcgggucggaggccggggccggggccgggggacggcggcuccccgcgcggcuccagcggcucggggaucccggccgggccccgcagggaccauggcagccgggagcaucaccacgcugcccgccuugcccgaggauggcggcagcggcgccuucccgcccggccacuucaaggaccccaagcggcuguacugcaaaaacgggggcuucuuccugcgcauccaccccgacggccgaguugacgggguccgggagaagagcgacccucacaucaagcuacaacuucaagcagaagagagaggaguugugucuaucaaaggagugugugcuaaccguuaccuggcuaugaaggaagauggaagauuacuggcuucuaaauguguuacggaugaguguuucuuuuuugaacgauuggaaucuaauaacuacaauacuuaccggucaaggaaauacaccaguugguauguggcacugaaacgaacugggcaguauaaacuuggauccaaaacaggaccugggcagaaagcuauacuuuuucuuccaaugucugcuaagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1431 - RNA, 802 nt, Artificial Sequence
  mRNA product Design1 comprising derived and/or modified sequence from Homo sapiens__NP_002000.1__HsFGF7 (wt)
gggagaaagcuuaccaugcacaaauggauacugacauggauccugccaacuuugcucuacagaucaugcuuucacauuaucugucuaguggguacuauaucuuuagcuugcaaugacaugacuccagagcaaauggcuacaaaugugaacuguuccagcccugagcgacacacaagaaguuaugauuacauggaaggaggggauauaagagugagaagacucuucugucgaacacagugguaccugaggaucgauaaaagaggcaaaguaaaagggacccaagagaugaagaauaauuacaauaucauggaaaucaggacaguggcaguuggaauuguggcaaucaaagggguggaaagugaauucuaucuugcaaugaacaaggaaggaaaacucuaugcaaagaaagaaugcaaugaagauuguaacuucaaagaacuaauucuggaaaaccauuacaacacauaugcaucagcuaaauggacacacaacggaggggaaauguuuguugccuuaaaucaaaaggggauuccuguaagaggaaaaaaaacgaagaaagaacaaaaaacagcccacuuucuuccuauggcaauaacuuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1432 - RNA, 844 nt, Artificial Sequence
  mRNA product Design1 comprising derived and/or modified sequence from Homo sapiens__NP_001936.1__HsHBEGF (wt)
gggagaaagcuuaccaugaagcugcugccgucgguggugcugaagcucuuucuggcugcaguucucucggcacuggugacuggcgagagccuggagcggcuucggagagggcuagcugcuggaaccagcaacccggacccucccacuguauccacggaccagcugcuaccccuaggaggcggccgggaccggaaaguccgugacuugcaagaggcagaucuggaccuuuugagagucacuuuauccuccaagccacaagcacuggccacaccaaacaaggaggagcacgggaaaagaaagaagaaaggcaaggggcuagggaagaagagggacccaugucuucggaaauacaaggacuucugcauccauggagaaugcaaauaugugaaggagcuccgggcucccuccugcaucugccacccggguuaccauggagagaggugucaugggcugagccucccaguggaaaaucgcuuauauaccuaugaccacacaaccauccuggccgugguggcuguggugcugucaucugucugucugcuggucaucguggggcuucucauguuuagguaccauaggagaggagguuaugauguggaaaaugaagagaaagugaaguugggcaugacuaauucccacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1433 - RNA, 2404 nt, Artificial Sequence
  mRNA product Design1 comprising derived and/or modified sequence from Homo sapiens__NP_000592.3__HsHGF (wt)
gggagaaagcuuaccaugugggugaccaaacuccugccagcccugcugcugcagcauguccuccugcaucuccuccugcuccccaucgccauccccuaugcagagggacaaaggaaaagaagaaauacaauucaugaauucaaaaaaucagcaaagacuacccuaaucaaaauagauccagcacugaagauaaaaaccaaaaaagugaauacugcagaccaaugugcuaauagauguacuaggaauaaaggacuuccauucacuugcaaggcuuuuguuuuugauaaagcaagaaaacaaugccucugguuccccuucaauagcaugucaaguggagugaaaaaagaauuuggccaugaauuugaccucuaugaaaacaaagacuacauuagaaacugcaucauugguaaaggacgcagcuacaagggaacaguaucuaucacuaagaguggcaucaaaugucagcccuggaguuccaugauaccacacgaacacagcuuuuugccuucgagcuaucgggguaaagaccuacaggaaaacuacugucgaaauccucgaggggaagaagggggacccugguguuucacaagcaauccagagguacgcuacgaagucugugacauuccucaguguucagaaguugaaugcaugaccugcaauggggagaguuaucgaggucucauggaucauacagaaucaggcaagauuugucagcgcugggaucaucagacaccacaccggcacaaauucuugccugaaagauaucccgacaagggcuuugaugauaauuauugccgcaaucccgauggccagccgaggccauggugcuauacucuugacccucacacccgcugggaguacugugcaauuaaaacaugcgcugacaauacuaugaaugacacugauguuccuuuggaaacaacugaaugcauccaaggucaaggagaaggcuacaggggcacugucaauaccauuuggaauggaauuccaugucagcguugggauucucaguauccucacgagcaugacaugacuccugaaaauuucaagugcaaggaccuacgagaaaauuacugccgaaauccagaugggucugaaucacccugguguuuuaccacugauccaaacauccgaguuggcuacugcucccaaauuccaaacugugauaugucacauggacaagauuguuaucgugggaauggcaaaaauuauaugggcaacuuaucccaaacaagaucuggacuaacauguucaaugugggacaagaacauggaagacuuacaucgucauaucuucugggaaccagaugcaaguaagcugaaugagaauuacugccgaaauccagaugaugaugcucauggacccuggugcuacacgggaaauccacucauuccuugggauuauugcccuauuucucguugugaaggugauaccacaccuacaauagucaauuuagaccaucccguaauaucuugugccaaaacgaaacaauugcgaguuguaaaugggauuccaacacgaacaaacauaggauggaugguuaguuugagauacagaaauaaacauaucugcggaggaucauugauaaaggagaguuggguucuuacugcacgacaguguuucccuucucgagacuugaaagauuaugaagcuuggcuuggaauucaugauguccacggaagaggagaugagaaaugcaaacagguucucaauguuucccagcugguauauggcccugaaggaucagaucugguuuuaaugaagcuugccaggccugcuguccuggaugauuuuguuaguacgauugauuuaccuaauuauggaugcacaauuccugaaaagaccaguugcaguguuuauggcuggggcuacacuggauugaucaacuaugauggccuauuacgaguggcacaucucuauauaaugggaaaugagaaaugcagccagcaucaucgagggaaggugacucugaaugagucugaaauaugugcuggggcugaaaagauuggaucaggaccaugugagggggauuaugguggcccacuuguuugugagcaacauaaaaugagaaugguucuuggugucauuguuccuggucguggaugugccauuccaaaucguccugguauuuuuguccgaguagcauauuaugcaaaauggauacacaaaauuauuuuaacauauaagguaccacagucauagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1434 - RNA, 2143 nt, Artificial Sequence
  mRNA product Design1 comprising derived and/or modified sequence from Homo sapiens__NP_005336.3 __HsHSPA1A (wt)
gggagaaagcuuaccauggccaaagccgcggcgaucggcaucgaccugggcaccaccuacuccugcguggggguguuccaacacggcaagguggagaucaucgccaacgaccagggcaaccgcaccacccccagcuacguggccuucacggacaccgagcggcucaucggggaugcggccaagaaccagguggcgcugaacccgcagaacaccguguuugacgcgaagcggcugauuggccgcaaguucggcgacccgguggugcagucggacaugaagcacuggccuuuccaggugaucaacgacggagacaagcccaaggugcaggugagcuacaagggggagaccaaggcauucuaccccgaggagaucucguccauggugcugaccaagaugaaggagaucgccgaggcguaccugggcuacccggugaccaacgcggugaucaccgugccggccuacuucaacgacucgcagcgccaggccaccaaggaugcgggugugaucgcggggcucaacgugcugcggaucaucaacgagcccacggccgccgccaucgccuacggccuggacagaacgggcaagggggagcgcaacgugcucaucuuugaccugggcgggggcaccuucgacguguccauccugacgaucgacgacggcaucuucgaggugaaggccacggccggggacacccaccuggguggggaggacuuugacaacaggcuggugaaccacuucguggaggaguucaagagaaaacacaagaaggacaucagccagaacaagcgagccgugaggcggcugcgcaccgccugcgagagggccaagaggacccugucguccagcacccaggccagccuggagaucgacucccuguuugagggcaucgacuucuacacguccaucaccagggcgagguucgaggagcugugcuccgaccuguuccgaagcacccuggagcccguggagaaggcucugcgcgacgccaagcuggacaaggcccagauucacgaccugguccuggucgggggcuccacccgcauccccaaggugcagaagcugcugcaggacuucuucaacgggcgcgaccugaacaagagcaucaaccccgacgaggcuguggccuacggggcggcggugcaggcggccauccugaugggggacaaguccgagaacgugcaggaccugcugcugcuggacguggcuccccugucgcuggggcuggagacggccggaggcgugaugacugcccugaucaagcgcaacuccaccauccccaccaagcagacgcagaucuucaccaccuacuccgacaaccaacccggggugcugauccagguguacgagggcgagagggccaugacgaaagacaacaaucuguuggggcgcuucgagcugagcggcaucccuccggcccccaggggcgugccccagaucgaggugaccuucgacaucgaugccaacggcauccugaacgucacggccacggacaagagcaccggcaaggccaacaagaucaccaucaccaacgacaagggccgccugagcaaggaggagaucgagcgcauggugcaggaggcggagaaguacaaagcggaggacgaggugcagcgcgagagggugucagccaagaacgcccuggaguccuacgccuucaacaugaagagcgccguggaggaugaggggcucaagggcaagaucagcgaggcggacaagaagaaggugcuggacaagugucaagaggucaucucguggcuggacgccaacaccuuggccgagaaggacgaguuugagcacaagaggaaggagcuggagcagguguguaaccccaucaucagcggacuguaccagggugccgguggucccgggccugggggcuucggggcucagggucccaagggagggucugggucaggccccaccauugaggagguagauuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1435 - RNA, 2143 nt, Artificial Sequence
  mRNA product Design1 comprising derived and/or modified sequence from Homo sapiens__NP_005337.2 __HsHSPA1B (wt)
gggagaaagcuuaccauggccaaagccgcggcgaucggcaucgaccugggcaccaccuacuccugcguggggguguuccaacacggcaagguggagaucaucgccaacgaccagggcaaccgcaccacccccagcuacguggccuucacggacaccgagcggcucaucggggaugcggccaagaaccagguggcgcugaacccgcagaacaccguguuugacgcgaagcggcugauuggccgcaaguucggcgacccgguggugcagucggacaugaagcacuggccuuuccaggugaucaacgacggagacaagcccaaggugcaggugagcuacaagggggagaccaaggcauucuaccccgaggagaucucguccauggugcugaccaagaugaaggagaucgccgaggcguaccugggcuacccggugaccaacgcggugaucaccgugccggccuacuucaacgacucgcagcgccaggccaccaaggaugcgggugugaucgcggggcucaacgugcugcggaucaucaacgagcccacggccgccgccaucgccuacggccuggacagaacgggcaagggggagcgcaacgugcucaucuuugaccugggcgggggcaccuucgacguguccauccugacgaucgacgacggcaucuucgaggugaaggccacggccggggacacccaccuggguggggaggacuuugacaacaggcuggugaaccacuucguggaggaguucaagagaaaacacaagaaggacaucagccagaacaagcgagccgugaggcggcugcgcaccgccugcgagagggccaagaggacccugucguccagcacccaggccagccuggagaucgacucccuguuugagggcaucgacuucuacacguccaucaccagggcgagguucgaggagcugugcuccgaccuguuccgaagcacccuggagcccguggagaaggcucugcgcgacgccaagcuggacaaggcccagauucacgaccugguccuggucgggggcuccacccgcauccccaaggugcagaagcugcugcaggacuucuucaacgggcgcgaccugaacaagagcaucaaccccgacgaggcuguggccuacggggcggcggugcaggcggccauccugaugggggacaaguccgagaacgugcaggaccugcugcugcuggacguggcuccccugucgcuggggcuggagacggccggaggcgugaugacugcccugaucaagcgcaacuccaccauccccaccaagcagacgcagaucuucaccaccuacuccgacaaccaacccggggugcugauccagguguacgagggcgagagggccaugacgaaagacaacaaucuguuggggcgcuucgagcugagcggcaucccuccggcccccaggggcgugccccagaucgaggugaccuucgacaucgaugccaacggcauccugaacgucacggccacggacaagagcaccggcaaggccaacaagaucaccaucaccaacgacaagggccgccugagcaaggaggagaucgagcgcauggugcaggaggcggagaaguacaaagcggaggacgaggugcagcgcgagagggugucagccaagaacgcccuggaguccuacgccuucaacaugaagagcgccguggaggaugaggggcucaagggcaagaucagcgaggcggacaagaagaagguucuggacaagugucaagaggucaucucguggcuggacgccaacaccuuggccgagaaggacgaguuugagcacaagaggaaggagcuggagcagguguguaaccccaucaucagcggacuguaccagggugccgguggucccgggccuggcggcuucggggcucagggucccaagggagggucugggucaggcccuaccauugaggagguggauuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1436 - RNA, 2143 nt, Artificial Sequence
  mRNA product Design1 comprising derived and/or modified sequence from Homo sapiens__NP_005518.3 __HsHSPA1L (wt)
gggagaaagcuuaccauggcuacugccaagggaaucgccauaggcaucgaccugggcaccaccuacuccuguguggggguguuccagcacggcaagguggagaucaucgccaacgaccagggcaaccgcaccacccccagcuacguggccuucacagacaccgagcggcucauuggggaugcggccaagaaccagguagcaaugaauccccagaacacuguuuuugaugcuaaacgucugaucggcaggaaauuuaaugauccuguuguacaagcagauaugaaacuuuggccuuuucaagugauuaaugaaggaggcaagcccaaaguccuuguguccuacaaaggggagaauaaagcuuucuacccugaggaaaucucuucgaugguauugacuaaguugaaggagacugcugaggccuuuuugggccacccugucaccaaugcagugauuaccgugccagccuauuucaaugacucucaacgucaggcuacuaaggaugcaggugugauugcuggacuuaaugugcuaagaaucaucaaugagcccacggcugcugccauugccuaugguuuagauaaaggaggucaaggagaacgacauguccugauuuuugaucuggguggaggcacauuugaugugucaauucugaccauagaugaugggauuuuugagguaaaggccacugcuggggacacucaccuggguggggaggacuuugacaacaggcuugugagccacuucguggaggaguucaagaggaaacacaaaaaggacaucagccagaacaagcgagccgugaggcggcugcgcaccgccugcgagagggccaagaggacccugucguccagcacccaggccaaccuagaaauugauucacuuuaugaaggcauugacuucuauacauccaucaccagagcucgauuugaagaguugugugcagaccuguuuagggguacccuggagccuguagaaaaagcgcuucgggaugccaagauggauaaggcuaaaauccaugacauuguuuuaguagggggcuccacccgcauccccaaggugcagcggcugcuucaggacuacuucaauggacgugaucucaacaagagcaucaacccugaugaggccguagcauauggggcugcgguacaagcagccauccugaugggggacaagucugagaagguacaggaccugcugcugcuggacguggcuccccugucccuggggcuggagacggcugggggcgugaugacugcccugauaaagcgcaacuccaccauccccaccaagcagacacagauuuucaccaccuacucugacaaccaacccggggugcugauccagguguaugagggcgagagggccaugacaaaggacaacaaccugcuggggcgguuugaccugacuggaaucccuccagcacccaggggaguuccucagaucgaggugacguuugacauugaugccaaugguauucucaaugucacagccacggacaagagcaccggcaaggugaacaagaucaccaucaccaaugacaagggccgccugagcaaggaggagauugagcgcaugguucuggaugcugagaaauauaaagcugaagaugagguccagagggagaaaauugcugcaaagaaugccuuagaauccuaugcuuuuaacaugaagaguguugugagugaugaagguuugaagggcaagauuagugagucugauaaaaauaaaauauuggauaaaugcaacgagcuccuuucguggcuggaggucaaucaacuggcagagaaagaugaguuugaucauaagagaaaggaauuggagcagauguguaacccuaucaucacaaaacucuaccaaggaggaugcacugggccugccugcggaacaggguaugugccuggaaggccugccacaggccccacaauugaagaaguagauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1437 - RNA, 2137 nt, Artificial Sequence
  mRNA product Design1 comprising derived and/or modified sequence from Homo sapiens__NP_068814.2 __HsHSPA2 (wt)
gggagaaagcuuaccaugucugcccguggcccggcuaucggcaucgaccugggcaccaccuauucgugcgucggggucuuccaacauggcaagguggagaucaucgccaacgaccagggcaaucgcaccacccccagcuacguggccuucacggacaccgagcgccucaucggcgacgccgccaagaaccagguggccaugaaccccaccaacaccaucuucgacgccaagaggcugauuggacggaaauucgaggaugccacagugcagucggauaugaaacacuggccguuccggguggugagcgagggaggcaagcccaaagugcaaguagaguacaagggggagaccaagaccuucuucccagaggagauauccuccaugguccucacgaagaugaaggagaucgcggaagccuaccuggggggcaaggugcacagcgcggucauaacggucccggccuauuucaacgacucgcagcgccaggccaccaaggacgcaggcaccaucacggggcucaaugugcugcgcaucaucaacgagcccacggcggcggccaucgccuacggccuggacaagaagggcugcgcgggcggcgagaagaacgugcucaucuuugaccugggcgguggcacuuucgacguguccauccugaccaucgaggauggcaucuucgaggugaaguccacggccggcgacacccaccugggcggugaggacuucgacaaccgcauggugagccaccuggcggaggaguucaagcgcaagcacaagaaggacauugggcccaacaagcgcgccgugaggcggcugcgcaccgcuugcgagcgcgccaagcgcacccugagcucguccacgcaggcgagcaucgagaucgacucgcucuacgagggcguggacuucuauacguccaucacgcgcgcccgcuucgaggagcucaaugccgaccucuuucgcgggacccuggagccgguggagaaggcgcugcgcgacgccaagcuggacaagggccagauccaggagaucgugcuggugggcggcuccacucguauccccaagauccagaagcugcugcaggauuucuucaacggcaaggagcugaacaagagcaucaaccccgacgaggcgguggccuauggcgccgcggugcaggcggccauccucaucggcgacaaaucagagaaugugcaggaccugcugcuacucgacgugaccccguugucgcugggcaucgagacagcuggcggugucaugaccccacucaucaagaggaacaccacgauccccaccaagcagacgcagaccuucaccaccuacucggacaaccagagcagcguacuggugcagguauacgagggcgaacgggccaugaccaaggacaauaaccugcugggcaaguucgaccugaccgggauucccccugcgccucgcggggucccccaaaucgagguuaccuucgacauugacgccaauggcauccuuaacguuaccgccgccgacaagagcaccgguaaggaaaacaaaaucaccaucaccaaugacaaaggucgucugagcaaggacgacauugaccggauggugcaggaggcggagcgguacaaaucggaagaugaggcgaaucgcgaccgagucgcggccaaaaacgcccuggaguccuauaccuacaacaucaagcagacgguggaagacgagaaacugaggggcaagauuagcgagcaggacaaaaacaagauccucgacaagugucaggaggugaucaacuggcucgaccgaaaccagauggcagagaaagaugaguaugaacacaagcagaaagagcucgaaagaguuugcaaccccaucaucagcaaacuuuaccaaggugguccuggcggcggcagcggcggcggcgguucaggagccuccgggggacccaccaucgaagaaguggacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1438 - RNA, 2740 nt, Artificial Sequence
  mRNA product Design1 comprising derived and/or modified sequence from Homo sapiens__NP_002145.3 __HsHSPA4 (wt)
gggagaaagcuuaccaugucgguggugggcauagaccugggcuuccagagcugcuacgucgcuguggcccgcgccggcggcaucgagacuaucgcuaaugaguauagcgaccgcugcacgccggcuugcauuucuuuugguccuaagaaucguucaauuggagcagcagcuaaaagccagguaauuucuaaugcaaagaacacaguccaaggauuuaaaagauuccauggccgagcauucucugauccauuuguggaggcagaaaaaucuaaccuugcauaugauauugugcaguugccuacaggauuaacagguauaaaggugacauauauggaggaagagcgaaauuuuaccacugagcaagugacugccaugcuuuuguccaaacugaaggagacagccgaaaguguucuuaagaagccuguaguugacuguguuguuucgguuccuuguuucuauacugaugcagaaagacgaucagugauggaugcaacacagauugcuggucuuaauugcuugcgauuaaugaaugaaaccacugcaguugcucuugcauauggaaucuauaagcaggaucuuccugccuuagaagagaaaccaagaaauguaguuuuuguagacaugggccacucugcuuaucaaguuucuguaugugcauuuaauagaggaaaacugaaaguucuggccacugcauuugacacgacauugggagguagaaaauuugaugaaguguuaguaaaucacuucugugaagaauuugggaagaaauacaagcuagacauuaaguccaaaauccgugcauuauuacgacucucucaggagugugagaaacucaagaaauugaugagugcaaaugcuucagaucucccuuugagcauugaauguuuuaugaaugauguugauguaucuggaacuaugaauagaggcaaauuucuggagaugugcaaugaucucuuagcuagaguggagccaccacuucguaguguuuuggaacaaaccaaguuaaagaaagaagauauuuaugcaguggagauaguugguggugcuacacgaaucccugcgguaaaagagaagaucagcaaauuuuucgguaaagaacuuaguacaacauuaaaugcugaugaagcugucacucgaggcugugcauugcagugugccaucuuaucgccugcuuucaaagucagagaauuuucuaucacugauguaguaccauauccaauaucucugagauggaauucuccagcugaagaagggucaagugacugugaagucuuuuccaaaaaucaugcugcuccuuucucuaaaguucuuacauuuuauagaaaggaaccuuucacucuugaggccuacuacagcucuccucaggauuugcccuauccagauccugcuauagcucaguuuucaguucagaaagucacuccucagucugauggcuccaguucaaaagugaaagucaaaguucgaguaaauguccauggcauuuucaguguguccagugcaucuuuaguggagguucacaagucugaggaaaaugaggagccaauggaaacagaucagaaugcaaaggaggaagagaagaugcaaguggaccaggaggaaccacauguugaagagcaacagcagcagacaccagcagaaaauaaggcagagucugaagaaauggagaccucucaagcuggauccaaggauaaaaagauggaccaaccaccccaagccaagaaggcaaaagugaagaccaguacuguggaccugccaaucgagaaucagcuauuauggcagauagacagagagaugcucaacuuguacauugaaaaugaggguaagaugaucaugcaggauaaacuggagaaggagcggaaugaugcuaagaacgcaguggaggaauauguguaugaaaugagagacaagcuuaguggugaauaugagaaguuugugagugaagaugaucguaacaguuuuacuuugaaacuggaagauacugaaaauugguuguaugaggauggagaagaccagccaaagcaaguuuauguugauaaguuggcugaauuaaaaaaucuaggucaaccuauuaagauacguuuccaggaaucugaagaacgaccaaaauuauuugaagaacuagggaaacagauccaacaguauaugaaaauaaucagcucuuucaaaaacaaggaggaccaguaugaucauuuggaugcugcugacaugacaaagguagaaaaaagcacaaaugaagcaauggaguggaugaauaacaagcuaaaucugcagaacaagcagaguuugaccauggauccaguugucaagucaaaagagauugaagcuaaaauuaaggagcugacaaguacuuguagcccuauaauuucaaagcccaaacccaaaguggaaccuccaaaagaggaacaaaaaaaugcagagcagaauggaccaguggauggacaaggagacaacccaggcccccaggcugcugagcaggguacagacacagcugugccuucggauucagacaagaagcuuccugaaauggacauugauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1439 - RNA, 2737 nt, Artificial Sequence
  mRNA product Design1 comprising derived and/or modified sequence from Homo sapiens__NP_055093.2 __HsHSPA4L (wt)
gggagaaagcuuaccaugucugugguuggcauugaccucggcuuucucaacugcuacauugcugucgcgagaaguggcggcaucgagaccaucgccaaugaguacagcgacagguguaccccggccuguauaucauugggaucaagaacucgagccauuggaaaugcagcaaagagccagauagucacgaacguaagaaauacaauucauggcuucaaaaagcuucaugggcgaucauuugaugaucccauugugcaaacugaaaggaucaggcuucccuaugaacugcagaaaaugccuaauggaagugcaggaguuaaggugcgguacuuagaggaagagagaccuuuugcaauugagcaaguuacuggaaugcuguuagccaagcuuaaagagacuucagaaaaugcuuugaagaaaccaguggcugacugugugauuucaauuccuagcuuuuuuacugaugccgagagaagaucugugauggcugcagcccagguugcaggcuuaaauuguuuaagguugaugaaugaaacuacugcaguugcacuggcguauggaauuuauaaacaggaucuucccccauuagaugagaaaccaagaaauguaguauuuauugauaugggacauucugccuaucaggucuugguuugugcuuuuaacaaaggaaaacuuaaagucuuggcuacuaccuuugauccauauuuggguggcaggaacuuugaugaggcuuuaguagacuacuucugugaugaguucaagaccaaauauaagauaaaugugaaagaaaacucucgggccuuguugcguuuauaucaggaaugugaaaaacuaaagaagcuaaugagugcaaaugcaucagaucuuccauugaacauugaguguuucaugaaugaccuugauguuucuaguaaaaugaacagggcucaauuugaacaacugugugcuucccuuuuggccaggguugaaccaccuuuaaaagcaguaauggaacaagcuaacuuacaacgugaagacauuaguaguauagaaauuguaggaggagcaacacgaauuccugcagugaaagaacaaaucacuaaauucuuucuuaaagacauaaguaccacauuaaaugcugaugaagcuguugcaagaggaugugcguuacagugugcgauucucucaccagcauuuaaagugcgugaauuuuccauaacagaccuuguucccuauucaaucacauuaagguggaagaccucuuuugaagauggaaguggggaaugugaaguuuucuguaagaaccauccugccccauucucaaaagucauuacuuuccacaagaaggaaccauuugaacuagaagcauuuuauacuaauuuacaugaagugccuuauccugaugcaagaauugggagcuucacuauucagaauguuuuuccacagucugauggugauaguuccaaagugaagguuaaaguucguguuaacauccauggaaucuucaguguggcuagcgcaucaguaauugagaagcaaaauuuggaaggcgaucacagugaugcuccaauggagacagaaacuucauuuaaaaaugaaaacaaagauaauauggauaaaaugcagguugaucaagaagaagggcaucaaaaaugucaugcugaacacacuccagaagaggaaauugaucauacaggagccaaaacaaagucagcugucucagacaaacaagaccgauuaaaucagacacuuaaaaaaggaaaagucaaaaguauugaucuaccgauccagaguagccuauguagacaacuaggccaagaucuucucaacagcuacauugaaaaugaggggaagaugaucaugcaagauaaguuagagaaagaaagaaaugaugcuaagaaugccguugaagaauauguauaugauuuuagagacaggcugggcacugucuaugaaaaauucaucacuccagaagacuugaguaaacugucugcaguauuggaagacacagaaaauuggcuuuaugaagacggagaggaccaaccuaaacaaguuuauguggauaagcuucaagaacuaaagaaauacggccagccuauucaaaugaaguacauggagcaugaagagagaccaaaagccuuaaaugacuugggaaaaaagauccaacuugucaugaaagugauagaagcuuauagaaacaaggaugaaagauaugaucaucuggauccuacugaaauggaaaagguugaaaaauguaucagugaugccaugaguuggcugaauaguaagaugaaugcacagaacaaacuaagucucacucaagauccugugguaaaaguuucagaaauaguagcaaagucaaaggaacuggauaauuucuguaaccccaucauuuacaagcccaaaccaaaagcagaaguuccugaagacaaaccaaaagcuaauagugaacacaauggcccaauggauggacagaguggaacugaaacuaaaucagauucaacaaaagacagcucacagcauacuaaauccucuggagagauggaaguggacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1440 - RNA, 2182 nt, Artificial Sequence
  mRNA product Design1 comprising derived and/or modified sequence from Homo sapiens__NP_005338.1__HsHSPA5 (wt)
gggagaaagcuuaccaugaagcucucccugguggccgcgaugcugcugcugcucagcgcggcgcgggccgaggaggaggacaagaaggaggacgugggcacgguggucggcaucgaccuggggaccaccuacuccugcgucggcguguucaagaacggccgcguggagaucaucgccaacgaucagggcaaccgcaucacgccguccuaugucgccuucacuccugaaggggaacgucugauuggcgaugccgccaagaaccagcucaccuccaaccccgagaacacggucuuugacgccaagcggcucaucggccgcacguggaaugacccgucugugcagcaggacaucaaguucuugccguucaaggugguugaaaagaaaacuaaaccauacauucaaguugauauuggaggugggcaaacaaagacauuugcuccugaagaaauuucugccaugguucucacuaaaaugaaagaaaccgcugaggcuuauuugggaaagaagguuacccaugcaguuguuacuguaccagccuauuuuaaugaugcccaacgccaagcaaccaaagacgcuggaacuauugcuggccuaaauguuaugaggaucaucaacgagccuacggcagcugcuauugcuuauggccuggauaagagggagggggagaagaacauccugguguuugaccuggguggcggaaccuucgaugugucucuucucaccauugacaauggugucuucgaaguuguggccacuaauggagauacucaucuggguggagaagacuuugaccagcgugucauggaacacuucaucaaacuguacaaaaagaagacgggcaaagaugucaggaaagacaauagagcugugcagaaacuccggcgcgagguagaaaaggccaaacgggcccugucuucucagcaucaagcaagaauugaaauugaguccuucuaugaaggagaagacuuuucugagacccugacucgggccaaauuugaagagcucaacauggaucuguuccggucuacuaugaagcccguccagaaaguguuggaagauucugauuugaagaagucugauauugaugaaauuguucuuguugguggcucgacucgaauuccaaagauucagcaacugguuaaagaguucuucaauggcaaggaaccaucccguggcauaaacccagaugaagcuguagcguauggugcugcuguccaggcuggugugcucucuggugaucaagauacaggugaccugguacugcuugauguauguccccuuacacuugguauugaaacugugggaggugucaugaccaaacugauuccaaggaacacaguggugccuaccaagaagucucagaucuuuucuacagcuucugauaaucaaccaacuguuacaaucaaggucuaugaaggugaaagaccccugacaaaagacaaucaucuucuggguacauuugaucugacuggaauuccuccugcuccucguggggucccacagauugaagucaccuuugagauagaugugaaugguauucuucgagugacagcugaagacaaggguacagggaacaaaaauaagaucacaaucaccaaugaccagaaucgccugacaccugaagaaaucgaaaggaugguuaaugaugcugagaaguuugcugaggaagacaaaaagcucaaggagcgcauugauacuagaaaugaguuggaaagcuaugccuauucucuaaagaaucagauuggagauaaagaaaagcugggagguaaacuuuccucugaagauaaggagaccauggaaaaagcuguagaagaaaagauugaauggcuggaaagccaccaagaugcugacauugaagacuucaaagcuaagaagaaggaacuggaagaaauuguucaaccaauuaucagcaaacucuauggaagugcaggcccucccccaacuggugaagaggauacagcagaaaaagaugaguuguagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1441 - RNA, 2149 nt, Artificial Sequence
  mRNA product Design1 comprising derived and/or modified sequence from Homo sapiens__NP_002146.2__HsHSPA6 (wt)
gggagaaagcuuaccaugcaggccccacgggagcucgcggugggcaucgaccugggcaccaccuacucgugcgugggcguguuucagcagggccgcguggagauccuggccaacgaccagggcaaccgcaccacgcccagcuacguggccuucaccgacaccgagcggcuggucggggacgcggccaagagccaggcggcccugaacccccacaacaccguguucgaugccaagcggcugaucgggcgcaaguucgcggacaccacggugcagucggacaugaagcacuggcccuuccggguggugagcgagggcggcaagcccaaggugcgcguaugcuaccgcggggaggacaagacguucuaccccgaggagaucucguccauggugcugagcaagaugaaggagacggccgaggcguaccugggccagcccgugaagcacgcagugaucaccgugcccgccuauuucaaugacucgcagcgccaggccaccaaggacgcgggggccaucgcggggcucaacguguugcggaucaucaaugagcccacggcagcugccaucgccuaugggcuggaccggcggggcgcgggagagcgcaacgugcucauuuuugaccugggugggggcaccuucgaugugucgguucucuccauugacgcuggugucuuugaggugaaagccacugcuggagauacccaccugggaggagaggacuucgacaaccggcucgugaaccacuucauggaagaauuccggcggaagcaugggaaggaccugagcgggaacaagcgugcccugcgcaggcugcgcacagccugugagcgcgccaagcgcacccuguccuccagcacccaggccacccuggagauagacucccuguucgagggcguggacuucuacacguccaucacucgugcccgcuuugaggaacugugcucagaccucuuccgcagcacccuggagccgguggagaaggcccugcgggaugccaagcuggacaaggcccagauucaugacgucguccugguggggggcuccacacgcauccccaaggugcagaaguugcugcaggacuucuucaacggcaaggagcugaacaagagcaucaacccugaugaggcuguggccuauggggcugcugugcaggcggccguguugaugggggacaaaugugagaaagugcaggaucuccugcugcuggauguggcuccccugucucuggggcuggagacagcagguggggugaugaccacgcugauccagaggaacgccacuauccccaccaagcagacccagacuuucaccaccuacucggacaaccagccuggggucuucauccagguguaugagggugagagggccaugaccaaggacaacaaccugcuggggcguuuugaacucaguggcaucccuccugccccacguggagucccccagauagaggugacuuuugacauugaugcuaauggcauccugagcgugacagccacugacaggagcacagguaaggcuaacaagaucaccaucaccaaugacaagggccggcugagcaaggaggagguggagaggaugguucaugaagccgagcaguacaaggcugaggaugaggcccagagggacagaguggcugccaaaaacucgcuggaggcccaugucuuccaugugaaagguucuuugcaagaggaaagccuuagggacaagauucccgaagaggacaggcgcaaaaugcaagacaagugucgggaaguccuugccuggcuggagcacaaccagcuggcagagaaggaggaguaugagcaucagaagagggagcuggagcaaaucugucgccccaucuucuccaggcucuauggggggccuggugucccugggggcagcaguuguggcacucaagcccgccagggggaccccagcaccggccccaucauugaggagguugauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1442 - RNA, 1321 nt, Artificial Sequence
  mRNA product Design1 comprising derived and/or modified sequence from Homo sapiens__P48741__HsHSPA7 (wt)
gggagaaagcuuaccaugcaggccccacgggagcucgcggugggcaucgaccugggcaccaccuacucgugcgugggcguguuucagcagggccgcguggagauccuggccaacgaccagggcaaccgcaccacgcccagcuacguggccuucaccgacaccgagcggcuggucggggacgcggccaagagccaggcggcccugaacccccacaacaccguguucgaugccaagcggcugaucgggcgcaaguucgcggacaccacggugcagucggacaugaagcacuggcccuuccagguggugagcgagggcggcaagcccaaggugcgcguaugcuaccgcggggaggacaagacguucuaccccgaggagaucucguccauggugcugagcaagaugaaggagacggccgaggcguaccugggccagcccgugaagcacgcagugaucaccgugcccaccuauuucaguaacucgcagcgccaggccaccaaggacgcgggggccaucgcggggcucaaggugcugccgaucaucaaugaggccacggcagcagccaucgccuaugggcuggaccggcggggcgcgggaaagcgcaacgugcucauuuuugaccugggugggggcaccuucgaugugucgguucucuccauugacgccggugucuuugaggugaaagccacugcuggagauacccaccugggaggagaggacuucgacaaccggcucgugaaccacuucauggaagaauuccggcggaagcaugggaaggaccugagcgggaacaagcgugcccugcgcaggcugcgcacagccugugagcgcgccaagcgcaccccguccuccagcacccaggccacccuggagauagacucccuguucgagggcguggacuucuacaaguccaucacucgugcccgcuuugaggaacugugcucagaccucuuccgcagcacccuggagccgguggagaaggcccugcgggaugccaagcuggacaaggcccagauucaugacuucguccuggggggagggcuccacucgcauccccaaggugcagaaguugcugcaggacuucuucaacggcaaggagcugaacaagagcaucaacccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1443 - RNA, 2158 nt, Artificial Sequence
  mRNA product Design1 comprising derived and/or modified sequence from Homo sapiens__NP_006588.1 __HsHSPA8 (wt)
gggagaaagcuuaccauguccaagggaccugcaguugguauugaucuuggcaccaccuacucuuguguggguguuuuccagcacggaaaagucgagauaauugccaaugaucagggaaaccgaaccacuccaagcuaugucgccuuuacggacacugaacgguugaucggugaugccgcaaagaaucaaguugcaaugaaccccaccaacacaguuuuugaugccaaacgucugauuggacgcagauuugaugaugcuguuguccagucugauaugaaacauuggcccuuuaugguggugaaugaugcuggcaggcccaagguccaaguagaauacaagggagagaccaaaagcuucuauccagaggaggugucuucuaugguucugacaaagaugaaggaaauugcagaagccuaccuugggaagacuguuaccaaugcuguggucacagugccagcuuacuuuaaugacucucagcgucaggcuaccaaagaugcuggaacuauugcuggucucaauguacuuagaauuauuaaugagccaacugcugcugcuauugcuuacggcuuagacaaaaagguuggagcagaaagaaacgugcucaucuuugaccugggagguggcacuuuugaugugucaauccucacuauugaggauggaaucuuugaggucaagucuacagcuggagacacccacuuggguggagaagauuuugacaaccgaauggucaaccauuuuauugcugaguuuaagcgcaagcauaagaaggacaucagugagaacaagagagcuguaagacgccuccguacugcuugugaacgugcuaagcguacccucucuuccagcacccaggccaguauugagaucgauucucucuaugaaggaaucgacuucuauaccuccauuacccgugcccgauuugaagaacugaaugcugaccuguuccguggcacccuggacccaguagagaaagcccuucgagaugccaaacuagacaagucacagauucaugauauuguccugguuggugguucuacucguauccccaagauucagaagcuucuccaagacuucuucaauggaaaagaacugaauaagagcaucaacccugaugaagcuguugcuuauggugcagcuguccaggcagccaucuugucuggagacaagucugagaauguucaagauuugcugcucuuggaugucacuccucuuucccuugguauugaaacugcugguggagucaugacuguccucaucaagcguaauaccaccauuccuaccaagcagacacagaccuucacuaccuauucugacaaccagccuggugugcuuauucagguuuaugaaggcgagcgugccaugacaaaggauaacaaccugcuuggcaaguuugaacucacaggcauaccuccugcaccccgagguguuccucagauugaagucacuuuugacauugaugccaaugguauacucaaugucucugcuguggacaagaguacgggaaaagagaacaagauuacuaucacuaaugacaagggccguuugagcaaggaagacauugaacguaugguccaggaagcugagaaguacaaagcugaagaugagaagcagagggacaaggugucauccaagaauucacuugaguccuaugccuucaacaugaaagcaacuguugaagaugagaaacuucaaggcaagauuaacgaugaggacaaacagaagauucuggacaaguguaaugaaauuaucaacuggcuugauaagaaucagacugcugagaaggaagaauuugaacaucaacagaaagagcuggagaaaguuugcaaccccaucaucaccaagcuguaccagagugcaggaggcaugccaggaggaaugccugggggauuuccuggugguggagcuccucccucugguggugcuuccucagggcccaccauugaagagguugauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1444 - RNA, 2257 nt, Artificial Sequence
  mRNA product Design1 comprising derived and/or modified sequence from Homo sapiens__NP_004125.3 __HsHSPA9 (wt)
gggagaaagcuuaccaugauaagugccagccgagcugcagcagcccgucucgugggcgccgcagccucccggggcccuacggccgcccgccaccaggauagcuggaauggccuuagucaugaggcuuuuagacuuguuucaaggcgggauuaugcaucagaagcaaucaagggagcaguuguugguauugauuuggguacuaccaacuccugcguggcaguuauggaagguaaacaagcaaaggugcuggagaaugccgaaggugccagaaccaccccuucaguuguggccuuuacagcagauggugagcgacuuguuggaaugccggccaagcgacaggcugucaccaacccaaacaauacauuuuaugcuaccaagcgucucauuggccggcgauaugaugauccugaaguacagaaagacauuaaaaauguucccuuuaaaauuguccgugccuccaauggugaugccuggguugaggcucaugggaaauuguauucuccgagucagauuggagcauuuguguugaugaagaugaaagagacugcagaaaauuacuuggggcacacagcaaaaaaugcugugaucacagucccagcuuauuucaaugacucgcagagacaggccacuaaagaugcuggccagauaucuggacugaaugugcuucgggugauuaaugagcccacagcugcugcucuugccuauggucuagacaaaucagaagacaaagucauugcuguauaugauuuaggugguggaacuuuugauauuucuauccuggaaauucagaaaggaguauuugaggugaaauccacaaauggggauaccuucuuagguggggaagacuuugaccaggccuugcuacggcacauugugaaggaguucaagagagagacagggguugauuugacuaaagacaacauggcacuucagaggguacgggaagcugcugaaaaggcuaaaugugaacucuccucaucugugcagacugacaucaauuugcccuaucuuacaauggauucuucuggacccaagcauuugaauaugaaguugacccgugcucaauuugaagggauugucacugaucuaaucagaaggacuaucgcuccaugccaaaaagcuaugcaagaugcagaagucagcaagagugacauaggagaagugauucuuguggguggcaugacuaggaugcccaagguucagcagacuguacaggaucuuuuuggcagagccccaaguaaagcugucaauccugaugaggcuguggccauuggagcugccauucagggagguguguuggccggcgaugucacggaugugcugcuccuugaugucacuccccugucucuggguauugaaacucuaggaggugucuuuaccaaacuuauuaauaggaauaccacuauuccaaccaagaagagccagguauucucuacugccgcugauggucaaacgcaaguggaaauuaaagugugucagggugaaagagagauggcuggagacaacaaacuccuuggacaguuuacuuugauuggaauuccaccagccccucguggaguuccucagauugaaguuacauuugacauugaugccaaugggauaguacauguuucugcuaaagauaaaggcacaggacgugagcagcagauuguaauccagucuucugguggauuaagcaaagaugauauugaaaauaugguuaaaaaugcagagaaauaugcugaagaagaccggcgaaagaaggaacgaguugaagcaguuaauauggcugaaggaaucauucacgacacagaaaccaagauggaagaauucaaggaccaauuaccugcugaugagugcaacaagcugaaagaagagauuuccaaaaugagggagcuccuggcuagaaaagacagcgaaacaggagaaaauauuagacaggcagcauccucucuucagcaggcaucacugaagcuguucgaaauggcauacaaaaagauggcaucugagcgagaaggcucuggaaguucuggcacuggggaacaaaaggaagaucaaaaggaggaaaaacaguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1445 - RNA, 2245 nt, Artificial Sequence
  mRNA product Design1 comprising derived and/or modified sequence from Homo sapiens__NP_079291.2__HsHSPA12A (wt)
gggagaaagcuuaccauggcggacaaggaggccggcggcagcgacgggccccgagaaacggcucccacaucugcauauucaucuccagcccggagucuuggggacacaggaauaacgccucugucccccucccauauugugaacgacacugacuccaacgucucagaacagcagucauuucucguggugguggccgucgacuuugggaccacauccaguggcuaugccuacagcuucaccaaggagccggaaugcauccaugugaugaggcgaugggagggaggugacccugguguguccaaucagaagacuccaaccaccaucuugcugacucccgagaggaaguuccacagcuucggguaugccgccagggacuuuuaccaugaccuggaucccaaugaggccaagcaguggcuguaccuggagaaguucaagaugaagcugcacaccacuggggaccucaccauggauacagaccugacggcagcaaauggcaagaaagucaaagcccuugaaaucuuugcuuaugcccugcaguacuuuaaggagcaggcgcugaaggagcugagugaccaggcggguucggaguucgagaacucugaugucagaugggucaucacggugccugccaucuggaagcagccggccaagcaguucaugagacaagcugccuaccaggcaggccuggccucccccgagaacucggagcagcucaucauugccuuggagccugaggcagccucuaucuacugccgaaagcugcggcuacaccagaugauugagcugagcagcaaggcagccgucaauggguacagcggcagugacacaguaggagcuggguuuacacaggcuaaggaacacauacggcguaaucggcagagucggaccuuuuugguggagaaugucauaggagaaaucugguccgagcuggaggaaggugauaaguaugugguuguggacaguggcgguggcaccguagaccugacaguccaucagauccgguuaccggagggacaccuuaaggaacuguauaaagcaacaggcggacccuauggaucuuuaggaguagauuaugaguucgaaaaacuucuguauaaaauauuuggagaggauuuuauugaacaauucaaaaucaaacgcccugcagccuggguugacuuaaugauugcguuugagucucgcaaaagggcggcugccccagacagaacuaacccgcugaacaucacccugcccuucuccuucauugacuacuacaagaaguuccgcgggcacaguguggagcacgccuugcggaaaagcaauguggauuuugugaagugguccucgcaggggaugcugcggaugaguccagaugccaugaacgcccuuuuuaagccgaccaucgauagcaucauugagcaucuccgggaccuguuucagaagcccgagguguccaccgucaaguuccucuuucuggugggcggcuuugccgaggcgccccugcugcagcaggcggugcaggcugcuuuuggggaccagugccggaucaucaucccccaggacgugggccucaccauccucaagggugccguccucuuuggccuggaccccgcggucaucaaggugcgccggucgccgcucaccuacgggguaggcgugcugaaccgcuacguggagggcaagcacccgccugagaagcugcuggugaaggauggcacucgguggugcaccgacgucuuugacaaguucaucucugccgaccagucuguggcucugggugagcuggucaagcguagcuacaccccggccaagcccucccagcuggucauugucaucaacaucuacagcucugagcacgacaacgucagcuucaucacugaucccggggugaagaaguguggcacgcuccgccuggaucucacagggaccaguggcacugcggugcccgcccggagggagauccagacccuuaugcaguucggggacaccgagaucaaagccacagccauugauauagccacuucgaagagugucaaaguugggaucgacuucuuaaauuacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1446 - RNA, 2278 nt, Artificial Sequence
  mRNA product Design1 comprising derived and/or modified sequence from Homo sapiens__NP_443202.3 __HsHSPA12B (wt)
gggagaaagcuuaccauguuggcugucccggagaugggccugcaggggcuguacaucggcuccagcccggagcgguccccagugccuagcccacccggcuccccgaggacccaggaaagcugcggcauugccccccucacacccucgcagucuccaaaacccgagguccgagccccccagcaggccuccuucucuguggugguggccauugacuucggcaccacgucuaguggcuaugcuuucagcuuugccagugacccugaggccauccacaugaugaggaaaugggagggcggagacccgggcguggcccaccagaagaccccgaccugccugcugcugacuccggagggcgccuuccacagcuuuggcuacaccgcccgcgauuacuaccaugaccuggaccccgaagaggcgcgggacuggcucuacuucgagaaguucaagaugaagauccacagcgccacggaucucaccuugaagacccagcuagaggcaguaaauggaaagacgaugcccgcccuggagguguucgcccaugcccugcgcuucuucagggagcacgcccuucaggagcugagggagcagagcccaucgcugccagagaaggacacugugcgcuggguguugacggugccugccaucuggaaacagccagccaagcaguucaugcgggaggcugccuaccuggcuggacuagugucccgagagaaugcagagcagcuacucaucgcccuggagcccgaggccgccucgguauacugccgcaagcugcgccugcaccagcuccuggaccugaguggccgggccccagguggugggcgccugggugagcgccgcuccaucgacuccagcuuccgucaggcucgggagcagcugcgaaggucccgccacagccgcacguuccugguggagucaggcguaggagagcugugggcagagaugcaagcaggagaccgcuacgugguggccgacugcggcggaggcaccguggaccugacggugcaccagcuggagcagccccauggcacccucaaggagcucuacaaggcaucugggggcccuuauggcgcggugggcguggaccuggccuucgagcagcugcugugccgcaucuucggcgaggacuucaucgccaccuucaaaaggcaacggccggcagccuggguagaucugaccaucgccuucgaggcucgcaagcgcacugcuggcccacaccgugcaggggcgcucaacaucucgcugcccuucuccuucauugacuucuaccgcaagcagcggggccacaacguggagaccgcucugcgcaggagcagcgugaacuucgugaagugguccucacaggggaugcuccgaaugucuugugaagccaugaacgagcucuuucagcccaccgucagcgggaucauccagcacauagaggcccugcuggcacggccggaggugcagggugugaagcugcuguuccuagugggcggcuucgccgagucagcggugcugcagcacgcggugcaggcggcgcugggcgcccgcggucugcgugucguggucccgcacgacgugggccucaccauccucaaaggcgcggugcuguucggccaggcgccgggcguggugcggguccgccgcucgccgcucaccuauggcgugggcgugcucaaccgcuuugugccugggcgccacccgcccgaaaagcugcugguucgcgacggccgccgcuggugcaccgacgucuucgagcgcuucguggccgccgagcagucgguggcccugggcgaggaggugcggcgcagcuacugcccggcgcgucccggccagcggcgcguacucaucaaccuguacugcugcgcggcagaggaugcgcgcuucaucaccgaccccggcgugcgcaaaugcggcgcgcucagccucgagcuugagcccgccgacugcggccaggacaccgccggcgcgccucccggccgccgcgagauccgcgccgccaugcaguuuggcgacaccgaaauuaaggucaccgccgucgacgucagcaccaaucgcuccgugcgcgcguccaucgacuuucuuuccaacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1447 - RNA, 1633 nt, Artificial Sequence
  mRNA product Design1 comprising derived and/or modified sequence from Homo sapiens__NP_008879.3__HsHSPA13 (wt)
gggagaaagcuuaccauggccagagagaugacgaucuuaggaucggcuguuuugacucuccuguuggccggcuauuuggcacaacaguauuuaccauugccuacuccuaaagugauugguauugaucuuggcaccaccuauuguucuguugggguguuuuuuccuggcacaggaaaaguaaaggugauuccagaugaaaaugggcauaucagcauacccagcauggugucuuuuacugacaaugauguauaugugggauaugaaagcguagagcuggcagauucaaauccucaaaacacaauauaugaugccaaaagauucauaggcaagauuuuuaccgcagaagaguuggaggcugaaauuggcagauacccauuuaagguuuuaaacaaaaauggaaugguugaguuuucugugacaaguaaugagaccaucacaguguccccagaauauguuggcucucgacuauuguugaaguuaaaggaaauggcagaggcauaucuuggaaugccaguugccaaugcugucauuucuguaccagcagaauuugaucuaaaacagagaaauucaacaauugaagcugcuaaccuugcaggacugaagauuuugaggguaauaaaugaacccacagcagcagcuauggccuauggucuccacaaggcugacgucuuccacgucuuggugauagacuugggcggaggaacucuagaugugucuuuacugaauaaacaaggagggauguuucuaacccgagcaaugucuggaaacaauaaacuuggaggacaggacuucaaucagagauugcuucaguacuuauauaaacagaucuaucaaacauauggcuucgugcccucuaggaaagaggaaauccacagauugagacaagcuguggaaauggucaaauuaaaucugacucuucaucaaucugcucaguugucaguauuacuaacgguggaggagcaggacaggaaggaaccucacaguagugacacugaacugccaaaagacaaacuuuccucagcagaugaccaucgcgugaacaguggguuuggacguggccuuucugauaagaaaaguggagaaagucagguuuuauuugaaacagaaauaucacggaaacucuuugauacccuuaaugaagaccucuuucagaaaauacugguacccauucagcaaguauugaaagaaggccaccuggaaaagacugagauugaugaggugguuuuaguugggggcuccacucguauuccucggauccgucaagucauucaagaguucuuuggaaaagaucccaacacaucuguagacccugaccuagcaguaguaacgggaguggcuauccaagcagggauugauggaggcucuuggccucuccaagucagugcuuuagaaauucccaauaagcauuuacaaaaaaccaacuucaacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1448 - RNA, 1747 nt, Artificial Sequence
  mRNA product Design1 comprising derived and/or modified sequence from Homo sapiens__NP_057383.2__HsHSPA14 (wt)
gggagaaagcuuaccauggcggccaucggaguucaccugggcugcaccucagccuguguggccgucuauaaggauggccgggcuggugugguugcaaaugaugccggugaccgaguuacuccagcuguuguugcuuacucagaaaaugaagagauuguuggauuggcagcaaaacaaaguagaauaagaaauauuucaaauacaguaaugaaaguaaagcagauccugggcagaagcuccagugauccacaagcucagaaauacaucgcggaaaguaaauguuuagucauugaaaaaaaugggaaauuacgauaugaaauagauacuggagaagaaacaaaauuuguuaacccagaagauguugccagacugauauuuaguaaaaugaaagaaacggcacauucuguauugggcucagaugcaaaugauguaguuauuacugucccguuugauuuuggagaaaagcaaaaaaaugcucuuggagaagcagcuagagcugcuggauuuaauguuuugcgauuaauucacgaaccgucugcagcucuucuugcuuauggaauuggacaagacuccccuacuggaaaaagcaauauuuugguguuuaagcuuggaggaacauccuuaucucucagcgucauggaaguuaacaguggaauauaucggguucuuucaacaaacacugaugauaacaucgguggugcacauuucacagaaaccuuagcacaguaucuagcuucugaguuccaaagauccuucaaacaugaugugagaggaaaugcgcgagccaugaugaaauuaacgaacagugcugaaguagcgaaacauucuuugucaaccuugggaagugccaacuguuuucuugacucauuauaugaaggucaagauuuugauugcaauguguccagagcaagauuugaacuucuuuguucuccacuuuuuaauaaguguauagaagcaaucagaggacucuuagaucaaaauggauuuacagcagaugauaucaacaagguuguccuuuguggagggucuucucgaaucccaaagcuacagcaacugauuaaagaucuuuucccagcuguugagcuucucaauucuaucccuccugaugaagugaucccuauuggugcagcuauagaagcaggaauucuuauugggaaagaaaaccuguugguggaagacucucuuaugauagaguguucagccagagauauuuuaguuaaggguguggacgaaucaggagccaguagauucacagugcuguuuccaucagggacuccuuugccagcucgaagacaacacacauugcaagccccuggaagcauaucuucagugugccuugaacucuaugagucugaugggaagaacucugccaaagaggaaaccaaguuugcacagguuguacuccaggauuuagauaaaaaagaaaauggauuacgugauauauuagcuguucuuacuaugaaaagggauggaucuuuacaugugacaugcacagaucaagaaacuggaaaaugugaagcaaucucuauugagauagcaucuuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1449 - RNA, 2794 nt, Artificial Sequence
  mRNA product Design1 comprising derived and/or modified sequence from Homo sapiens__NP_006635.2 __HsHSPH1 (wt)
gggagaaagcuuaccaugucgguggugggguuggacgugggcucgcagagcugcuacaucgcgguagcccgggccgggggcaucgagaccaucgccaaugaguucagcgaccggugcaccccgucagucauaucauuuggaucaaaaaauagaacaaucggaguugcagccaaaaaucagcaaaucacucaugcaaacaauacggugucuaacuucaaaagauuucauggccgagcauucaaugaccccuucauucaaaaggagaaggaaaacuugaguuacgauuugguuccauugaaaaaugguggaguuggaauaaagguaauguacaugggugaagaacaucuauuuaguguggagcagauaacagccauguuguugacuaagcugaaggaaacugcugaaaacagccucaagaaaccaguaacagauuguguuauuucaguccccuccuucuuuacagaugcugagaggcgaucuguguuagaugcugcacagauuguuggccuaaacuguuuaagacuuaugaaugacaugacagcuguugcuuugaauuacggaauuuauaagcaggaucucccaagccuggaugagaaaccucggauagugguuuuuguugauaugggacauucagcuuuucaagugucugcuugugcuuuuaacaagggaaaauugaagguacugggaacagcuuuugauccuuucuuaggaggaaaaaacuucgaugaaaaguuaguggaacauuuuugugcagaauuuaaaacuaaguacaaguuggaugcaaaauccaaaauacgagcacuccuacgucuguaucaggaaugugaaaaacugaaaaagcuaaugagcucuaacagcacagaccuuccacugaauaucgaaugcuuuaugaaugauaaagauguuuccggaaagaugaacaggucacaauuugaagaacucugugcugaacuucugcaaaagauagaaguaccccuuuauucacuguuggaacaaacucaucucaaaguagaagaugugagugcaguugagauuguuggaggcgcuacacgaauuccagcugugaaggaaagaauugccaaauucuuuggaaaagauauuagcacaacacucaaugcagaugaagcaguagccagaggaugugcauuacagugugcaauacuuuccccggcauuuaaaguuagagaauuuuccgucacagaugcaguuccuuuuccaauaucucugaucuggaaccaugauucagaagauacugaagguguucaugaagucuuuagucgaaaccaugcugcuccuuucuccaaaguucucaccuuucugagaagggggccuuuugagcuagaagcuuucuauucugauccccaaggaguuccauauccagaagcaaaaauaggccgcuuuguaguucagaauguuucugcacagaaagauggagaaaaaucuagaguaaaagucaaagugcgagucaacacccauggcauuuucaccaucucuacggcaucuaugguggagaaagucccaacugaggagaaugaaaugucuucugaagcugacauggagugucugaaucagagaccaccagaaaacccagacacugauaaaaauguccagcaagacaacagugaagcuggaacacagccccagguacaaacugaugcucaacaaaccucacagucucccccuucaccugaacuuaccucagaagaaaacaaaaucccagaugcugacaaagcaaaugaaaaaaaaguugaccagccuccagaagcuaaaaagcccaaaauaaagguggugaauguugagcugccuauugaagccaacuuggucuggcaguuagggaaagaccuucuuaacauguauauugagacagaggguaagaugauaaugcaagauaaauuggaaaaagaaaggaaugaugcuaaaaaugcaguugaggaauauguguaugaguucagagacaagcuguguggaccauaugaaaaauuuauaugugagcaggaucaucaaaauuuuuugagacuccucacagaaacugaagacuggcuguaugaagaaggagaggaccaagcuaaacaagcauauguugacaaguuggaagaauuaaugaaaauuggcacuccaguuaaaguucgguuucaggaagcugaagaacggccaaaaauguuugaagaacuaggacagaggcugcagcauuaugccaagauagcagcugacuucagaaauaaggaugagaaauacaaccauauugaugagucugaaaugaaaaaaguggagaagucuguuaaugaagugauggaauggaugaauaaugucaugaaugcucaggcuaaaaagagucuugaucaggauccaguuguacgugcucaggaaauuaaaacaaaaaucaaggaauugaacaacacaugugaacccguuguaacacaaccgaaaccaaaaauugaaucacccaaacuggaaagaacuccaaauggcccaaauauugauaaaaaggaagaagauuuagaagacaaaaacaauuuuggugcugaaccuccacaucagaauggugaauguuacccuaaugagaaaaauucuguuaauauggacuuggacuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1450 - RNA, 3217 nt, Artificial Sequence
  mRNA product Design1 comprising derived and/or modified sequence from Homo sapiens__NP_006380.1 __HsHYOU1 (wt)
gggagaaagcuuaccauggcagacaaaguuaggaggcagaggccgaggaggcgagucuguugggccuugguggcugugcucuuggcagaccuguuggcacugagugauacacuggcagugaugucuguggaccugggcagugaguccaugaagguggccauugucaaaccuggagugcccauggaaauugucuugaauaaggaaucucggaggaaaacaccggugaucgugacccugaaagaaaaugaaagauucuuuggagacagugcagcaagcauggcgauuaagaauccaaaggcuacgcuacguuacuuccagcaccuccuggggaagcaggcagauaacccccauguagcucuuuaccaggcccgcuucccggagcacgagcugacuuucgacccacagaggcagacugugcacuuucagaucagcucgcagcugcaguucucaccugaggaaguguugggcaugguucucaauuauucucguucucuagcugaagauuuugcagagcagcccaucaaggaugcagugaucaccgugccagucuucuucaaccaggccgagcgccgagcugugcugcaggcugcucguauggcuggccucaaagugcugcagcucaucaaugacaacaccgccacugcccucagcuauggugucuuccgccggaaagauauuaacaccacugcccagaauaucauguucuaugacaugggcucaggcagcaccguaugcaccauugugaccuaccagauggugaagacuaaggaagcugggaugcagccacagcugcagauccggggaguaggauuugaccguacccuggggggccuggagauggagcuccggcuucgagaacgccuggcugggcuuuucaaugagcagcgcaagggucagagagcaaaggaugugcgggagaacccgcgugccauggccaagcugcugcgugaggcuaaucggcucaaaaccguccucagugccaacgcugaccacauggcacagauugaaggccugauggaugauguggacuucaaggcaaaagugacucguguggaauuugaggaguugugugcagacuuguuugagcgggugccugggccuguacagcaggcccuccagagugccgaaaugagucuggaugagauugagcaggugauccugguggguggggccacucggguccccagaguucaggaggugcugcugaaggccgugggcaaggaggagcuggggaagaacaucaaugcagaugaagcagccgccaugggggcaguguaccaggcagcugcgcucagcaaagccuuuaaagugaagccauuugucguccgagaugcaguggucuaccccauccugguggaguucacgagggagguggaggaggagccugggauucacagccugaagcacaauaaacggguacucuucucucggauggggcccuacccucaacgcaaagucaucaccuuuaaccgcuacagccaugauuucaacuuccacaucaacuacggcgaccugggcuuccuggggccugaagaucuucggguauuuggcucccagaaucugaccacagugaagcuaaaaggggugggugacagcuucaagaaguauccugacuacgaguccaagggcaucaaggcucacuucaaccuggaugagaguggcgugcucagucuagacaggguggagucuguauuugagacacugguagaggacagcgcagaagaggaaucuacucucaccaaacuuggcaacaccauuuccagccuguuuggaggcgguaccacaccagaugccaaggagaaugguacugauacuguccaggaggaagaggagagcccugcagaggggagcaaggacgagccuggggagcagguggagcucaaggaggaagcugaggccccaguggaggauggcucucagcccccacccccugaaccuaagggagaugcaaccccugagggagaaaaggccacagaaaaagaaaauggggacaagucugaggcccagaaaccaagugagaaggcagaggcagggccugagggcgucgcuccagccccagagggagagaagaagcagaagcccgccaggaagcggcgaaugguagaggagaucgggguggagcugguuguucuggaccugccugacuugccagaggauaagcuggcucagucggugcagaaacuucaggacuugacacuccgagaccuggagaagcaggaacgggaaaaagcugccaacagcuuggaagcauucauauuugagacccaggacaagcuguaccagcccgaguaccaggaaguguccacagaggagcagcgugaggagaucucugggaagcucagcgccgcauccaccuggcuggaggaugaggguguuggagccaccacagugauguugaaggagaagcuggcugagcugaggaagcugugccaagggcuguuuuuucggguagaggagcgcaagaaguggcccgaacggcugucugcccucgauaaucuccucaaccauuccagcauguuccucaagggggcccggcucaucccagagauggaccagaucuucacugagguggagaugacaacguuagagaaagucaucaaugagaccugggccuggaagaaugcaacucuggccgagcaggcuaagcugcccgccacagagaagccuguguugcucucaaaagacauugaagcuaagaugauggcccuggaccgagaggugcaguaucugcucaauaaggccaaguuuaccaagccccggccccggccuaaggacaagaaugggacccgggcagagccaccccucaaugccagugccagugaccagggggagaaggucaucccuccagcaggccagacugaagaugcagagcccauuucagaaccugagaaaguagagacuggauccgagccaggagacacugagccuuuggaguuaggagguccuggagcagaaccugaacagaaagaacaaucgacaggacagaagcggccuuugaagaacgacgaacuauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1451 - RNA, 2416 nt, Artificial Sequence
  mRNA product Design1 comprising derived and/or modified sequence from Homo sapiens__NP_005339.3 __HsHSP90AA1 (wt)
gggagaaagcuuaccaugccugaggaaacccagacccaagaccaaccgauggaggaggaggagguugagacguucgccuuucaggcagaaauugcccaguugaugucauugaucaucaauacuuucuacucgaacaaagagaucuuucugagagagcucauuucaaauucaucagaugcauuggacaaaauccgguaugaaagcuugacagaucccaguaaauuagacucugggaaagagcugcauauuaaccuuauaccgaacaaacaagaucgaacucucacuauuguggauacuggaauuggaaugaccaaggcugacuugaucaauaaccuugguacuaucgccaagucugggaccaaagcguucauggaagcuuugcaggcuggugcagauaucucuaugauuggccaguucgguguugguuuuuauucugcuuauuugguugcugagaaaguaacugugaucaccaaacauaacgaugaugagcaguacgcuugggaguccucagcagggggaucauucacagugaggacagacacaggugaaccuaugggucguggaacaaaaguuauccuacaccugaaagaagaccaaacugaguacuuggaggaacgaagaauaaaggagauugugaagaaacauucucaguuuauuggauaucccauuacucuuuuuguggagaaggaacgugauaaagaaguaagcgaugaugaggcugaagaaaaggaagacaaagaagaagaaaaagaaaaagaagagaaagagucggaagacaaaccugaaauugaagauguugguucugaugaggaagaagaaaagaaggauggugacaagaagaagaagaagaagauuaaggaaaaguacaucgaucaagaagagcucaacaaaacaaagcccaucuggaccagaaaucccgacgauauuacuaaugaggaguacggagaauucuauaagagcuugaccaaugacugggaagaucacuuggcagugaagcauuuuucaguugaaggacaguuggaauucagagcccuucuauuugucccacgacgugcuccuuuugaucuguuugaaaacagaaagaaaaagaacaacaucaaauuguauguacgcagaguuuucaucauggauaacugugaggagcuaaucccugaauaucugaacuucauuagaggggugguagacucggaggaucucccucuaaacauaucccgugagauguugcaacaaagcaaaauuuugaaaguuaucaggaagaauuuggucaaaaaaugcuuagaacucuuuacugaacuggcggaagauaaagagaacuacaagaaauucuaugagcaguucucuaaaaacauaaagcuuggaauacacgaagacucucaaaaucggaagaagcuuucagagcuguuaagguacuacacaucugccucuggugaugagaugguuucucucaaggacuacugcaccagaaugaaggagaaccagaaacauaucuauuauaucacaggugagaccaaggaccagguagcuaacucagccuuuguggaacgucuucggaaacauggcuuagaagugaucuauaugauugagcccauugaugaguacuguguccaacagcugaaggaauuugaggggaagacuuuagugucagucaccaaagaaggccuggaacuuccagaggaugaagaagagaaaaagaagcaggaagagaaaaaaacaaaguuugagaaccucugcaaaaucaugaaagacauauuggagaaaaaaguugaaaaggugguugugucaaaccgauuggugacaucuccaugcuguauugucacaagcacauauggcuggacagcaaacauggagagaaucaugaaagcucaagcccuaagagacaacucaacaauggguuacauggcagcaaagaaacaccuggagauaaacccugaccauuccauuauugagaccuuaaggcaaaaggcagaggcugauaagaacgacaagucugugaaggaucuggucaucuugcuuuaugaaacugcgcuccugucuucuggcuucagucuggaagauccccagacacaugcuaacaggaucuacaggaugaucaaacuuggucuggguauugaugaagaugacccuacugcugaugauaccagugcugcuguaacugaagaaaugccaccccuugaaggagaugacgacacaucacgcauggaagaaguagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1452 - RNA, 556 nt, Artificial Sequence
  mRNA product Design1 comprising derived and/or modified sequence from Homo sapiens__NG_005218__HsHSP90AA3P (wt)
gggagaaagcuuaccauggauuccaguaaauuagacucugggaaagggcugcauauuaaccuuguaccaaacaaacaaaaucaaacccucacuauuguggacacuagaauuggaaugaccaagacugacuugaucaauaaccucgguacugucaccaagucugggaccaaagcauucauggaagcuuugcaggcugaugcagauaucucuaugauuggccauuucgggguugguuuuuauucugcuuauuugguugccaagaaaguaacugugaucagcaaacauaacaaugaugagcaguacaccugggaguccucagcagggggaucauucacagugaggacagacgagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1453 - RNA, 2392 nt, Artificial Sequence
  mRNA product Design1 comprising derived and/or modified sequence from Homo sapiens__NP_031381.2__HsHSP90AB1 (wt)
gggagaaagcuuaccaugccugaggaagugcaccauggagaggaggagguggagacuuuugccuuucaggcagaaauugcccaacucaugucccucaucaucaauaccuucuauuccaacaaggagauuuuccuucgggaguugaucucuaaugcuucugaugccuuggacaagauucgcuaugagagccugacagacccuucgaaguuggacagugguaaagagcugaaaauugacaucauccccaacccucaggaacguacccugacuuugguagacacaggcauuggcaugaccaaagcugaucucauaaauaauuugggaaccauugccaagucugguacuaaagcauucauggaggcucuucaggcuggugcagacaucuccaugauugggcaguuugguguuggcuuuuauucugccuacuugguggcagagaaagugguugugaucacaaagcacaacgaugaugaacaguaugcuugggagucuucugcuggagguuccuucacugugcgugcugaccauggugagcccauuggcagggguaccaaagugauccuccaucuuaaagaagaucagacagaguaccuagaagagaggcgggucaaagaaguagugaagaagcauucucaguucauaggcuaucccaucacccuuuauuuggagaaggaacgagagaaggaaauuagugaugaugaggcagaggaagagaaaggugagaaagaagaggaagauaaagaugaugaagaaaaacccaagaucgaagauguggguucagaugaggaggaugacagcgguaaggauaagaagaagaaaacuaagaagaucaaagagaaauacauugaucaggaagaacuaaacaagaccaagccuauuuggaccagaaacccugaugacaucacccaagaggaguauggagaauucuacaagagccucacuaaugacugggaagaccacuuggcagucaagcacuuuucuguagaaggucaguuggaauucagggcauugcuauuuauuccucgucgggcucccuuugaccuuuuugagaacaagaagaaaaagaacaacaucaaacucuauguccgccguguguucaucauggacagcugugaugaguugauaccagaguaucucaauuuuauccguggugugguugacucugaggaucugccccugaacaucucccgagaaaugcuccagcagagcaaaaucuugaaagucauucgcaaaaacauuguuaagaagugccuugagcucuucucugagcuggcagaagacaaggagaauuacaagaaauucuaugaggcauucucuaaaaaucucaagcuuggaauccacgaagacuccacuaaccgccgccgccugucugagcugcugcgcuaucauaccucccagucuggagaugagaugacaucucugucagaguauguuucucgcaugaaggagacacagaaguccaucuauuacaucacuggugagagcaaagagcagguggccaacucagcuuuuguggagcgagugcggaaacggggcuucgaggugguauauaugaccgagcccauugacgaguacugugugcagcagcucaaggaauuugaugggaagagccuggucucaguuaccaaggagggucuggagcugccugaggaugaggaggagaagaagaagauggaagagagcaaggcaaaguuugagaaccucugcaagcucaugaaagaaaucuuagauaagaagguugagaaggugacaaucuccaauagacuugugucuucaccuugcugcauugugaccagcaccuacggcuggacagccaauauggagcggaucaugaaagcccaggcacuucgggacaacuccaccaugggcuauaugauggccaaaaagcaccuggagaucaacccugaccaccccauuguggagacgcugcggcagaaggcugaggccgacaagaaugauaaggcaguuaaggaccugguggugcugcuguuugaaaccgcccugcuaucuucuggcuuuucccuugaggauccccagacccacuccaaccgcaucuaucgcaugaucaagcuaggucuagguauugaugaagaugaaguggcagcagaggaacccaaugcugcaguuccugaugagauccccccucucgagggcgaugaggaugcgucucgcauggaagaagucgauuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1454 - RNA, 2629 nt, Artificial Sequence
  mRNA product Design1 comprising derived and/or modified sequence from Homo sapiens__NP_003290.1__HsHSP90B1 (wt)
gggagaaagcuuaccaugagggcccugugggugcugggccucugcugcguccugcugaccuucgggucggucagagcugacgaugaaguugauguggaugguacaguagaagaggaucuggguaaaaguagagaaggaucaaggacggaugaugaaguaguacagagagaggaagaagcuauucaguuggauggauuaaaugcaucacaaauaagagaacuuagagagaagucggaaaaguuugccuuccaagccgaaguuaacagaaugaugaaacuuaucaucaauucauuguauaaaaauaaagagauuuuccugagagaacugauuucaaaugcuucugaugcuuuagauaagauaaggcuaauaucacugacugaugaaaaugcucuuucuggaaaugaggaacuaacagucaaaauuaagugugauaaggagaagaaccugcugcaugucacagacaccgguguaggaaugaccagagaagaguugguuaaaaaccuugguaccauagccaaaucugggacaagcgaguuuuuaaacaaaaugacugaagcacaggaagauggccagucaacuucugaauugauuggccaguuuggugucgguuucuauuccgccuuccuuguagcagauaagguuauugucacuucaaaacacaacaacgauacccagcacaucugggagucugacuccaaugaauuuucuguaauugcugacccaagaggaaacacucuaggacggggaacgacaauuacccuugucuuaaaagaagaagcaucugauuaccuugaauuggauacaauuaaaaaucucgucaaaaaauauucacaguucauaaacuuuccuauuuauguauggagcagcaagacugaaacuguugaggagcccauggaggaagaagaagcagccaaagaagagaaagaagaaucugaugaugaagcugcaguagaggaagaagaagaagaaaagaaaccaaagacuaaaaaaguugaaaaaacugucugggacugggaacuuaugaaugauaucaaaccaauauggcagagaccaucaaaagaaguagaagaagaugaauacaaagcuuucuacaaaucauuuucaaaggaaagugaugaccccauggcuuauauucacuuuacugcugaaggggaaguuaccuucaaaucaauuuuauuuguacccacaucugcuccacguggucuguuugacgaauauggaucuaaaaagagcgauuacauuaagcucuaugugcgccguguauucaucacagacgacuuccaugauaugaugccuaaauaccucaauuuugucaagggugugguggacucagaugaucuccccuugaauguuucccgcgagacucuucagcaacauaaacugcuuaaggugauuaggaagaagcuuguucguaaaacgcuggacaugaucaagaagauugcugaugauaaauacaaugauacuuuuuggaaagaauuugguaccaacaucaagcuuggugugauugaagaccacucgaaucgaacacgucuugcuaaacuucuuagguuccagucuucucaucauccaacugacauuacuagccuagaccaguauguggaaagaaugaaggaaaaacaagacaaaaucuacuucauggcuggguccagcagaaaagaggcugaaucuucuccauuuguugagcgacuucugaaaaagggcuaugaaguuauuuaccucacagaaccuguggaugaauacuguauucaggcccuucccgaauuugaugggaagagguuccagaauguugccaaggaaggagugaaguucgaugaaagugagaaaacuaaggagagucgugaagcaguugagaaagaauuugagccucugcugaauuggaugaaagauaaagcccuuaaggacaagauugaaaaggcuguggugucucagcgccugacagaaucuccgugugcuuugguggccagccaguacggauggucuggcaacauggagagaaucaugaaagcacaagcguaccaaacgggcaaggacaucucuacaaauuacuaugcgagucagaagaaaacauuugaaauuaaucccagacacccgcugaucagagacaugcuucgacgaauuaaggaagaugaagaugauaaaacaguuuuggaucuugcugugguuuuguuugaaacagcaacgcuucggucaggguaucuuuuaccagacacuaaagcauauggagauagaauagaaagaaugcuucgccucaguuugaacauugacccugaugcaaagguggaagaagagcccgaagaagaaccugaagagacagcagaagacacaacagaagacacagagcaagacgaagaugaagaaauggaugugggaacagaugaagaagaagaaacagcaaaggaaucuacagcugaaaaagaugaauuguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1455 - RNA, 2332 nt, Artificial Sequence
  mRNA product Design1 comprising derived and/or modified sequence from Homo sapiens__NP_057376.2__HsTRAP1 (wt)
gggagaaagcuuaccauggcgcgcgagcugcgggcgcugcugcuguggggccgccgccugcggccuuugcugcgggcgccggcgcuggcggccgugccgggaggaaaaccaauucuguguccucggaggaccacagcccaguugggccccaggcgaaacccagccuggagcuugcaggcaggacgacuguucagcacgcagaccgccgaggacaaggaggaaccccugcacucgauuaucagcagcacagagagcgugcaggguuccacuuccaaacaugaguuccaggccgagacaaagaagcuuuuggacauuguugcccggucccuguacucagaaaaagagguguuuauacgggagcugaucuccaaugccagcgaugccuuggaaaaacugcgucacaaacuggugucugacggccaagcacugccagaaauggagauucacuugcagaccaaugccgagaaaggcaccaucaccauccaggauacugguaucgggaugacacaggaagagcugguguccaaccuggggacgauugccagaucggggucaaaggccuuccuggaugcucugcagaaccaggcugaggccagcagcaagaucaucggccaguuuggaguggguuucuacucagcuuucaugguggcugacagaguggaggucuauucccgcucggcagccccggggagccuggguuaccaguggcuuucagaugguucuggaguguuugaaaucgccgaagcuucgggaguuagaaccgggacaaaaaucaucauccaccugaaauccgacugcaaggaguuuuccagcgaggcccgggugcgagaugugguaacgaaguacagcaacuucgucagcuuccccuuguacuugaauggaaggcggaugaacaccuugcaggccaucuggaugauggaccccaaggauguccgugaguggcaacaugaggaguucuaccgcuacgucgcgcaggcucacgacaagccccgcuacacccugcacuauaagacggacgcaccgcucaacauccgcagcaucuucuacgugcccgacaugaaaccguccauguuugaugugagccgggagcugggcuccagcguugcacuguacagccgcaaaguccucauccagaccaaggccacggacauccugcccaaguggcugcgcuucauccgaggugugguggacagugaggacauuccccugaaccucagccgggagcugcugcaggagagcgcacucaucaggaaacuccgggacguuuuacagcagaggcugaucaaauucuucauugaccagaguaaaaaagaugcugagaaguaugcaaaguuuuuugaagauuacggccuguucaugcgggagggcauugugaccgccaccgagcaggaggucaaggaggacauagcaaagcugcugcgcuacgaguccucggcgcugcccuccgggcagcuaaccagccucucagaauacgccagccgcaugcgggccggcacccgcaacaucuacuaccugugcgcccccaaccgucaccuggcagagcacucacccuacuaugaggccaugaagaagaaagacacagagguucucuucugcuuugagcaguuugaugagcucacccugcugcaccuucgugaguuugacaagaagaagcugaucucuguggagacggacauagucguggaucacuacaaggaggagaaguuugaggacagguccccagccgccgagugccuaucagagaaggagacggaggagcucauggccuggaugagaaaugugcuggggucgcgugucaccaacgugaaggugacccuccgacuggacacccacccugccauggucaccgugcuggagaugggggcugcccgccacuuccugcgcaugcagcagcuggccaagacccaggaggagcgcgcacagcuccugcagcccacgcuggagaucaaccccaggcacgcgcucaucaagaagcugaaucagcugcgcgcaagcgagccuggccuggcucagcugcugguggaucagauauacgagaacgccaugauugcugcuggacuuguugacgacccuagggccauggugggccgcuugaaugagcugcuugucaaggcccuggagcgacacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1456 - RNA, 679 nt, Artificial Sequence
  mRNA product Design1 comprising derived and/or modified sequence from Homo sapiens__NP_000609.1__HsIGF1 (wt)
gggagaaagcuuaccaugggaaaaaucagcagucuuccaacccaauuauuuaagugcugcuuuugugauuucuugaaggugaagaugcacaccauguccuccucgcaucucuucuaccuggcgcugugccugcucaccuucaccagcucugccacggcuggaccggagacgcucugcggggcugagcugguggaugcucuucaguucguguguggagacaggggcuuuuauuucaacaagcccacaggguauggcuccagcagucggagggcgccucagacaggcaucguggaugagugcugcuuccggagcugugaucuaaggaggcuggagauguauugcgcaccccucaagccugccaagucagcucgcucuguccgugcccagcgccacaccgacaugcccaagacccagaaggaaguacauuugaagaacgcaaguagagggagugcaggaaacaagaacuacaggauguagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1457 - RNA, 760 nt, Artificial Sequence
  mRNA product Design1 comprising derived and/or modified sequence from Homo sapiens__NP_000603.1__HsIGF2 (wt)
gggagaaagcuuaccaugggaaucccaauggggaagucgaugcuggugcuucucaccuucuuggccuucgccucgugcugcauugcugcuuaccgccccagugagacccugugcggcggggagcugguggacacccuccaguucgucuguggggaccgcggcuucuacuucagcaggcccgcaagccgugugagccgucgcagccguggcaucguugaggagugcuguuuccgcagcugugaccuggcccuccuggagacguacugugcuacccccgccaaguccgagagggacgugucgaccccuccgaccgugcuuccggacaacuuccccagauaccccgugggcaaguucuuccaauaugacaccuggaagcaguccacccagcgccugcgcaggggccugccugcccuccugcgugcccgccggggucacgugcucgccaaggagcucgaggcguucagggaggccaaacgucaccguccccugauugcucuacccacccaagaccccgcccacgggggcgcccccccagagauggccagcaaucggaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1458 - RNA, 856 nt, Artificial Sequence
  mRNA product Design1 comprising derived and/or modified sequence from Homo sapiens__NP_000591.1__HsIL6 (wt)
gggagaaagcuuaccaugaacuccuucuccacaagcgccuucgguccaguugccuucucccuggggcugcuccugguguugccugcugccuucccugccccaguacccccaggagaagauuccaaagauguagccgccccacacagacagccacucaccucuucagaacgaauugacaaacaaauucgguacauccucgacggcaucucagcccugagaaaggagacauguaacaagaguaacaugugugaaagcagcaaagaggcacuggcagaaaacaaccugaaccuuccaaagauggcugaaaaagauggaugcuuccaaucuggauucaaugaggagacuugccuggugaaaaucaucacuggucuuuuggaguuugagguauaccuagaguaccuccagaacagauuugagaguagugaggaacaagccagagcugugcagaugaguacaaaaguccugauccaguuccugcagaaaaaggcaaagaaucuagaugcaauaaccaccccugacccaaccacaaaugccagccugcugacgaagcugcaggcacagaaccaguggcugcaggacaugacaacucaucucauucugcgcagcuuuaaggaguuccugcaguccagccugagggcucuucggcaaauguagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1459 - RNA, 1498 nt, Artificial Sequence
  mRNA product Design1 comprising derived and/or modified sequence from Homo sapiens__NP_002183.1__HsINHBA (wt)
gggagaaagcuuaccaugcccuugcuuuggcugagaggauuucuguuggcaaguugcuggauuauagugaggaguucccccaccccaggauccgaggggcacagcgcggcccccgacuguccguccugugcgcuggccgcccucccaaaggauguacccaacucucagccagagaugguggaggccgucaagaagcacauuuuaaacaugcugcacuugaagaagagacccgaugucacccagccgguacccaaggcggcgcuucugaacgcgaucagaaagcuucaugugggcaaagucggggagaacggguauguggagauagaggaugacauuggaaggagggcagaaaugaaugaacuuauggagcagaccucggagaucaucacguuugccgagucaggaacagccaggaagacgcugcacuucgagauuuccaaggaaggcagugaccugucagugguggagcgugcagaagucuggcucuuccuaaaaguccccaaggccaacaggaccaggaccaaagucaccauccgccucuuccagcagcagaagcacccgcagggcagcuuggacacaggggaagaggccgaggaagugggcuuaaagggggagaggagugaacuguugcucucugaaaaaguaguagacgcucggaagagcaccuggcaugucuucccugucuccagcagcauccagcgguugcuggaccagggcaagagcucccuggacguucggauugccugugagcagugccaggagaguggcgccagcuugguucuccugggcaagaagaagaagaaagaagaggagggggaagggaaaaagaagggcggaggugaagguggggcaggagcagaugaggaaaaggagcagucgcacagaccuuuccucaugcugcaggcccggcagucugaagaccacccucaucgccggcgucggcggggcuuggagugugauggcaaggucaacaucugcuguaagaaacaguucuuugucaguuucaaggacaucggcuggaaugacuggaucauugcucccucuggcuaucaugccaacuacugcgagggugagugcccgagccauauagcaggcacguccggguccucacuguccuuccacucaacagucaucaaccacuaccgcaugcggggccauagccccuuugccaaccucaaaucgugcugugugcccaccaagcugagacccauguccauguuguacuaugaugauggucaaaacaucaucaaaaaggacauucagaacaugaucguggaggagugugggugcucauagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1460 - RNA, 1441 nt, Artificial Sequence
  mRNA product Design1 comprising derived and/or modified sequence from Homo sapiens__NP_002184.2__HsINHBB (wt)
gggagaaagcuuaccauggacgggcugcccggucgggcgcugggggccgccugccuucugcugcuggcggccggcuggcuggggccugaggccuggggcucacccacgcccccgccgacgccugccgcgccgccgccacccccgccacccggauccccggguggcucgcaggacaccuguacgucgugcggcggcuuccggcggccagaggagcucggccgaguggacggcgacuuccuggaggcggugaagcggcacaucuugagccgccugcagaugcggggccggcccaacaucacgcacgccgugccuaaggccgccauggucacggcccugcgcaagcugcacgcgggcaaggugcgcgaggacggccgcguggagaucccgcaccucgacggccacgccagcccgggcgccgacggccaggagcgcguuuccgaaaucaucagcuucgccgagacagauggccucgccuccucccggguccgccuauacuucuucaucuccaacgaaggcaaccagaaccuguuugugguccaggccagccuguggcuuuaccugaaacuccugcccuacguccuggagaagggcagccggcggaaggugcgggucaaaguguacuuccaggagcagggccacggugacagguggaacaugguggagaagaggguggaccucaagcgcagcggcuggcauaccuucccacucacggaggccauccaggccuuguuugagcggggcgagcggcgacucaaccuagacgugcagugugacagcugccaggagcuggccguggugccgguguucguggacccaggcgaagagucgcaccggcccuuugugguggugcaggcucggcugggcgacagcaggcaccgcauucgcaagcgaggccuggagugcgauggccggaccaaccucuguugcaggcaacaguucuucauugacuuccgccucaucggcuggaacgacuggaucauagcacccaccggcuacuacgggaacuacugugagggcagcugcccagccuaccuggcagggguccccggcucugccuccuccuuccacacggcuguggugaaccaguaccgcaugcggggucugaaccccggcacggugaacuccugcugcauucccaccaagcugagcaccauguccaugcuguacuucgaugaugaguacaacaucgucaagcgggacgugcccaacaugauuguggaggagugcggcugcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1461 - RNA, 3676 nt, Artificial Sequence
  mRNA product Design1 comprising derived and/or modified sequence from Homo sapiens__NP_000623.2__HsITGAM (wt)
gggagaaagcuuaccauggcucucagaguccuucuguuaacagccuugaccuuaugucauggguucaacuuggacacugaaaacgcaaugaccuuccaagagaacgcaaggggcuucgggcagagcgugguccagcuucagggauccaggguggugguuggagccccccaggagauaguggcugccaaccaaaggggcagccucuaccagugcgacuacagcacaggcucaugcgagcccauccgccugcagguccccguggaggccgugaacaugucccugggccugucccuggcagccaccaccagccccccucagcugcuggccuguggucccaccgugcaccagacuugcagugagaacacguaugugaaagggcucugcuuccuguuuggauccaaccuacggcagcagccccagaaguucccagaggcccuccgaggguguccucaagaggauagugacauugccuucuugauugauggcucugguagcaucaucccacaugacuuucggcggaugaaggaguuugucucaacugugauggagcaauuaaaaaaguccaaaaccuuguucucuuugaugcaguacucugaagaauuccggauucacuuuaccuucaaagaguuccagaacaacccuaacccaagaucacuggugaagccaauaacgcagcugcuugggcggacacacacggccacgggcauccgcaaagugguacgagagcuguuuaacaucaccaacggagcccgaaagaaugccuuuaagauccuaguugucaucacggauggagaaaaguuuggcgaucccuugggauaugaggaugucaucccugaggcagacagagagggagucauucgcuacgucauuggggugggagaugccuuccgcagugagaaaucccgccaagagcuuaauaccaucgcauccaagccgccucgugaucacguguuccaggugaauaacuuugaggcucugaagaccauucagaaccagcuucgggagaagaucuuugcgaucgaggguacucagacaggaaguagcagcuccuuugagcaugagaugucucaggaaggcuucagcgcugccaucaccucuaauggccccuugcugagcacuguggggagcuaugacugggcugguggagucuuucuauauacaucaaaggagaaaagcaccuucaucaacaugaccagaguggauucagacaugaaugaugcuuacuuggguuaugcugccgccaucaucuuacggaaccgggugcaaagccugguucugggggcaccucgauaucagcacaucggccugguagcgauguucaggcagaacacuggcaugugggaguccaacgcuaaugucaagggcacccagaucggcgccuacuucggggccucccucugcuccguggacguggacagcaacggcagcaccgaccugguccucaucggggccccccauuacuacgagcagacccgagggggccagguguccgugugccccuugcccagggggagggcucgguggcagugugaugcuguucucuacggggagcagggccaacccuggggccgcuuuggggcagcccuaacagugcugggggacguaaauggggacaagcugacggacguggccauuggggccccaggagaggaggacaaccggggugcuguuuaccuguuucacggaaccucaggaucuggcaucagccccucccauagccagcggauagcaggcuccaagcucucucccaggcuccaguauuuuggucagucacugagugggggccaggaccucacaauggauggacugguagaccugacuguaggagcccaggggcacgugcugcugcucaggucccagccaguacugagagucaaggcaaucauggaguucaaucccagggaaguggcaaggaauguauuugaguguaaugaucagguggugaaaggcaaggaagccggagaggucagagucugccuccauguccagaagagcacacgggaucggcuaagagaaggacagauccagaguguugugacuuaugaccuggcucuggacuccggccgcccacauucccgcgccgucuucaaugagacaaagaacagcacacgcagacagacacaggucuuggggcugacccagacuugugagacccugaaacuacaguugccgaauugcaucgaggacccagugagccccauugugcugcgccugaacuucucucuggugggaacgccauugucugcuuucgggaaccuccggccagugcuggcggaggaugcucagagacucuucacagccuuguuucccuuugagaagaauuguggcaaugacaacaucugccaggaugaccucagcaucaccuucaguuucaugagccuggacugccucguggugggugggccccgggaguucaacgugacagugacugugagaaaugauggugaggacuccuacaggacacaggucaccuucuucuucccgcuugaccuguccuaccggaagguguccacgcuccagaaccagcgcucacagcgauccuggcgccuggccugugagucugccuccuccaccgaagugucuggggccuugaagagcaccagcugcagcauaaaccaccccaucuucccggaaaacucagaggucaccuuuaauaucacguuugauguagacucuaaggcuucccuuggaaacaaacugcuccucaaggccaaugugaccagugagaacaacaugcccagaaccaacaaaaccgaauuccaacuggagcugccggugaaauaugcugucuacaugguggucaccagccauggggucuccacuaaauaucucaacuucacggccucagagaauaccagucgggucaugcagcaucaauaucaggucagcaaccuggggcagaggagccuccccaucagccugguguucuuggugcccguccggcugaaccagacugucauaugggaccgcccccaggucaccuucuccgagaaccucucgaguacgugccacaccaaggagcgcuugcccucucacuccgacuuucuggcugagcuucggaaggcccccguggugaacugcuccaucgcugucugccagagaauccagugugacaucccguucuuuggcauccaggaagaauucaaugcuacccucaaaggcaaccucucguuugacugguacaucaagaccucgcauaaccaccuccugaucgugagcacagcugagaucuuguuuaacgauuccguguucacccugcugccgggacagggggcguuugugaggucccagacggagaccaaaguggagccguucgagguccccaacccccugccgcucaucgugggcagcucugucgggggacugcugcuccuggcccucaucaccgccgcgcuguacaagcucggcuucuucaagcggcaauacaaggacaugaugagugaagggggucccccgggggccgaaccccaguagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1462 - RNA, 1621 nt, Artificial Sequence
  mRNA product Design1 comprising derived and/or modified sequence from Homo sapiens__NP_002415.1__HsMMP8 (wt)
gggagaaagcuuaccauguucucccugaagacgcuuccauuucugcucuuacuccaugugcagauuuccaaggccuuuccuguaucuucuaaagagaaaaauacaaaaacuguucaggacuaccuggaaaaguucuaccaauuaccaagcaaccaguaucagucuacaaggaagaauggcacuaaugugaucguugaaaagcuuaaagaaaugcagcgauuuuuuggguugaaugugacggggaagccaaaugaggaaacucuggacaugaugaaaaagccucgcuguggagugccugacaguggugguuuuauguuaaccccaggaaaccccaagugggaacgcacuaacuugaccuacaggauucgaaacuauaccccacagcugucagaggcugagguagaaagagcuaucaaggaugccuuugaacucuggaguguugcaucaccucucaucuucaccaggaucucacagggagaggcagauaucaacauugcuuuuuaccaaagagaucacggugacaauucuccauuugauggacccaauggaauccuugcucaugccuuucagccaggccaagguauuggaggagaugcucauuuugaugccgaagaaacauggaccaacaccuccgcaaauuacaacuuguuucuuguugcugcucaugaauuuggccauucuuuggggcucgcucacuccucugacccuggugccuugauguaucccaacuaugcuuucagggaaaccagcaacuacucacucccucaagaugacaucgauggcauucaggccaucuauggacuuucaagcaacccuauccaaccuacuggaccaagcacacccaaacccugugaccccaguuugacauuugaugcuaucaccacacuccguggagaaauacuuuucuuuaaagacagguacuucuggagaaggcauccucagcuacaaagagucgaaaugaauuuuauuucucuauucuggccaucccuuccaacugguauacaggcugcuuaugaagauuuugacagagaccucauuuuccuauuuaaaggcaaccaauacugggcucugaguggcuaugauauucugcaagguuaucccaaggauauaucaaacuauggcuuccccagcagcguccaagcaauugacgcagcuguuuucuacagaaguaaaacauacuucuuuguaaaugaccaauucuggagauaugauaaccaaagacaauucauggagccagguuaucccaaaagcauaucaggugccuuuccaggaauagagaguaaaguugaugcaguuuuccagcaagaacauuucuuccaugucuucaguggaccaagauauuacgcauuugaucuuauugcucagagaguuaccagaguugcaagaggcaauaaauggcuuaacuguagauauggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1463 - RNA, 2341 nt, Artificial Sequence
  mRNA product Design1 comprising derived and/or modified sequence from Homo sapiens__NP_004985.2__HsMMP9 (wt)
gggagaaagcuuaccaugagccucuggcagccccugguccuggugcuccuggugcugggcugcugcuuugcugcccccagacagcgccaguccacccuugugcucuucccuggagaccugagaaccaaucucaccgacaggcagcuggcagaggaauaccuguaccgcuaugguuacacucggguggcagagaugcguggagagucgaaaucucuggggccugcgcugcugcuucuccagaagcaacugucccugcccgagaccggugagcuggauagcgccacgcugaaggccaugcgaaccccacggugcggggucccagaccugggcagauuccaaaccuuugagggcgaccucaaguggcaccaccacaacaucaccuauuggauccaaaacuacucggaagacuugccgcgggcggugauugacgacgccuuugcccgcgccuucgcacuguggagcgcggugacgccgcucaccuucacucgcguguacagccgggacgcagacaucgucauccaguuuggugucgcggagcacggagacggguaucccuucgacgggaaggacgggcuccuggcacacgccuuuccuccuggccccggcauucagggagacgcccauuucgacgaugacgaguuguggucccugggcaagggcgucgugguuccaacucgguuuggaaacgcagauggcgcggccugccacuuccccuucaucuucgagggccgcuccuacucugccugcaccaccgacggucgcuccgacggcuugcccuggugcaguaccacggccaacuacgacaccgacgaccgguuuggcuucugccccagcgagagacucuacacccaggacggcaaugcugaugggaaacccugccaguuuccauucaucuuccaaggccaauccuacuccgccugcaccacggacggucgcuccgacggcuaccgcuggugcgccaccaccgccaacuacgaccgggacaagcucuucggcuucugcccgacccgagcugacucgacggugauggggggcaacucggcgggggagcugugcgucuuccccuucacuuuccuggguaaggaguacucgaccuguaccagcgagggccgcggagaugggcgccucuggugcgcuaccaccucgaacuuugacagcgacaagaaguggggcuucugcccggaccaaggauacaguuuguuccucguggcggcgcaugaguucggccacgcgcugggcuuagaucauuccucagugccggaggcgcucauguacccuauguaccgcuucacugaggggccccccuugcauaaggacgacgugaauggcauccggcaccucuaugguccucgcccugaaccugagccacggccuccaaccaccaccacaccgcagcccacggcucccccgacggucugccccaccggaccccccacuguccaccccucagagcgccccacagcuggccccacagguccccccucagcuggccccacagguccccccacugcuggcccuucuacggccacuacugugccuuugaguccgguggacgaugccugcaacgugaacaucuucgacgccaucgcggagauugggaaccagcuguauuuguucaaggaugggaaguacuggcgauucucugagggcagggggagccggccgcagggccccuuccuuaucgccgacaaguggcccgcgcugccccgcaagcuggacucggucuuugaggagcggcucuccaagaagcuuuucuucuucucugggcgccagguguggguguacacaggcgcgucggugcugggcccgaggcgucuggacaagcugggccugggagccgacguggcccaggugaccggggcccuccggaguggcagggggaagaugcugcuguucagcgggcggcgccucuggagguucgacgugaaggcgcagaugguggauccccggagcgccagcgagguggaccggauguuccccggggugccuuuggacacgcacgacgucuuccaguaccgagagaaagccuauuucugccaggaccgcuucuacuggcgcgugaguucccggagugaguugaaccagguggaccaagugggcuacgugaccuaugacauccugcagugcccugaggacuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1464 - RNA, 1633 nt, Artificial Sequence
  mRNA product Design1 comprising derived and/or modified sequence from Homo sapiens__NP_002418.1__HsMMP13 (wt)
gggagaaagcuuaccaugcauccagggguccuggcugccuuccucuucuugagcuggacucauugucgggcccugccccuucccagugguggugaugaagaugauuugucugaggaagaccuccaguuugcagagcgcuaccugagaucauacuaccauccuacaaaucucgcgggaauccugaaggagaaugcagcaagcuccaugacugagaggcuccgagaaaugcagucuuucuucggcuuagaggugacuggcaaacuugacgauaacaccuuagaugucaugaaaaagccaagaugcgggguuccugaugugggugaauacaauguuuucccucgaacucuuaaaugguccaaaaugaauuuaaccuacagaauugugaauuacaccccugauaugacucauucugaagucgaaaaggcauucaaaaaagccuucaaaguuugguccgauguaacuccucugaauuuuaccagacuucacgauggcauugcugacaucaugaucucuuuuggaauuaaggagcauggcgacuucuacccauuugaugggcccucuggccugcuggcucaugcuuuuccuccugggccaaauuauggaggagaugcccauuuugaugaugaugaaaccuggacaaguaguuccaaaggcuacaacuuguuucuuguugcugcgcaugaguucggccacuccuuaggucuugaccacuccaaggacccuggagcacucauguuuccuaucuacaccuacaccggcaaaagccacuuuaugcuuccugaugacgauguacaagggauccagucucucuaugguccaggagaugaagaccccaacccuaaacauccaaaaacgccagacaaaugugacccuuccuuaucccuugaugccauuaccagucuccgaggagaaacaaugaucuuuaaagacagauucuucuggcgccugcauccucagcagguugaugcggagcuguuuuuaacgaaaucauuuuggccagaacuucccaaccguauugaugcugcauaugagcacccuucucaugaccucaucuucaucuucagagguagaaaauuuugggcucuuaaugguuaugacauucuggaagguuaucccaaaaaaauaucugaacugggucuuccaaaagaaguuaagaagauaagugcagcuguucacuuugaggauacaggcaagacucuccuguucucaggaaaccaggucuggagauaugaugauacuaaccauauuauggauaaagacuauccgagacuaauagaagaagacuucccaggaauuggugauaaaguagaugcugucuaugagaaaaaugguuauaucuauuuuuucaacggacccauacaguuugaauacagcaucuggaguaaccguauuguucgcgucaugccagcaaauuccauuuugugguguuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1465 - RNA, 1285 nt, Artificial Sequence
  mRNA product Design1 comprising derived and/or modified sequence from Homo sapiens__NP_001286.1__HsCCR1 (wt)
gggagaaagcuuaccauggaaacuccaaacaccacagaggacuaugacacgaccacagaguuugacuauggggaugcaacuccgugccagaaggugaacgagagggccuuuggggcccaacugcugcccccucuguacuccuugguauuugucauuggccugguuggaaacauccuggugguccugguccuugugcaauacaagaggcuaaaaaacaugaccagcaucuaccuccugaaccuggccauuucugaccugcucuuccuguucacgcuucccuucuggaucgacuacaaguugaaggaugacuggguuuuuggugaugccauguguaagauccucucuggguuuuauuacacaggcuuguacagcgagaucuuuuucaucauccugcugacgauugacagguaccuggccaucguccacgccguguuugccuugcgggcacggaccgucacuuuuggugucaucaccagcaucaucauuugggcccuggccaucuuggcuuccaugccaggcuuauacuuuuccaagacccaaugggaauucacucaccacaccugcagccuucacuuuccucacgaaagccuacgagaguggaagcuguuucaggcucugaaacugaaccucuuugggcugguauugccuuuguuggucaugaucaucugcuacacagggauuauaaagauucugcuaagacgaccaaaugagaagaaauccaaagcuguccguuugauuuuugucaucaugaucaucuuuuuucucuuuuggacccccuacaauuugacuauacuuauuucuguuuuccaagacuuccuguucacccaugagugugagcagagcagacauuuggaccuggcugugcaagugacggaggugaucgccuacacgcacugcugugucaacccagugaucuacgccuucguuggugagagguuccggaaguaccugcggcaguuguuccacaggcguguggcugugcaccugguuaaauggcuccccuuccucuccguggacaggcuggagagggucagcuccacaucucccuccacaggggagcaugaacucucugcuggguucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1466 - RNA, 853 nt, Artificial Sequence
  mRNA product Design1 comprising derived and/or modified sequence from Homo sapiens__NP_002598.4__HsPDGFA (wt)
gggagaaagcuuaccaugaggaccuuggcuugccugcugcuccucggcugcggauaccucgcccauguucuggccgaggaagccgagaucccccgcgaggugaucgagaggcuggcccgcagucagauccacagcauccgggaccuccagcgacuccuggagauagacuccguagggagugaggauucuuuggacaccagccugagagcucacgggguccaugccacuaagcaugugcccgagaagcggccccugcccauucggaggaagagaagcaucgaggaagcuguccccgcugucugcaagaccaggacggucauuuacgagauuccucggagucaggucgaccccacguccgccaacuuccugaucuggcccccgugcguggaggugaaacgcugcaccggcugcugcaacacgagcagugucaagugccagcccucccgcguccaccaccgcagcgucaagguggccaagguggaauacgucaggaagaagccaaaauuaaaagaaguccaggugagguuagaggagcauuuggagugcgccugcgcgaccacaagccugaauccggauuaucgggaagaggacacgggaaggccuagggagucagguaaaaaacggaaaagaaaaagguuaaaacccaccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1467 - RNA, 943 nt, Artificial Sequence
  mRNA product Design1 comprising derived and/or modified sequence from Homo sapiens__NP_002599.1__HsPDGFB (wt)
gggagaaagcuuaccaugaaucgcugcugggcgcucuuccugucucucugcugcuaccugcgucuggucagcgccgagggggaccccauucccgaggagcuuuaugagaugcugagugaccacucgauccgcuccuuugaugaucuccaacgccugcugcacggagaccccggagaggaagauggggccgaguuggaccugaacaugacccgcucccacucuggaggcgagcuggagagcuuggcucguggaagaaggagccuggguucccugaccauugcugagccggccaugaucgccgagugcaagacgcgcaccgagguguucgagaucucccggcgccucauagaccgcaccaacgccaacuuccugguguggccgcccuguguggaggugcagcgcugcuccggcugcugcaacaaccgcaacgugcagugccgccccacccaggugcagcugcgaccuguccaggugagaaagaucgagauugugcggaagaagccaaucuuuaagaaggccacggugacgcuggaagaccaccuggcaugcaagugugagacaguggcagcugcacggccugugacccgaagcccgggggguucccaggagcagcgagccaaaacgccccaaacucgggugaccauucggacggugcgaguccgccggccccccaagggcaagcaccggaaauucaagcacacgcaugacaagacggcacugaaggagacccuuggagccuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1468 - RNA, 1255 nt, Artificial Sequence
  mRNA product Design1 comprising derived and/or modified sequence from Homo sapiens__NP_057289.1__HsPDGFC (wt)
gggagaaagcuuaccaugagccucuucgggcuucuccugcugacaucugcccuggccggccagagacaggggacucaggcggaauccaaccugaguaguaaauuccaguuuuccagcaacaaggaacagaacggaguacaagauccucagcaugagagaauuauuacugugucuacuaauggaaguauucacagcccaagguuuccucauacuuauccaagaaauacggucuugguauggagauuaguagcaguagaggaaaauguauggauacaacuuacguuugaugaaagauuugggcuugaagacccagaagaugacauaugcaaguaugauuuuguagaaguugaggaacccagugauggaacuauauuagggcgcuggugugguucugguacuguaccaggaaaacagauuucuaaaggaaaucaaauuaggauaagauuuguaucugaugaauauuuuccuucugaaccaggguucugcauccacuacaacauugucaugccacaauucacagaagcugugaguccuucagugcuacccccuucagcuuugccacuggaccugcuuaauaaugcuauaacugccuuuaguaccuuggaagaccuuauucgauaucuugaaccagagagauggcaguuggacuuagaagaucuauauaggccaacuuggcaacuucuuggcaaggcuuuuguuuuuggaagaaaauccagagugguggaucugaaccuucuaacagaggagguaagauuauacagcugcacaccucguaacuucucaguguccauaagggaagaacuaaagagaaccgauaccauuuucuggccagguugucuccugguuaaacgcuguggugggaacugugccuguugucuccacaauugcaaugaaugucaaugugucccaagcaaaguuacuaaaaaauaccacgagguccuucaguugagaccaaagaccggugucaggggauugcacaaaucacucaccgacguggcccuggagcaccaugaggagugugacugugugugcagagggagcacaggaggauagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1469 - RNA, 1312 nt, Artificial Sequence
  mRNA product Design1 comprising derived and/or modified sequence from Homo sapiens__NP_149126.1__HsPDGFD (wt)
gggagaaagcuuaccaugcaccggcucaucuuugucuacacucuaaucugcgcaaacuuuugcagcugucgggacacuucugcaaccccgcagagcgcauccaucaaagcuuugcgcaacgccaaccucaggcgagaugacuuguaccgaagagaugagaccauccaggugaaaggaaacggcuacgugcagaguccuagauucccgaacagcuaccccaggaaccugcuccugacauggcggcuucacucucaggagaauacacggauacagcuaguguuugacaaucaguuuggauuagaggaagcagaaaaugauaucuguagguaugauuuuguggaaguugaagauauauccgaaaccaguaccauuauuagaggacgaugguguggacacaaggaaguuccuccaaggauaaaaucaagaacgaaccaaauuaaaaucacauucaaguccgaugacuacuuuguggcuaaaccuggauucaagauuuauuauucuuugcuggaagauuuccaacccgcagcagcuucagagaccaacugggaaucugucacaagcucuauuucagggguauccuauaacucuccaucaguaacggaucccacucugauugcggaugcucuggacaaaaaaauugcagaauuugauacaguggaagaucugcucaaguacuucaauccagagucauggcaagaagaucuugagaauauguaucuggacaccccucgguaucgaggcaggucauaccaugaccggaagucaaaaguugaccuggauaggcucaaugaugaugccaagcguuacaguugcacucccaggaauuacucggucaauauaagagaagagcugaaguuggccaauguggucuucuuuccacguugccuccucgugcagcgcuguggaggaaauuguggcuguggaacugucaacuggagguccugcacaugcaauucagggaaaaccgugaaaaaguaucaugagguauuacaguuugagccuggccacaucaagaggagggguagagcuaagaccauggcucuaguugacauccaguuggaucaccaugaacgaugugauuguaucugcagcucaagaccaccucgauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1470 - RNA, 895 nt, Artificial Sequence
  mRNA product Design1 comprising derived and/or modified sequence from Homo sapiens__NP_003946.3__HsSOCS3 (wt)
gggagaaagcuuaccauggucacccacagcaaguuucccgccgccgggaugagccgcccccuggacaccagccugcgccucaagaccuucagcuccaagagcgaguaccagcugguggugaacgcagugcgcaagcugcaggagagcggcuucuacuggagcgcagugaccggcggcgaggcgaaccugcugcucagugccgagcccgccggcaccuuucugauccgcgacagcucggaccagcgccacuucuucacgcucagcgucaagacccagucugggaccaagaaccugcgcauccagugugaggggggcagcuucucucugcagagcgauccccggagcacgcagcccgugccccgcuucgacugcgugcucaagcuggugcaccacuacaugccgcccccuggagcccccuccuuccccucgccaccuacugaacccuccuccgaggugcccgagcagccgucugcccagccacucccugggaguccccccagaagagccuauuacaucuacuccgggggcgagaagaucccccugguguugagccggccccucuccuccaacguggccacucuucagcaucucugucggaagaccgucaacggccaccuggacuccuaugagaaagucacccagcugccggggcccauucgggaguuccuggaccaguacgaugccccgcuuuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1471 - RNA, 700 nt, Artificial Sequence
  mRNA product Design1 comprising derived and/or modified sequence from Homo sapiens__NP_003227.1__HsTGFA (wt)
gggagaaagcuuaccaugguccccucggcuggacagcucgcccuguucgcucuggguauuguguuggcugcgugccaggccuuggagaacagcacguccccgcugagugcagacccgcccguggcugcagcaguggugucccauuuuaaugacugcccagauucccacacucaguucugcuuccauggaaccugcagguuuuuggugcaggaggacaagccagcaugugucugccauucuggguacguuggugcacgcugugagcaugcggaccuccuggccgugguggcugccagccagaagaagcaggccaucaccgccuuggugguggucuccaucguggcccuggcuguccuuaucaucacaugugugcugauacacugcugccagguccgaaaacacugugaguggugccgggcccucaucugccggcacgagaagcccagcgcccuccugaagggaagaaccgcuugcugccacucagaaacaguggucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1472 - RNA, 1390 nt, Artificial Sequence
  mRNA product Design1 comprising derived and/or modified sequence from Homo sapiens__NP_000651.3__HsTGFB1 (wt)
gggagaaagcuuaccaugccgcccuccgggcugcggcugcugccgcugcugcuaccgcugcuguggcuacuggugcugacgccuggccggccggccgcgggacuauccaccugcaagacuaucgacauggagcuggugaagcggaagcgcaucgaggccauccgcggccagauccuguccaagcugcggcucgccagccccccgagccagggggaggugccgcccggcccgcugcccgaggccgugcucgcccuguacaacagcacccgcgaccggguggccggggagagugcagaaccggagcccgagccugaggccgacuacuacgccaaggaggucacccgcgugcuaaugguggaaacccacaacgaaaucuaugacaaguucaagcagaguacacacagcauauauauguucuucaacacaucagagcuccgagaagcgguaccugaacccguguugcucucccgggcagagcugcgucugcugaggcucaaguuaaaaguggagcagcacguggagcuguaccagaaauacagcaacaauuccuggcgauaccucagcaaccggcugcuggcacccagcgacucgccagagugguuaucuuuugaugucaccggaguugugcggcagugguugagccguggaggggaaauugagggcuuucgccuuagcgcccacugcuccugugacagcagggauaacacacugcaaguggacaucaacggguucacuaccggccgccgaggugaccuggccaccauucauggcaugaaccggccuuuccugcuucucauggccaccccgcuggagagggcccagcaucugcaaagcucccggcaccgccgagcccuggacaccaacuauugcuucagcuccacggagaagaacugcugcgugcggcagcuguacauugacuuccgcaaggaccucggcuggaaguggauccacgagcccaagggcuaccaugccaacuucugccucgggcccugccccuacauuuggagccuggacacgcaguacagcaagguccuggcccuguacaaccagcauaacccgggcgccucggcggcgccgugcugcgugccgcaggcgcuggagccgcugcccaucguguacuacgugggccgcaagcccaagguggagcagcuguccaacaugaucgugcgcuccugcaagugcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1473 - RNA, 1462 nt, Artificial Sequence
  mRNA product Design1 comprising derived and/or modified sequence from Homo sapiens__NP_003229.1__HsTGFB2 (wt)
gggagaaagcuuaccaugcacuacugugugcugagcgcuuuucugauccugcaucuggucacggucgcgcucagccugucuaccugcagcacacucgauauggaccaguucaugcgcaagaggaucgaggcgauccgcgggcagauccugagcaagcugaagcucaccagucccccagaagacuauccugagcccgaggaaguccccccggaggugauuuccaucuacaacagcaccagggacuugcuccaggagaaggcgagccggagggcggccgccugcgagcgcgagaggagcgacgaagaguacuacgccaaggagguuuacaaaauagacaugccgcccuucuuccccuccgaaaaugccaucccgcccacuuucuacagacccuacuucagaauuguucgauuugacgucucagcaauggagaagaaugcuuccaauuuggugaaagcagaguucagagucuuucguuugcagaacccaaaagccagagugccugaacaacggauugagcuauaucagauucucaaguccaaagauuuaacaucuccaacccagcgcuacaucgacagcaaaguugugaaaacaagagcagaaggcgaauggcucuccuucgauguaacugaugcuguucaugaauggcuucaccauaaagacaggaaccugggauuuaaaauaagcuuacacugucccugcugcacuuuuguaccaucuaauaauuacaucaucccaaauaaaagugaagaacuagaagcaagauuugcagguauugauggcaccuccacauauaccaguggugaucagaaaacuauaaaguccacuaggaaaaaaaacagugggaagaccccacaucuccugcuaauguuauugcccuccuacagacuugagucacaacagaccaaccggcggaagaagcgugcuuuggaugcggccuauugcuuuagaaaugugcaggauaauugcugccuacguccacuuuacauugauuucaagagggaucuaggguggaaauggauacacgaacccaaaggguacaaugccaacuucugugcuggagcaugcccguauuuauggaguucagacacucagcacagcaggguccugagcuuauauaauaccauaaauccagaagcaucugcuucuccuugcugcgugucccaagauuuagaaccucuaaccauucucuacuacauuggcaaaacacccaagauugaacagcuuucuaauaugauuguaaagucuugcaaaugcagcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1474 - RNA, 1456 nt, Artificial Sequence
  mRNA product Design1 comprising derived and/or modified sequence from Homo sapiens__NP_003230.1__HsTGFB3 (wt)
gggagaaagcuuaccaugaagaugcacuugcaaagggcucuggugguccuggcccugcugaacuuugccacggucagccucucucuguccacuugcaccaccuuggacuucggccacaucaagaagaagaggguggaagccauuaggggacagaucuugagcaagcucaggcucaccagccccccugagccaacggugaugacccacguccccuaucagguccuggcccuuuacaacagcacccgggagcugcuggaggagaugcauggggagagggaggaaggcugcacccaggaaaacaccgagucggaauacuaugccaaagaaauccauaaauucgacaugauccaggggcuggcggagcacaacgaacuggcugucugcccuaaaggaauuaccuccaagguuuuccgcuucaauguguccucaguggagaaaaauagaaccaaccuauuccgagcagaauuccgggucuugcgggugcccaaccccagcucuaagcggaaugagcagaggaucgagcucuuccagauccuucggccagaugagcacauugccaaacagcgcuauaucgguggcaagaaucugcccacacggggcacugccgaguggcuguccuuugaugucacugacacugugcgugaguggcuguugagaagagaguccaacuuaggucuagaaaucagcauucacuguccaugucacaccuuucagcccaauggagauauccuggaaaacauucacgaggugauggaaaucaaauucaaaggcguggacaaugaggaugaccauggccguggagaucuggggcgccucaagaagcagaaggaucaccacaacccucaucuaauccucaugaugauucccccacaccggcucgacaacccgggccaggggggucagaggaagaagcgggcuuuggacaccaauuacugcuuccgcaacuuggaggagaacugcugugugcgcccccucuacauugacuuccgacaggaucugggcuggaaguggguccaugaaccuaagggcuacuaugccaacuucugcucaggcccuugcccauaccuccgcagugcagacacaacccacagcacggugcugggacuguacaacacucugaacccugaagcaucugccucgccuugcugcgugccccaggaccuggagccccugaccauccuguacuauguugggaggacccccaaaguggagcagcucuccaacaugguggugaagucuuguaaauguagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1475 - RNA, 1603 nt, Artificial Sequence
  mRNA product Design1 comprising derived and/or modified sequence from Homo sapiens__NP_001057.1__HsTNFRSF1B (wt)
gggagaaagcuuaccauggcgcccgucgccgucugggccgcgcuggccgucggacuggagcucugggcugcggcgcacgccuugcccgcccagguggcauuuacacccuacgccccggagcccgggagcacaugccggcucagagaauacuaugaccagacagcucagaugugcugcagcaaaugcucgccgggccaacaugcaaaagucuucuguaccaagaccucggacaccgugugugacuccugugaggacagcacauacacccagcucuggaacuggguucccgagugcuugagcuguggcucccgcuguagcucugaccagguggaaacucaagccugcacucgggaacagaaccgcaucugcaccugcaggcccggcugguacugcgcgcugagcaagcaggaggggugccggcugugcgcgccgcugcgcaagugccgcccgggcuucggcguggccagaccaggaacugaaacaucagacguggugugcaagcccugugccccggggacguucuccaacacgacuucauccacggauauuugcaggccccaccagaucuguaacgugguggccaucccugggaaugcaagcauggaugcagucugcacguccacgucccccacccggaguauggccccaggggcaguacacuuaccccagccaguguccacacgaucccaacacacgcagccaacuccagaacccagcacugcuccaagcaccuccuuccugcucccaaugggccccagccccccagcugaagggagcacuggcgacuucgcucuuccaguuggacugauugugggugugacagccuugggucuacuaauaauaggaguggugaacugugucaucaugacccaggugaaaaagaagcccuugugccugcagagagaagccaaggugccucacuugccugccgauaaggcccgggguacacagggccccgagcagcagcaccugcugaucacagcgccgagcuccagcagcagcucccuggagagcucggccagugcguuggacagaagggcgcccacucggaaccagccacaggcaccaggcguggaggccaguggggccggggaggcccgggccagcaccgggagcucagauucuuccccugguggccaugggacccaggucaaugucaccugcaucgugaacgucuguagcagcucugaccacagcucacagugcuccucccaagccagcuccacaaugggagacacagauuccagccccucggaguccccgaaggacgagcagguccccuucuccaaggaggaaugugccuuucggucacagcuggagacgccagagacccugcuggggagcaccgaagagaagccccugccccuuggagugccugaugcugggaugaagcccaguuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1476 - RNA, 730 nt, Artificial Sequence
  mRNA product Design1 comprising derived and/or modified sequence from Homo sapiens__NP_002623.2__HsPGF (wt)
gggagaaagcuuaccaugccggucaugaggcuguucccuugcuuccugcagcuccuggccgggcuggcgcugccugcugugcccccccagcagugggccuugucugcugggaacggcucgucagagguggaagugguacccuuccaggaaguguggggccgcagcuacugccgggcgcuggagaggcugguggacgucguguccgaguaccccagcgagguggagcacauguucagcccauccugugucucccugcugcgcugcaccggcugcugcggcgaugagaaucugcacugugugccgguggagacggccaaugucaccaugcagcuccuaaagauccguucuggggaccggcccuccuacguggagcugacguucucucagcacguucgcugcgaaugccggccucugcgggagaagaugaagccggaaaggaggagacccaagggcagggggaagaggaggagagagaagcagagacccacagacugccaccugugcggcgaugcuguuccccggagguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1477 - RNA, 1456 nt, Artificial Sequence
  mRNA product Design1 comprising derived and/or modified sequence from Homo sapiens__NP_001020537.2__HsVEGFA (wt)
gggagaaagcuuaccaugacggacagacagacagacaccgcccccagccccagcuaccaccuccuccccggccggcggcggacaguggacgcggcggcgagccgcgggcaggggccggagcccgcgcccggaggcgggguggagggggucggggcucgcggcgucgcacugaaacuuuucguccaacuucugggcuguucucgcuucggaggagccgugguccgcgcgggggaagccgagccgagcggagccgcgagaagugcuagcucgggccgggaggagccgcagccggaggagggggaggaggaagaagagaaggaagaggagagggggccgcaguggcgacucggcgcucggaagccgggcucauggacgggugaggcggcggugugcgcagacagugcuccagccgcgcgcgcuccccaggcccuggcccgggccucgggccggggaggaagaguagcucgccgaggcgccgaggagagcgggccgccccacagcccgagccggagagggagcgcgagccgcgccggccccggucgggccuccgaaaccaugaacuuucugcugucuugggugcauuggagccuugccuugcugcucuaccuccaccaugccaaguggucccaggcugcacccauggcagaaggaggagggcagaaucaucacgaaguggugaaguucauggaugucuaucagcgcagcuacugccauccaaucgagacccugguggacaucuuccaggaguacccugaugagaucgaguacaucuucaagccauccugugugccccugaugcgaugcgggggcugcugcaaugacgagggccuggagugugugcccacugaggaguccaacaucaccaugcagauuaugcggaucaaaccucaccaaggccagcacauaggagagaugagcuuccuacagcacaacaaaugugaaugcagaccaaagaaagauagagcaagacaagaaaaaaaaucaguucgaggaaagggaaaggggcaaaaacgaaagcgcaagaaaucccgguauaaguccuggagcguguacguuggugcccgcugcugucuaaugcccuggagccucccuggcccccaucccugugggccuugcucagagcggagaaagcauuuguuuguacaagauccgcagacguguaaauguuccugcaaaaacacagacucgcguugcaaggcgaggcagcuugaguuaaacgaacguacuugcagaugugacaagccgaggcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1478 - RNA, 916 nt, Artificial Sequence
  mRNA product Design1 comprising derived and/or modified sequence from Homo sapiens__NP_001165094.1__HsVEGFA (wt)
gggagaaagcuuaccaugaacuuucugcugucuugggugcauuggagccuugccuugcugcucuaccuccaccaugccaaguggucccaggcugcacccauggcagaaggaggagggcagaaucaucacgaaguggugaaguucauggaugucuaucagcgcagcuacugccauccaaucgagacccugguggacaucuuccaggaguacccugaugagaucgaguacaucuucaagccauccugugugccccugaugcgaugcgggggcugcugcaaugacgagggccuggagugugugcccacugaggaguccaacaucaccaugcagauuaugcggaucaaaccucaccaaggccagcacauaggagagaugagcuuccuacagcacaacaaaugugaaugcagaccaaagaaagauagagcaagacaagaaaaaaaaucaguucgaggaaagggaaaggggcaaaaacgaaagcgcaagaaaucccgguauaaguccuggagcguguacguuggugcccgcugcugucuaaugcccuggagccucccuggcccccaucccugugggccuugcucagagcggagaaagcauuuguuuguacaagauccgcagacguguaaauguuccugcaaaaacacagacucgcguugcaaggcgaggcagcuugaguuaaacgaacguacuugcagaugugacaagccgaggcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1479 - RNA, 841 nt, Artificial Sequence
  mRNA product Design1 comprising derived and/or modified sequence from Homo sapiens__NP_003368.1__HsVEGFB (wt)
gggagaaagcuuaccaugagcccucugcuccgccgccugcugcucgccgcacuccugcagcuggcccccgcccaggccccugucucccagccugaugccccuggccaccagaggaaaguggugucauggauagauguguauacucgcgcuaccugccagccccgggaggugguggugcccuugacuguggagcucaugggcaccguggccaaacagcuggugcccagcugcgugacugugcagcgcugugguggcugcugcccugacgauggccuggagugugugcccacugggcagcaccaaguccggaugcagauccucaugauccgguacccgagcagucagcugggggagaugucccuggaagaacacagccagugugaaugcagaccuaaaaaaaaggacagugcugugaagccagacagggcugccacuccccaccaccguccccagccccguucuguuccgggcugggacucugcccccggagcacccuccccagcugacaucacccaucccacuccagccccaggccccucugcccacgcugcacccagcaccaccagcgcccugacccccggaccugccgcugccgcugccgacgccgcagcuuccuccguugccaagggcggggcuuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1480 - RNA, 1477 nt, Artificial Sequence
  mRNA product Design1 comprising derived and/or modified sequence from Homo sapiens__NP_005420.1__HsVEGFC (wt)
gggagaaagcuuaccaugcacuugcugggcuucuucucuguggcguguucucugcucgccgcugcgcugcucccggguccucgcgaggcgcccgccgccgccgccgccuucgaguccggacucgaccucucggacgcggagcccgacgcgggcgaggccacggcuuaugcaagcaaagaucuggaggagcaguuacggucuguguccaguguagaugaacucaugacuguacucuacccagaauauuggaaaauguacaagugucagcuaaggaaaggaggcuggcaacauaacagagaacaggccaaccucaacucaaggacagaagagacuauaaaauuugcugcagcacauuauaauacagagaucuugaaaaguauugauaaugaguggagaaagacucaaugcaugccacgggagguguguauagauguggggaaggaguuuggagucgcgacaaacaccuucuuuaaaccuccauguguguccgucuacagauguggggguugcugcaauagugaggggcugcagugcaugaacaccagcacgagcuaccucagcaagacguuauuugaaauuacagugccucucucucaaggccccaaaccaguaacaaucaguuuugccaaucacacuuccugccgaugcaugucuaaacuggauguuuacagacaaguucauuccauuauuagacguucccugccagcaacacuaccacagugucaggcagcgaacaagaccugccccaccaauuacauguggaauaaucacaucugcagaugccuggcucaggaagauuuuauguuuuccucggaugcuggagaugacucaacagauggauuccaugacaucuguggaccaaacaaggagcuggaugaagagaccugucagugugucugcagagcggggcuucggccugccagcuguggaccccacaaagaacuagacagaaacucaugccagugugucuguaaaaacaaacucuuccccagccaauguggggccaaccgagaauuugaugaaaacacaugccaguguguauguaaaagaaccugccccagaaaucaaccccuaaauccuggaaaaugugccugugaauguacagaaaguccacagaaaugcuuguuaaaaggaaagaaguuccaccaccaaacaugcagcuguuacagacggccauguacgaaccgccagaaggcuugugagccaggauuuucauauagugaagaagugugucguugugucccuucauauuggaaaagaccacaaaugagcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1481 - RNA, 1282 nt, Artificial Sequence
  mRNA product Design1 comprising derived and/or modified sequence from Homo sapiens__NP_004460.1__HsVEGFD (wt)
gggagaaagcuuaccauguacagagaguggguaguggugaauguuuucaugauguuguacguccagcuggugcagggcuccaguaaugaacauggaccagugaagcgaucaucucaguccacauuggaacgaucugaacagcagaucagggcugcuucuaguuuggaggaacuacuucgaauuacucacucugaggacuggaagcuguggagaugcaggcugaggcucaaaaguuuuaccaguauggacucucgcucagcaucccaucgguccacuagguuugcggcaacuuucuaugacauugaaacacuaaaaguuauagaugaagaauggcaaagaacucagugcagcccuagagaaacgugcguggagguggccagugagcuggggaagaguaccaacacauucuucaagcccccuugugugaacguguuccgaugugguggcuguugcaaugaagagagccuuaucuguaugaacaccagcaccucguacauuuccaaacagcucuuugagauaucagugccuuugacaucaguaccugaauuagugccuguuaaaguugccaaucauacagguuguaagugcuugccaacagccccccgccauccauacucaauuaucagaagauccauccagaucccugaagaagaucgcuguucccauuccaagaaacucuguccuauugacaugcuaugggauagcaacaaauguaaauguguuuugcaggaggaaaauccacuugcuggaacagaagaccacucucaucuccaggaaccagcucucugugggccacacaugauguuugacgaagaucguugcgagugugucuguaaaacaccaugucccaaagaucuaauccagcaccccaaaaacugcaguugcuuugagugcaaagaaagucuggagaccugcugccagaagcacaagcuauuucacccagacaccugcagcugugaggacagaugccccuuucauaccagaccaugugcaaguggcaaaacagcaugugcaaagcauugccgcuuuccaaaggagaaaagggcugcccaggggccccacagccgaaagaauccuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1482 - RNA, 847 nt, Artificial Sequence
  mRNA product Design1 comprising derived and/or modified sequence from Homo sapiens__NP_061986.1__HsFGF21 (opt1)
gggagaaagcuuaccauggacagcgacgagaccggcuucgagcacuccgggcugugggugagcguccucgccggccugcugcucggggccugccaggcccaccccaucccggacuccagcccccugcugcaguucggcggccaggugcgccagcgguaccucuacaccgacgacgcccagcagacggaggcccaccuggagauccgcgaggacgggaccgugggcggggccgccgaccagucccccgagagccugcuccagcugaaggcgcugaagcccggcgucauccagauccucggggugaagaccucccgguuccugugccagcgcccggacggcgcccuguacgggagccuccacuucgaccccgaggccugcuccuuccgggagcugcugcucgaggacggcuacaacguguaccagagcgaggcccacggccugccccugcaccuccccgggaacaaguccccgcaccgcgaccccgcgccccggggccccgcccgcuuccugccgcugcccgggcucccgcccgcccugcccgagccgcccggcauccuggcgccccagccgcccgacgucggcagcuccgacccccucagcaugguggggcccucccagggccggagccccuccuacgccagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1483 - RNA, 1627 nt, Artificial Sequence
  mRNA product Design1 comprising derived and/or modified sequence from Homo sapiens__NP_002412.1__HsMMP1 (opt1)
gggagaaagcuuaccaugcacagcuucccgccccugcuccugcugcucuucuggggcguggucucccacagcuuccccgccacccuggagacccaggagcaggacguggaccuggugcagaaguaccucgagaaguacuacaaccugaagaacgacgggcgccaggucgagaagcggcgcaacuccggccccgugguggagaagcugaagcagaugcaggaguucuucgggcucaaggucacgggcaagcccgacgccgagacccugaaggugaugaagcagccgcggugcggggugcccgacgucgcgcaguucgugcugaccgagggcaacccccgcugggagcagacccaccucacguaccggaucgagaacuacacccccgaccugccgcgcgccgacguggaccacgccaucgagaaggccuuccagcuguggagcaacgucaccccgcucaccuucacgaagguguccgagggccaggccgacaucaugaucagcuucgugcggggcgaccaccgcgacaacucccccuucgacgggcccgggggcaaccuggcgcacgccuuccagccggggcccggcaucggcggggacgcccacuucgacgaggacgagcgguggaccaacaacuuccgcgaguacaaccugcaccgggucgccgcgcacgagcucggccacagccuggggcugucccacagcaccgacaucggcgcccucauguaccccuccuacaccuucagcggcgacgugcagcuggcccaggacgacaucgacgggauccaggccaucuacggccgcucccagaaccccgugcagccgaucgggccccagacgcccaaggccugcgacagcaagcugaccuucgacgcgaucaccaccauccggggcgaggucauguucuucaaggaccgcuucuacaugcggacgaaccccuucuacccggagguggagcucaacuucaucuccguguucuggccccagcugcccaacgggcuggaggccgccuacgaguucgccgaccgcgacgagguccgguucuucaagggcaacaaguacugggccgugcagggccagaacgugcuccacggguaccccaaggacaucuacagcuccuucggcuucccgcgcaccgucaagcacaucgacgcggcccugagcgaggagaacaccgggaagaccuacuucuucguggccaacaaguacuggcgguacgacgaguacaagcgcuccauggaccccggcuaccccaagaugaucgcccacgacuuccccgggaucggccacaaggucgacgccguguucaugaaggacggcuucuucuacuucuuccacgggacgcggcaguacaaguucgacccgaagaccaagcgcauccugacccuccagaaggcgaacagcugguucaacugccgcaagaacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1484 - RNA, 1387 nt, Artificial Sequence
  mRNA product Design1 comprising derived and/or modified sequence from Homo sapiens__NP_002412.1__HsMMP1(1-19,100-469) (opt1)
gggagaaagcuuaccaugcacagcuucccgccccugcuccugcugcucuucuggggcguggucucccacagcuucgugcugaccgagggcaacccccgcugggagcagacccaccucacguaccggaucgagaacuacacccccgaccugccgcgcgccgacguggaccacgccaucgagaaggccuuccagcuguggagcaacgucaccccgcucaccuucacgaagguguccgagggccaggccgacaucaugaucagcuucgugcggggcgaccaccgcgacaacucccccuucgacgggcccgggggcaaccuggcgcacgccuuccagccggggcccggcaucggcggggacgcccacuucgacgaggacgagcgguggaccaacaacuuccgcgaguacaaccugcaccgggucgccgcgcacgagcucggccacagccuggggcugucccacagcaccgacaucggcgcccucauguaccccuccuacaccuucagcggcgacgugcagcuggcccaggacgacaucgacgggauccaggccaucuacggccgcucccagaaccccgugcagccgaucgggccccagacgcccaaggccugcgacagcaagcugaccuucgacgcgaucaccaccauccggggcgaggucauguucuucaaggaccgcuucuacaugcggacgaaccccuucuacccggagguggagcucaacuucaucuccguguucuggccccagcugcccaacgggcuggaggccgccuacgaguucgccgaccgcgacgagguccgguucuucaagggcaacaaguacugggccgugcagggccagaacgugcuccacggguaccccaaggacaucuacagcuccuucggcuucccgcgcaccgucaagcacaucgacgcggcccugagcgaggagaacaccgggaagaccuacuucuucguggccaacaaguacuggcgguacgacgaguacaagcgcuccauggaccccggcuaccccaagaugaucgcccacgacuuccccgggaucggccacaaggucgacgccguguucaugaaggacggcuucuucuacuucuuccacgggacgcggcaguacaaguucgacccgaagaccaagcgcauccugacccuccagaaggcgaacagcugguucaacugccgcaagaacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1485 - RNA, 3574 nt, Artificial Sequence
  mRNA product Design1 comprising derived and/or modified sequence from Clostridium histolyticum__BAA77453.1__ColG (opt1)
gggagaaagcuuaccaugaagaagaacauccugaagauccucauggacagcuacuccaaggagagcaagauccagaccgugcgccgggucaccuccgugagccugcuggccguguaccucacgaugaacaccuccagccugguccuggccaagcccaucgagaacaccaacgacaccuccaucaagaacguggagaagcuccgcaacgcgcccaacgaggagaacagcaagaagguggaggacuccaagaacgacaaggucgagcacgugaagaacaucgaggaggccaagguggagcaggucgcccccgaggugaagagcaaguccacgcugcggagcgccuccaucgccaacaccaacagcgagaaguacgacuucgaguaccugaacggccucuccuacaccgagcugaccaaccugaucaagaacaucaaguggaaccagaucaacgggcucuucaacuacagcacgggcucccagaaguucuucggggacaagaaccgcgugcaggcgaucaucaacgcccugcaggagagcggccggaccuacaccgccaacgacaugaaggggaucgagaccuucacggagguccugcgcgccggcuucuaccucggcuacuacaacgacgggcuguccuaccugaacgaccggaacuuccaggacaagugcauccccgcgaugaucgccauccagaagaaccccaacuucaagcucggcaccgccgugcaggacgaggugaucaccagccuggggaagcugaucggcaacgccagcgccaacgcggaggucgugaacaacugcgugccgguccucaagcaguuccgcgagaaccugaaccaguacgcccccgacuacgugaaggggaccgccgugaacgagcugaucaagggcaucgaguucgacuucuccggcgccgccuacgagaaggacgucaagacgaugcccugguacgggaagaucgaccccuucaucaacgagcucaaggcgcugggccuguacgggaacaucaccagcgccaccgagugggccuccgacgugggcaucuacuaccucagcaaguucggccuguacuccaccaaccggaacgacaucgugcagagccuggagaaggccgucgacauguacaaguacgggaagaucgccuucguggcgauggagcgcaucacgugggacuacgacggcaucggguccaacggcaagaaggucgaccacgacaaguuccucgacgacgccgagaagcacuaccugccgaagaccuacaccuucgacaacgggaccuucaucauccgggccggcgacaaggugagcgaggagaagaucaagcgccuguacugggccucccgggaggugaagagccaguuccaccgcgucgugggcaacgacaaggcccucgagguggggaacgcggacgacguccugacgaugaagaucuucaacucccccgaggaguacaaguucaacaccaacaucaacggcgugagcaccgacaacgggggccuguacaucgagccgcgggggaccuucuacacguacgagcgcaccccgcagcaguccaucuucagccucgaggagcuguuccggcacgaguacacccacuaccugcaggcccgcuaccucguggacggccuguggggccaggggccguucuacgagaagaaccggcugaccugguucgacgagggcacggccgaguucuucgccggguccacccgcaccagcggcguccucccccggaaguccauccugggguaccuggcgaaggacaagguggaccaccgcuacagccucaagaagacccugaacuccggcuacgacgacagcgacuggauguucuacaacuacggcuucgccguggcccacuaccuguacgagaaggacaugcccacguucaucaagaugaacaaggccauccugaacaccgacgucaagagcuacgacgagaucaucaagaagcucuccgacgacgccaacaagaacaccgaguaccagaaccacauccaggagcuggcggacaaguaccagggggccggcaucccccuggugagcgacgacuaccucaaggaccacggguacaagaaggccuccgagguguacagcgagaucuccaaggccgccagccugaccaacaccuccgucacggcggagaagagccaguacuucaacaccuucacccugcgcggcaccuacacgggcgagaccuccaagggggaguucaaggacugggacgagaugagcaagaagcucgacggcacccuggagucccuggccaagaacagcugguccggguacaagacccucacggccuacuucaccaacuaccgggugaccagcgacaacaaggugcaguacgacgucguguuccacggcgugcugaccgacaacgccgacaucuccaacaacaaggccccgaucgcgaaggucacggggcccagcaccggcgccgugggccgcaacaucgaguucuccgggaaggacagcaaggacgaggacggcaagaucgugagcuacgacugggacuucggggacggcgccaccucccgggggaagaacagcguccacgccuacaagaaggcgggcaccuacaacgugacgcugaaggugaccgacgacaagggcgccaccgccaccgaguccuucacgaucgagaucaagaacgaggacaccaccacccccaucacgaaggagauggagcccaacgacgacaucaaggaggccaacgggccgaucgucgagggcgugaccgugaagggggaccucaacggcagcgacgacgccgacaccuucuacuucgacgucaaggaggacggggacgugaccaucgagcugcccuacuccggcagcuccaacuucacguggcugguguacaaggagggcgacgaccagaaccacaucgcgagcgggaucgacaagaacaacuccaaggucggcaccuucaagagcaccaaggggcgccacuacguguucaucuacaagcacgacuccgccagcaacaucuccuacagccucaacaucaagggccuggggaacgagaagcugaaggagaaggagaacaacgacuccagcgacaaggccaccgugauccccaacuucaacacgaccaugcagggcucccuccugggcgacgacagccgggacuacuacuccuucgaggucaaggaggagggggaggugaacaucgagcuggacaagaaggacgaguucggcgugaccuggacccuccaccccgagagcaacaucaacgaccgcaucacguacgggcaggucgacggcaacaaggugagcaacaaggugaagcugcggccgggcaaguacuaccugcucgucuacaaguacuccgggagcggcaacuacgagcugcgcgugaacaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1486 - RNA, 3298 nt, Artificial Sequence
  mRNA product Design1 comprising derived and/or modified sequence from Clostridium histolyticum__BAA77453.1__HsALB(1-18)_ColG(111-1118) (opt1)
gggagaaagcuuaccaugaagugggugaccuucaucagccugcucuuccuguucuccagcgccuacuccaucgccaacaccaacagcgagaaguacgacuucgaguaccugaacggccucuccuacaccgagcugaccaaccugaucaagaacaucaaguggaaccagaucaacgggcucuucaacuacagcacgggcucccagaaguucuucggggacaagaaccgcgugcaggcgaucaucaacgcccugcaggagagcggccggaccuacaccgccaacgacaugaaggggaucgagaccuucacggagguccugcgcgccggcuucuaccucggcuacuacaacgacgggcuguccuaccugaacgaccggaacuuccaggacaagugcauccccgcgaugaucgccauccagaagaaccccaacuucaagcucggcaccgccgugcaggacgaggugaucaccagccuggggaagcugaucggcaacgccagcgccaacgcggaggucgugaacaacugcgugccgguccucaagcaguuccgcgagaaccugaaccaguacgcccccgacuacgugaaggggaccgccgugaacgagcugaucaagggcaucgaguucgacuucuccggcgccgccuacgagaaggacgucaagacgaugcccugguacgggaagaucgaccccuucaucaacgagcucaaggcgcugggccuguacgggaacaucaccagcgccaccgagugggccuccgacgugggcaucuacuaccucagcaaguucggccuguacuccaccaaccggaacgacaucgugcagagccuggagaaggccgucgacauguacaaguacgggaagaucgccuucguggcgauggagcgcaucacgugggacuacgacggcaucggguccaacggcaagaaggucgaccacgacaaguuccucgacgacgccgagaagcacuaccugccgaagaccuacaccuucgacaacgggaccuucaucauccgggccggcgacaaggugagcgaggagaagaucaagcgccuguacugggccucccgggaggugaagagccaguuccaccgcgucgugggcaacgacaaggcccucgagguggggaacgcggacgacguccugacgaugaagaucuucaacucccccgaggaguacaaguucaacaccaacaucaacggcgugagcaccgacaacgggggccuguacaucgagccgcgggggaccuucuacacguacgagcgcaccccgcagcaguccaucuucagccucgaggagcuguuccggcacgaguacacccacuaccugcaggcccgcuaccucguggacggccuguggggccaggggccguucuacgagaagaaccggcugaccugguucgacgagggcacggccgaguucuucgccggguccacccgcaccagcggcguccucccccggaaguccauccugggguaccuggcgaaggacaagguggaccaccgcuacagccucaagaagacccugaacuccggcuacgacgacagcgacuggauguucuacaacuacggcuucgccguggcccacuaccuguacgagaaggacaugcccacguucaucaagaugaacaaggccauccugaacaccgacgucaagagcuacgacgagaucaucaagaagcucuccgacgacgccaacaagaacaccgaguaccagaaccacauccaggagcuggcggacaaguaccagggggccggcaucccccuggugagcgacgacuaccucaaggaccacggguacaagaaggccuccgagguguacagcgagaucuccaaggccgccagccugaccaacaccuccgucacggcggagaagagccaguacuucaacaccuucacccugcgcggcaccuacacgggcgagaccuccaagggggaguucaaggacugggacgagaugagcaagaagcucgacggcacccuggagucccuggccaagaacagcugguccggguacaagacccucacggccuacuucaccaacuaccgggugaccagcgacaacaaggugcaguacgacgucguguuccacggcgugcugaccgacaacgccgacaucuccaacaacaaggccccgaucgcgaaggucacggggcccagcaccggcgccgugggccgcaacaucgaguucuccgggaaggacagcaaggacgaggacggcaagaucgugagcuacgacugggacuucggggacggcgccaccucccgggggaagaacagcguccacgccuacaagaaggcgggcaccuacaacgugacgcugaaggugaccgacgacaagggcgccaccgccaccgaguccuucacgaucgagaucaagaacgaggacaccaccacccccaucacgaaggagauggagcccaacgacgacaucaaggaggccaacgggccgaucgucgagggcgugaccgugaagggggaccucaacggcagcgacgacgccgacaccuucuacuucgacgucaaggaggacggggacgugaccaucgagcugcccuacuccggcagcuccaacuucacguggcugguguacaaggagggcgacgaccagaaccacaucgcgagcgggaucgacaagaacaacuccaaggucggcaccuucaagagcaccaaggggcgccacuacguguucaucuacaagcacgacuccgccagcaacaucuccuacagccucaacaucaagggccuggggaacgagaagcugaaggagaaggagaacaacgacuccagcgacaaggccaccgugauccccaacuucaacacgaccaugcagggcucccuccugggcgacgacagccgggacuacuacuccuucgaggucaaggaggagggggaggugaacaucgagcuggacaagaaggacgaguucggcgugaccuggacccuccaccccgagagcaacaucaacgaccgcaucacguacgggcaggucgacggcaacaaggugagcaacaaggugaagcugcggccgggcaaguacuaccugcucgucuacaaguacuccgggagcggcaacuacgagcugcgcgugaacaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1487 - RNA, 3646 nt, Artificial Sequence
  mRNA product Design1 comprising derived and/or modified sequence from Clostridium histolyticum__BAA77453.1__HsALB(1-18)_ColG(1-110)_CS-F_ColG(111-1 118) (opt1)
gggagaaagcuuaccaugaagugggugaccuucaucagccugcucuuccuguucuccagcgccuacuccaugaagaagaacauccugaagauccucauggacagcuacuccaaggagagcaagauccagaccgugcgccgggucaccuccgugagccugcuggccguguaccucacgaugaacaccuccagccugguccuggccaagcccaucgagaacaccaacgacaccuccaucaagaacguggagaagcuccgcaacgcgcccaacgaggagaacagcaagaagguggaggacuccaagaacgacaaggucgagcacgugaagaacaucgaggaggccaagguggagcaggucgcccccgaggugaagagcaaguccacgcugcggagcgccucccgccggcgccggaagcgcaucgccaacaccaacagcgagaaguacgacuucgaguaccugaacggccucuccuacaccgagcugaccaaccugaucaagaacaucaaguggaaccagaucaacgggcucuucaacuacagcacgggcucccagaaguucuucggggacaagaaccgcgugcaggcgaucaucaacgcccugcaggagagcggccggaccuacaccgccaacgacaugaaggggaucgagaccuucacggagguccugcgcgccggcuucuaccucggcuacuacaacgacgggcuguccuaccugaacgaccggaacuuccaggacaagugcauccccgcgaugaucgccauccagaagaaccccaacuucaagcucggcaccgccgugcaggacgaggugaucaccagccuggggaagcugaucggcaacgccagcgccaacgcggaggucgugaacaacugcgugccgguccucaagcaguuccgcgagaaccugaaccaguacgcccccgacuacgugaaggggaccgccgugaacgagcugaucaagggcaucgaguucgacuucuccggcgccgccuacgagaaggacgucaagacgaugcccugguacgggaagaucgaccccuucaucaacgagcucaaggcgcugggccuguacgggaacaucaccagcgccaccgagugggccuccgacgugggcaucuacuaccucagcaaguucggccuguacuccaccaaccggaacgacaucgugcagagccuggagaaggccgucgacauguacaaguacgggaagaucgccuucguggcgauggagcgcaucacgugggacuacgacggcaucggguccaacggcaagaaggucgaccacgacaaguuccucgacgacgccgagaagcacuaccugccgaagaccuacaccuucgacaacgggaccuucaucauccgggccggcgacaaggugagcgaggagaagaucaagcgccuguacugggccucccgggaggugaagagccaguuccaccgcgucgugggcaacgacaaggcccucgagguggggaacgcggacgacguccugacgaugaagaucuucaacucccccgaggaguacaaguucaacaccaacaucaacggcgugagcaccgacaacgggggccuguacaucgagccgcgggggaccuucuacacguacgagcgcaccccgcagcaguccaucuucagccucgaggagcuguuccggcacgaguacacccacuaccugcaggcccgcuaccucguggacggccuguggggccaggggccguucuacgagaagaaccggcugaccugguucgacgagggcacggccgaguucuucgccggguccacccgcaccagcggcguccucccccggaaguccauccugggguaccuggcgaaggacaagguggaccaccgcuacagccucaagaagacccugaacuccggcuacgacgacagcgacuggauguucuacaacuacggcuucgccguggcccacuaccuguacgagaaggacaugcccacguucaucaagaugaacaaggccauccugaacaccgacgucaagagcuacgacgagaucaucaagaagcucuccgacgacgccaacaagaacaccgaguaccagaaccacauccaggagcuggcggacaaguaccagggggccggcaucccccuggugagcgacgacuaccucaaggaccacggguacaagaaggccuccgagguguacagcgagaucuccaaggccgccagccugaccaacaccuccgucacggcggagaagagccaguacuucaacaccuucacccugcgcggcaccuacacgggcgagaccuccaagggggaguucaaggacugggacgagaugagcaagaagcucgacggcacccuggagucccuggccaagaacagcugguccggguacaagacccucacggccuacuucaccaacuaccgggugaccagcgacaacaaggugcaguacgacgucguguuccacggcgugcugaccgacaacgccgacaucuccaacaacaaggccccgaucgcgaaggucacggggcccagcaccggcgccgugggccgcaacaucgaguucuccgggaaggacagcaaggacgaggacggcaagaucgugagcuacgacugggacuucggggacggcgccaccucccgggggaagaacagcguccacgccuacaagaaggcgggcaccuacaacgugacgcugaaggugaccgacgacaagggcgccaccgccaccgaguccuucacgaucgagaucaagaacgaggacaccaccacccccaucacgaaggagauggagcccaacgacgacaucaaggaggccaacgggccgaucgucgagggcgugaccgugaagggggaccucaacggcagcgacgacgccgacaccuucuacuucgacgucaaggaggacggggacgugaccaucgagcugcccuacuccggcagcuccaacuucacguggcugguguacaaggagggcgacgaccagaaccacaucgcgagcgggaucgacaagaacaacuccaaggucggcaccuucaagagcaccaaggggcgccacuacguguucaucuacaagcacgacuccgccagcaacaucuccuacagccucaacaucaagggccuggggaacgagaagcugaaggagaaggagaacaacgacuccagcgacaaggccaccgugauccccaacuucaacacgaccaugcagggcucccuccugggcgacgacagccgggacuacuacuccuucgaggucaaggaggagggggaggugaacaucgagcuggacaagaaggacgaguucggcgugaccuggacccuccaccccgagagcaacaucaacgaccgcaucacguacgggcaggucgacggcaacaaggugagcaacaaggugaagcugcggccgggcaaguacuaccugcucgucuacaaguacuccgggagcggcaacuacgagcugcgcgugaacaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1488 - RNA, 3322 nt, Artificial Sequence
  mRNA product Design1 comprising derived and/or modified sequence from Clostridium histolyticum__BAA34542.1__ColH (opt1)
gggagaaagcuuaccaugaacuuccugaagaucauccucaaccgcggcaagaccaugaagcggaagugccugagcaagcgccugaugcucgccaucaccauggccacgaucuucaccgugaacuccacccugcccaucuacgcggccgucgacaagaacaacgccaccgccgccgugcagaacgagagcaagcgguacacgguguccuaccugaagacccucaacuacuacgaccuggucgaccugcucgugaagaccgagaucgagaaccugccggaccuguuccaguacagcuccgacgcgaaggaguucuacgggaacaagacccgcaugagcuucaucauggacgagaucggccggcgcgcgccccaguacacggagaucgaccacaaggggauccccacccucguggaggucgugcgggccggcuucuaccugggguuccacaacaaggagcugaacgagaucaacaagcgcuccuucaaggagcgggugauccccagcauccucgccauccagaagaacccgaacuucaagcugggcaccgagguccaggacaagaucguguccgccaccggccugcucgccgggaacgagacggccccgcccgagguggucaacaacuucacccccauccugcaggacugcaucaagaacaucgaccgcuacgcccuggacgaccucaagagcaaggcccuguucaacgugcuggcggccccgaccuacgacaucaccgaguaccuccgggccacgaaggagaagcccgagaacacccccugguacggcaagaucgacggguucaucaacgagcugaagaagcuggcccucuacggcaagaucaacgacaacaacuccuggaucaucgacaacgggaucuaccacaucgcgccccugggcaagcugcacagcaacaacaagaucggcaucgagacccucaccgaggugaugaaggucuacccguaccuguccaugcagcaccuccagagcgccgaccagaucaagcgccacuacgacuccaaggacgccgaggggaacaagaucccccuggacaaguucaagaaggagggcaaggagaaguacugccccaagacguacaccuucgacgacgggaaggugaucaucaaggccggcgcccggguggaggaggagaaggucaagcgccuguacugggccagcaaggaggugaacucccaguucuuccggguguacggcaucgacaagccccuggaggaggggaacccggacgacauccucaccauggucaucuacaacagccccgaggaguacaagcugaacuccgugcuguacggcuacgacaccaacaacgggggcauguacaucgagcccgaggggacguucuucaccuacgagcgcgaggcgcaggagagcaccuacacccucgaggagcuguuccggcacgaguacacgcacuaccugcagggccgcuacgccgugcccggccagugggggcggaccaagcucuacgacaacgaccgccugaccugguacgaggagggcggggccgagcuguucgccggcagcacccggacguccgggauccucccgcgcaagagcaucgucuccaacauccacaacaccacccgcaacaaccgguacaagcugagcgacaccgugcacuccaaguacggcgccagcuucgaguucuacaacuacgcgugcauguucauggacuacauguacaacaaggacaugggcauccugaacaagcucaacgaccuggccaagaacaacgacgucgacggguacgacaacuacauccgcgaccuguccagcaacuacgcccugaacgacaaguaccaggaccacaugcaggagcggaucgacaacuacgagaaccucacggugcccuucguggccgacgacuaccugguccgccacgcguacaagaaccccaacgagaucuacuccgagaucagcgagguggccaagcugaaggacgccaaguccgaggugaagaagucccaguacuucagcaccuucacccuccggggcagcuacaccgggggcgccuccaaggggaagcuggaggaccagaaggccaugaacaaguucaucgacgacagccugaagaagcucgacaccuacuccuggagcggcuacaagacgcugaccgcguacuucaccaacuacaaggucgacuccagcaaccgcgugaccuacgacguggucuuccacggcuaccugcccaacgagggggacagcaagaacucccucccguacggcaagaucaacgggacguacaagggcaccgagaaggagaagaucaaguucagcuccgagggcagcuucgaccccgacgggaagaucguguccuacgagugggacuucggcgacgggaacaagagcaacgaggagaaccccgagcacuccuacgacaaggugggcaccuacaccgucaagcugaaggugacggacgacaagggggagagcuccgugagcaccaccaccgccgagaucaaggaccuguccgagaacaagcuccccgucaucuacaugcacgugcccaagagcggcgcccugaaccagaagguggucuucuacggcaaggggacguacgaccccgacggcuccaucgccggguaccagugggacuucggcgacgggagcgacuucuccagcgagcagaaccccucccacguguacaccaagaagggcgaguacaccgugacccugcgggucauggacagcagcggccagauguccgagaagacgaugaagaucaagaucaccgacccgguguaccccaucgggaccgagaaggagcccaacaacagcaaggagaccgccuccggccccaucgugccggggauccccgucagcggcacgaucgagaacaccuccgaccaggacuacuucuacuucgacgugaucacccccggggaggugaagaucgacaucaacaagcucggcuacggcggggcgaccugggucguguacgacgagaacaacaacgccgugagcuacgccacggacgacggccagaaccuguccgggaaguucaaggccgacaagcccggccgcuacuacauccaccuguacauguucaacgggagcuacaugccguaccggaucaacaucgagggcuccgucggccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1489 - RNA, 3283 nt, Artificial Sequence
  mRNA product Design1 comprising derived and/or modified sequence from Clostridium histolyticum__BAA34542.1__ColH (opt1)
gggagaaagcuuaccaugaagcgcaagugccugagcaagcggcucaugcuggccaucaccauggccaccaucuucacggugaacuccacccugcccaucuacgcggccgucgacaagaacaacgccaccgccgccgugcagaacgagagcaagcgcuacaccguguccuaccucaagacgcugaacuacuacgaccuggucgaccuccuggugaagaccgagaucgagaaccugcccgaccucuuccaguacagcuccgacgcgaaggaguucuacggcaacaagacccggaugagcuucaucauggacgagaucgggcgccgggccccgcaguacaccgagaucgaccacaagggcauccccacgcugguggaggucgugcgcgccggguucuaccugggcuuccacaacaaggagcucaacgagaucaacaagcgguccuucaaggagcgcgugauccccagcauccuggccauccagaagaacccgaacuucaagcuggggaccgagguccaggacaagaucguguccgcgaccggccuccuggccggcaacgagaccgccccgcccgagguggucaacaacuucacgcccauccugcaggacugcaucaagaacaucgaccgguacgcccucgacgaccugaagagcaaggcccuguucaacgugcucgcggccccgaccuacgacaucaccgaguaccugcgcgccaccaaggagaagcccgagaacacgccgugguacgggaagaucgacggcuucaucaacgagcugaagaagcucgcccuguacgggaagaucaacgacaacaacuccuggaucaucgacaacggcaucuaccacaucgccccccuggggaagcuccacagcaacaacaagaucggcaucgagacccugaccgaggugaugaaggucuacccguaccuguccaugcagcaccuccagagcgcggaccagaucaagcggcacuacgacuccaaggacgccgagggcaacaagaucccccuggacaaguucaagaaggaggggaaggagaaguacugccccaagaccuacacguucgacgacggcaaggugaucaucaaggccggggcccgcguggaggaggagaaggucaagcggcuguacugggccagcaaggaggugaacucccaguucuuccgcguguacggcaucgacaagccccucgaggagggcaacccggacgacauccugaccauggucaucuacaacagccccgaggaguacaagcugaacuccgugcucuacggguacgacaccaacaacggcgggauguacaucgagcccgagggcaccuucuucacguacgagcgggaggcgcaggagagcaccuacacccuggaggagcuguuccgccacgaguacacccacuaccuccaggggcgguacgccgugcccggccaguggggccgcacgaagcuguacgacaacgaccggcugaccugguacgaggagggcggcgccgagcucuucgccgggagcacccgcaccuccgggauccugccgcggaagagcaucgucuccaacauccacaacacgacccgcaacaaccgcuacaagcugagcgacaccgugcacuccaaguacggggccagcuucgaguucuacaacuacgcgugcauguucauggacuacauguacaacaaggacaugggcauccucaacaagcugaacgaccuggccaagaacaacgacgucgacggcuacgacaacuacauccgggaccuguccagcaacuacgcccucaacgacaaguaccaggaccacaugcaggagcgcaucgacaacuacgagaaccugaccgugcccuucguggccgacgacuaccugguccggcacgcguacaagaaccccaacgagaucuacuccgagaucagcgagguggccaagcucaaggacgccaaguccgaggugaagaagagccaguacuucuccacguucacccugcgcgggagcuacaccggcggggccuccaagggcaagcuggaggaccagaaggccaugaacaaguucaucgacgacagccucaagaagcuggacaccuacuccuggagcggguacaagacccugacggcguacuucaccaacuacaaggucgacuccagcaaccgggugaccuacgacguggucuuccacggcuaccuccccaacgagggcgacagcaagaacucccugccguacgggaagaucaacggcaccuacaaggggacggagaaggagaagaucaaguucagcuccgagggcagcuucgaccccgacggcaagaucguguccuacgagugggacuucggggacggcaacaagagcaacgaggagaaccccgagcacuccuacgacaagguggggaccuacaccgucaagcugaaggugaccgacgacaagggcgagagcuccgugagcacgaccaccgccgagaucaaggaccucuccgagaacaagcugcccgucaucuacaugcacgugccgaagagcggggcccugaaccagaagguggucuucuacggcaagggcaccuacgaccccgacggguccaucgccggcuaccagugggacuucggggacggcagcgacuucuccagcgagcagaaccccucccacguguacacgaagaagggggaguacaccgugacccuccgcgucauggacagcagcggccagauguccgagaagaccaugaagaucaagaucacggacccgguguaccccaucggcaccgagaaggagcccaacaacagcaaggagaccgccuccgggcccaucgugccgggcauccccgucagcgggaccaucgagaacacguccgaccaggacuacuucuacuucgacgugaucacccccggcgaggugaagaucgacaucaacaagcugggguacggcggcgcgaccugggucguguacgacgagaacaacaacgccgugagcuacgccaccgacgacgggcagaaccuguccggcaaguucaaggccgacaagcccgggcgguacuacauccaccucuacauguucaacggcagcuacaugccguaccgcaucaacaucgagggguccgucggccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1490 - RNA, 3217 nt, Artificial Sequence
  mRNA product Design1 comprising derived and/or modified sequence from Clostridium histolyticum__BAA34542.1__HsALB(1-18)_ColH(41-1021) (opt1)
gggagaaagcuuaccaugaagugggugaccuucaucagccugcucuuccuguucuccagcgccuacuccgugcagaacgagagcaagcgcuacaccguguccuaccucaagacgcugaacuacuacgaccuggucgaccuccuggugaagaccgagaucgagaaccugcccgaccucuuccaguacagcuccgacgcgaaggaguucuacggcaacaagacccggaugagcuucaucauggacgagaucgggcgccgggccccgcaguacaccgagaucgaccacaagggcauccccacgcugguggaggucgugcgcgccggguucuaccugggcuuccacaacaaggagcucaacgagaucaacaagcgguccuucaaggagcgcgugauccccagcauccuggccauccagaagaacccgaacuucaagcuggggaccgagguccaggacaagaucguguccgcgaccggccuccuggccggcaacgagaccgccccgcccgagguggucaacaacuucacgcccauccugcaggacugcaucaagaacaucgaccgguacgcccucgacgaccugaagagcaaggcccuguucaacgugcucgcggccccgaccuacgacaucaccgaguaccugcgcgccaccaaggagaagcccgagaacacgccgugguacgggaagaucgacggcuucaucaacgagcugaagaagcucgcccuguacgggaagaucaacgacaacaacuccuggaucaucgacaacggcaucuaccacaucgccccccuggggaagcuccacagcaacaacaagaucggcaucgagacccugaccgaggugaugaaggucuacccguaccuguccaugcagcaccuccagagcgcggaccagaucaagcggcacuacgacuccaaggacgccgagggcaacaagaucccccuggacaaguucaagaaggaggggaaggagaaguacugccccaagaccuacacguucgacgacggcaaggugaucaucaaggccggggcccgcguggaggaggagaaggucaagcggcuguacugggccagcaaggaggugaacucccaguucuuccgcguguacggcaucgacaagccccucgaggagggcaacccggacgacauccugaccauggucaucuacaacagccccgaggaguacaagcugaacuccgugcucuacggguacgacaccaacaacggcgggauguacaucgagcccgagggcaccuucuucacguacgagcgggaggcgcaggagagcaccuacacccuggaggagcuguuccgccacgaguacacccacuaccuccaggggcgguacgccgugcccggccaguggggccgcacgaagcuguacgacaacgaccggcugaccugguacgaggagggcggcgccgagcucuucgccgggagcacccgcaccuccgggauccugccgcggaagagcaucgucuccaacauccacaacacgacccgcaacaaccgcuacaagcugagcgacaccgugcacuccaaguacggggccagcuucgaguucuacaacuacgcgugcauguucauggacuacauguacaacaaggacaugggcauccucaacaagcugaacgaccuggccaagaacaacgacgucgacggcuacgacaacuacauccgggaccuguccagcaacuacgcccucaacgacaaguaccaggaccacaugcaggagcgcaucgacaacuacgagaaccugaccgugcccuucguggccgacgacuaccugguccggcacgcguacaagaaccccaacgagaucuacuccgagaucagcgagguggccaagcucaaggacgccaaguccgaggugaagaagagccaguacuucuccacguucacccugcgcgggagcuacaccggcggggccuccaagggcaagcuggaggaccagaaggccaugaacaaguucaucgacgacagccucaagaagcuggacaccuacuccuggagcggguacaagacccugacggcguacuucaccaacuacaaggucgacuccagcaaccgggugaccuacgacguggucuuccacggcuaccuccccaacgagggcgacagcaagaacucccugccguacgggaagaucaacggcaccuacaaggggacggagaaggagaagaucaaguucagcuccgagggcagcuucgaccccgacggcaagaucguguccuacgagugggacuucggggacggcaacaagagcaacgaggagaaccccgagcacuccuacgacaagguggggaccuacaccgucaagcugaaggugaccgacgacaagggcgagagcuccgugagcacgaccaccgccgagaucaaggaccucuccgagaacaagcugcccgucaucuacaugcacgugccgaagagcggggcccugaaccagaagguggucuucuacggcaagggcaccuacgaccccgacggguccaucgccggcuaccagugggacuucggggacggcagcgacuucuccagcgagcagaaccccucccacguguacacgaagaagggggaguacaccgugacccuccgcgucauggacagcagcggccagauguccgagaagaccaugaagaucaagaucacggacccgguguaccccaucggcaccgagaaggagcccaacaacagcaaggagaccgccuccgggcccaucgugccgggcauccccgucagcgggaccaucgagaacacguccgaccaggacuacuucuacuucgacgugaucacccccggcgaggugaagaucgacaucaacaagcugggguacggcggcgcgaccugggucguguacgacgagaacaacaacgccgugagcuacgccaccgacgacgggcagaaccuguccggcaaguucaaggccgacaagcccgggcgguacuacauccaccucuacauguucaacggcagcuacaugccguaccgcaucaacaucgagggguccgucggccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1491 - RNA, 3355 nt, Artificial Sequence
  mRNA product Design1 comprising derived and/or modified sequence from Clostridium histolyticum__BAA34542.1__HsALB(1-18)_ColH(1-40)_CS-F_ColH(41-102 1) (opt1)
gggagaaagcuuaccaugaagugggugaccuucaucagccugcucuuccuguucuccagcgccuacuccaugaagcgcaagugccugagcaagcggcucaugcuggccaucaccauggccaccaucuucacggugaacuccacccugcccaucuacgcggccgucgacaagaacaacgccaccgccgcccgccggcgccggaagcgcgugcagaacgagagcaagcgcuacaccguguccuaccucaagacgcugaacuacuacgaccuggucgaccuccuggugaagaccgagaucgagaaccugcccgaccucuuccaguacagcuccgacgcgaaggaguucuacggcaacaagacccggaugagcuucaucauggacgagaucgggcgccgggccccgcaguacaccgagaucgaccacaagggcauccccacgcugguggaggucgugcgcgccggguucuaccugggcuuccacaacaaggagcucaacgagaucaacaagcgguccuucaaggagcgcgugauccccagcauccuggccauccagaagaacccgaacuucaagcuggggaccgagguccaggacaagaucguguccgcgaccggccuccuggccggcaacgagaccgccccgcccgagguggucaacaacuucacgcccauccugcaggacugcaucaagaacaucgaccgguacgcccucgacgaccugaagagcaaggcccuguucaacgugcucgcggccccgaccuacgacaucaccgaguaccugcgcgccaccaaggagaagcccgagaacacgccgugguacgggaagaucgacggcuucaucaacgagcugaagaagcucgcccuguacgggaagaucaacgacaacaacuccuggaucaucgacaacggcaucuaccacaucgccccccuggggaagcuccacagcaacaacaagaucggcaucgagacccugaccgaggugaugaaggucuacccguaccuguccaugcagcaccuccagagcgcggaccagaucaagcggcacuacgacuccaaggacgccgagggcaacaagaucccccuggacaaguucaagaaggaggggaaggagaaguacugccccaagaccuacacguucgacgacggcaaggugaucaucaaggccggggcccgcguggaggaggagaaggucaagcggcuguacugggccagcaaggaggugaacucccaguucuuccgcguguacggcaucgacaagccccucgaggagggcaacccggacgacauccugaccauggucaucuacaacagccccgaggaguacaagcugaacuccgugcucuacggguacgacaccaacaacggcgggauguacaucgagcccgagggcaccuucuucacguacgagcgggaggcgcaggagagcaccuacacccuggaggagcuguuccgccacgaguacacccacuaccuccaggggcgguacgccgugcccggccaguggggccgcacgaagcuguacgacaacgaccggcugaccugguacgaggagggcggcgccgagcucuucgccgggagcacccgcaccuccgggauccugccgcggaagagcaucgucuccaacauccacaacacgacccgcaacaaccgcuacaagcugagcgacaccgugcacuccaaguacggggccagcuucgaguucuacaacuacgcgugcauguucauggacuacauguacaacaaggacaugggcauccucaacaagcugaacgaccuggccaagaacaacgacgucgacggcuacgacaacuacauccgggaccuguccagcaacuacgcccucaacgacaaguaccaggaccacaugcaggagcgcaucgacaacuacgagaaccugaccgugcccuucguggccgacgacuaccugguccggcacgcguacaagaaccccaacgagaucuacuccgagaucagcgagguggccaagcucaaggacgccaaguccgaggugaagaagagccaguacuucuccacguucacccugcgcgggagcuacaccggcggggccuccaagggcaagcuggaggaccagaaggccaugaacaaguucaucgacgacagccucaagaagcuggacaccuacuccuggagcggguacaagacccugacggcguacuucaccaacuacaaggucgacuccagcaaccgggugaccuacgacguggucuuccacggcuaccuccccaacgagggcgacagcaagaacucccugccguacgggaagaucaacggcaccuacaaggggacggagaaggagaagaucaaguucagcuccgagggcagcuucgaccccgacggcaagaucguguccuacgagugggacuucggggacggcaacaagagcaacgaggagaaccccgagcacuccuacgacaagguggggaccuacaccgucaagcugaaggugaccgacgacaagggcgagagcuccgugagcacgaccaccgccgagaucaaggaccucuccgagaacaagcugcccgucaucuacaugcacgugccgaagagcggggcccugaaccagaagguggucuucuacggcaagggcaccuacgaccccgacggguccaucgccggcuaccagugggacuucggggacggcagcgacuucuccagcgagcagaaccccucccacguguacacgaagaagggggaguacaccgugacccuccgcgucauggacagcagcggccagauguccgagaagaccaugaagaucaagaucacggacccgguguaccccaucggcaccgagaaggagcccaacaacagcaaggagaccgccuccgggcccaucgugccgggcauccccgucagcgggaccaucgagaacacguccgaccaggacuacuucuacuucgacgugaucacccccggcgaggugaagaucgacaucaacaagcugggguacggcggcgcgaccugggucguguacgacgagaacaacaacgccgugagcuacgccaccgacgacgggcagaaccuguccggcaaguucaaggccgacaagcccgggcgguacuacauccaccucuacauguucaacggcagcuacaugccguaccgcaucaacaucgagggguccgucggccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1492 - RNA, 793 nt, Artificial Sequence
  mRNA product Design1 comprising derived and/or modified sequence from Homo sapiens__NP_001133.1__HsAMELX (opt1)
gggagaaagcuuaccaugggcaccuggauccuguucgccugccuccugggggccgcguucgccaugccccugccgccccaccccggccaccccggguacaucaacuucagcuacgaggugcucaccccgcugaagugguaccaguccauccgcccgcccuaccccagcuacggcuacgagcccaugggcggguggcugcaccaccagaucauccccguccucucccagcagcacccgcccacgcacacccugcagccgcaccaccacauccccguggugcccgcccagcagcccgucaucccccagcagcccaugaugcccgugcccggccagcacagcaugaccccgauccagcaccaccagcccaaccugcccccgccggcccagcagcccuaccagccccagcccgugcagccccagccccaccagcccaugcagccgcagccgcccguccaccccaugcagccgcucccgccccagcccccgcugccgcccauguuccccaugcagccccugccgcccaugcuccccgaccugacccuggaggccuggcccuccacggacaagaccaagcgggaggagguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1493 - RNA, 352 nt, Artificial Sequence
  mRNA product Design1 comprising derived and/or modified sequence from Homo sapiens__NP_001133.1__HsAMELX-TRAP (opt1)
gggagaaagcuuaccaugccccugccgccccaccccggccaccccggguacaucaacuucagcuacgaggugcucaccccgcugaagugguaccaguccauccgcccgcccuaccccagcuacggcuacgagcccaugggcggguggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1494 - RNA, 385 nt, Artificial Sequence
  mRNA product Design1 comprising derived and/or modified sequence from Homo sapiens__NP_001133.1__HsAMELX-LRAP (opt1)
gggagaaagcuuaccaugccccugccgccccaccccggccaccccggguacaucaacuucagcuacgaggugcucaccccgcugaagugguaccaguccauccgcccgccgcccaugcuccccgaccugacccuggaggccuggcccuccacggacaagaccaagcgggaggagguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1495 - RNA, 424 nt, Artificial Sequence
  mRNA product Design1 comprising derived and/or modified sequence from Homo sapiens__NP_001133.1__HLA-A2-SP_HsAMELX(17-60) (opt1)
gggagaaagcuuaccauggccgugauggccccgcggacccugguccuccugcugagcggcgcgcucgcccugacccagacgugggccaugccccugccgccccaccccggccaccccggguacaucaacuucagcuacgaggugcucaccccgcugaagugguaccaguccauccgcccgcccuaccccagcuacggcuacgagcccaugggcggguggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1496 - RNA, 457 nt, Artificial Sequence
  mRNA product Design1 comprising derived and/or modified sequence from Homo sapiens__NP_001133.1__HLA-A2-SP_HsAMELX(17-47,168-191) (opt1)
gggagaaagcuuaccauggccgugauggccccgcggacccugguccuccugcugagcggcgcgcucgcccugacccagacgugggccaugccccugccgccccaccccggccaccccggguacaucaacuucagcuacgaggugcucaccccgcugaagugguaccaguccauccgcccgccgcccaugcuccccgaccugacccuggaggccuggcccuccacggacaagaccaagcgggaggagguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1497 - RNA, 796 nt, Artificial Sequence
  mRNA product Design1 comprising derived and/or modified sequence from Homo sapiens__NP_001134.1__HsAMELY (opt1)
gggagaaagcuuaccaugggcaccuggauccuguucgccugccucgugggggccgcguucgccaugccccugccgccccaccccggccaccccggguacaucaacuucagcuacgagguccugaccccgcucaagugguaccaguccaugauccgcccgcccuacagcuccuacggcuacgagcccaugggcggguggcugcaccaccagaucauccccguggugagccagcagcacccccugacgcacacccuccagucccaccaccacauccccgucgugcccgcccagcagccgcgggugcgccagcaggcccugaugcccguccccggccagcagagcaugacccccacccagcaccaccagccgaaccugccccuccccgcccagcagcccuuccagccgcagcccgugcagccccagccccaccagccgaugcagccccagccgcccgugcagcccaugcagccccugcugccccagccgccccucccgcccauguucccccugcggccccugccgcccauccuccccgaccugcaccuggaggcguggcccgccacggacaagaccaagcaggaggaggucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1498 - RNA, 355 nt, Artificial Sequence
  mRNA product Design1 comprising derived and/or modified sequence from Homo sapiens__NP_001134.1__HsAMELY-TRAP (opt1)
gggagaaagcuuaccaugccccugccgccccaccccggccaccccggguacaucaacuucagcuacgagguccugaccccgcucaagugguaccaguccaugauccgcccgcccuacagcuccuacggcuacgagcccaugggcggguggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1499 - RNA, 388 nt, Artificial Sequence
  mRNA product Design1 comprising derived and/or modified sequence from Homo sapiens__NP_001134.1__HsAMELY-LRAP (opt1)
gggagaaagcuuaccaugccccugccgccccaccccggccaccccggguacaucaacuucagcuacgagguccugaccccgcucaagugguaccaguccaugauccgcccgccgcccauccuccccgaccugcaccuggaggcguggcccgccacggacaagaccaagcaggaggaggucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1500 - RNA, 427 nt, Artificial Sequence
  mRNA product Design1 comprising derived and/or modified sequence from Homo sapiens__NP_001134.1__HLA-A2-SP_HsAMELY(17-61) (opt1)
gggagaaagcuuaccauggccgugauggccccgcggacccugguccuccugcugagcggcgcgcucgcccugacccagacgugggccaugccccugccgccccaccccggccaccccggguacaucaacuucagcuacgagguccugaccccgcucaagugguaccaguccaugauccgcccgcccuacagcuccuacggcuacgagcccaugggcggguggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1501 - RNA, 460 nt, Artificial Sequence
  mRNA product Design1 comprising derived and/or modified sequence from Homo sapiens__NP_001134.1__HLA-A2-SP_HsAMELY(17-48,169-192) (opt1)
gggagaaagcuuaccauggccgugauggccccgcggacccugguccuccugcugagcggcgcgcucgcccugacccagacgugggccaugccccugccgccccaccccggccaccccggguacaucaacuucagcuacgagguccugaccccgcucaagugguaccaguccaugauccgcccgccgcccauccuccccgaccugcaccuggaggcguggcccgccacggacaagaccaagcaggaggaggucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1502 - RNA, 787 nt, Artificial Sequence
  mRNA product Design1 comprising derived and/or modified sequence from Sus scrofa__NP_999071.1__SsAMELX-001-1 (opt1)
gggagaaagcuuaccaugggcaccuggauccuguucgccugccuccugggggccgcguucagcaugccccugccgccccaccccggccaccccggguacaucaacuucuccuacgaggugcucaccccgcugaagugguaccagaacaugauccgccaccccuacacgagcuacggcuacgagcccaugggcggguggcugcaccaccagaucauccccgucgugucccagcagaccccgcagagccacgcccuccagccccaccaccacauccccauggugcccgcccagcagccgggcaucccccagcagcccaugaugccccugccggggcagcacuccaugacccccacccagcaccaccagcccaaccugccccucccggcccagcagcccuuccagccccagcccguccagccgcagccccaccagccccugcagccccagagcccgaugcaccccauccagccccugcucccgcagccgccccugcccccgauguucuccaugcagagccugcuccccgaccugccccuggaggccuggcccgcgacggacaagaccaagcgggaggagguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1503 - RNA, 355 nt, Artificial Sequence
  mRNA product Design1 comprising derived and/or modified sequence from Sus scrofa__NP_999071.1__SsAMELX-TRAP (opt1)
gggagaaagcuuaccaugccccugccgccccaccccggccaccccggguacaucaacuucuccuacgaggugcucaccccgcugaagugguaccagaacaugauccgccaccccuacacgagcuacggcuacgagcccaugggcggguggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1504 - RNA, 388 nt, Artificial Sequence
  mRNA product Design1 comprising derived and/or modified sequence from Sus scrofa__NP_999071.1__SsAMELX-LRAP (opt1)
gggagaaagcuuaccaugccccugccgccccaccccggccaccccggguacaucaacuucuccuacgaggugcucaccccgcugaagugguaccagaacaugauccgccaccccagccugcuccccgaccugccccuggaggccuggcccgcgacggacaagaccaagcgggaggagguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1505 - RNA, 427 nt, Artificial Sequence
  mRNA product Design1 comprising derived and/or modified sequence from Sus scrofa__NP_999071.1__HLA-A2-SP_SsAMEL(17-61) (opt1)
gggagaaagcuuaccauggccgugauggccccgcggacccugguccuccugcugagcggcgcgcucgcccugacccagacgugggccaugccccugccgccccaccccggccaccccggguacaucaacuucuccuacgaggugcucaccccgcugaagugguaccagaacaugauccgccaccccuacacgagcuacggcuacgagcccaugggcggguggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1506 - RNA, 460 nt, Artificial Sequence
  mRNA product Design1 comprising derived and/or modified sequence from Sus scrofa__NP_999071.1__HLA-A2-SP_SsAMEL(17-49,167-189) (opt1)
gggagaaagcuuaccauggccgugauggccccgcggacccugguccuccugcugagcggcgcgcucgcccugacccagacgugggccaugccccugccgccccaccccggccaccccggguacaucaacuucuccuacgaggugcucaccccgcugaagugguaccagaacaugauccgccaccccagccugcuccccgaccugccccuggaggccuggcccgcgacggacaagaccaagcgggaggagguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1507 - RNA, 751 nt, Artificial Sequence
  mRNA product Design1 comprising derived and/or modified sequence from Sus scrofa__P45561-2__SsAMELX-001-2 (opt1)
gggagaaagcuuaccaugggcaccuggauccuguucgccugccuccugggggccgcguucagcaugccccugccgccccaccccggccaccccggguacaucaacuucuccuacauccgccacccguacaccagcuacggcuacgagcccaugggcggguggcuccaccaccagaucauccccguggucucccagcagacgccccagagccacgcccugcagccgcaccaccacauccccauggugcccgcccagcagcccggcaucccgcagcagcccaugaugccccugcccgggcagcacuccaugaccccgacccagcaccaccagcccaaccucccccugcccgcccagcagccguuccagccccagcccgugcagccccagccgcaccagccccugcagccccagagccccaugcacccgauccagccccuccugccccagccgccccugccgcccauguucuccaugcagagccuccugcccgaccugccccucgaggccuggcccgcgaccgacaagacgaagcgggaggaggucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1508 - RNA, 787 nt, Artificial Sequence
  mRNA product Design1 comprising derived and/or modified sequence from Sus scrofa__NP_998965.1__SsAMELX-001-3 (opt1)
gggagaaagcuuaccaugggcaccuggaucuucuucgccugccugcucggggccagccuggcgaugccccugccgccccaccccggccaccccggguacaucaacuucuccuacgaggugcucacgccccugaagugguaccagaacaugauccgccaccccuacaccagcuacggcuacgagcccaugggcggguggcugcaccaccagaucauccccgucgugucccagcagaccccgcagagccacgcccuccagccccaccaccacauccccauggugcccgcccagcagccgggcaucccccagcagcccaugaugccccugccggggcagcacuccaugacccccacccagcaccaccagcccaaccugccccucccggcccagcagcccuuccagccccagcccguccagccgcagccccaccagccccugcagccccagagcccgaugcaccccauccagccccugcucccgcagccgccccugccgcccauguucuccaugcagagccugcuccccgaccugccccuggaggccuggcccgcgacggacaagaccaagcgggaggagguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1509 - RNA, 436 nt, Artificial Sequence
  mRNA product Design1 comprising derived and/or modified sequence from Sus scrofa__K7GPB2__SsAMELX-002 (opt1)
gggagaaagcuuaccaugggcaccuggauccuguucgccugccuccugggggccgcguucagcaugccccugccgccccaccccggccaccccggguacaucaacuucuccuacgaggugcucaccccgcugaagugguaccagaacaugauccgccaccccagccugcuccccgaccugccccuggaggccuggccggccacggacaagaccaagcgggaggaggucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1510 - RNA, 829 nt, Artificial Sequence
  mRNA product Design1 comprising derived and/or modified sequence from Sus scrofa__K7GLD0__SsAMELX-003 (opt1)
gggagaaagcuuaccaugggcaccuggauccuguucgccugccuccugggggccgcguucagcaugccccugccgccccaccccggccaccccggguacaucaacuucuccuacgaggaccucuaccuggaggccauccgcaucgaccggaccgccuucgugcugacgccccucaagugguaccagaacaugauccgccaccccuacaccagcuacggcuacgagcccaugggcggguggcugcaccaccagaucauccccgucgugucccagcagaccccgcagagccacgcccugcagccccaccaccacauccccauggugcccgcccagcagccgggcaucccccagcagcccaugaugccccucccggggcagcacuccaugacccccacgcagcaccaccagcccaaccugccccugccggcgcagcagcccuuccagccccagcccguccagccgcagccccaccagccccuccagccccagagcccgaugcaccccauccagccccugcugccgcagccgccccugccgcccauguucuccaugcagagccuccugcccgaccucccccuggaggccuggcccgccaccgacaagaccaagcgggaggagguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1511 - RNA, 715 nt, Artificial Sequence
  mRNA product Design1 comprising derived and/or modified sequence from Sus scrofa__K7GPE9__SsAMELX-004 (opt1)
gggagaaagcuuaccaugggcaccuggauccuguucgccugccuccugggggccgcguucagcaugccccugccgccccaccccggccaccccggguacaucaacuucuccuacgaggugcucaccccgcugaagugguaccagaacaugauccgccaccccacgccccagagccacgcccugcagccccaccaccacaucccgaugguccccgcccagcagcccggcaucccccagcagccgaugaugccccuccccgggcagcacuccaugacccccacccagcaccaccagccgaaccugccccugcccgcccagcagcccuuccagccgcagcccgugcagccccagccccaccagccgcuccagccccagagccccaugcaccccauccagccgcugcugccccagcccccgcucccgcccauguucuccaugcagagccugcugcccgaccucccccuggaggccuggcccgcgaccgacaagacgaagcgggaggagguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1512 - RNA, 739 nt, Artificial Sequence
  mRNA product Design1 comprising derived and/or modified sequence from Sus scrofa__J9JIM4__SsAMELX-201 (opt1)
gggagaaagcuuaccaugccccugccgccccaccccggccaccccggguacaucaacuucagcuacgaggugcucaccccgcugaagugguaccagaacaugauccgccaccccuacaccuccuacggcuacgagcccaugggcggguggcugcaccaccagaucauccccgucgugagccagcagacgccgcagucccacgcccuccagccccaccaccacauccccauggugcccgcccagcagcccgggaucccccagcagcccaugaugccccugccgggccagcacagcaugacccccacccagcaccaccagcccaaccugccccucccggcgcagcagcccuuccagccccagcccguccagccgcagccccaccagccccugcagccccaguccccgaugcaccccauccagccccugcucccgcagccgccccugccgcccauguucagcaugcagucccugcuccccgaccugccccuggaggccuggcccgccaccgacaagacgaagcgggaggagguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1513 - RNA, 3178 nt, Artificial Sequence
  mRNA product Design1 comprising derived and/or modified sequence from Homo sapiens__NP_006120.1__HsBMP1 (opt1)
gggagaaagcuuaccaugcccggcguggcccgccugccgcuccugcuggggcuccugcugcucccccggcccggccgcccccuggaccuggccgacuacaccuacgaccucgccgaggaggacgacagcgagccgcugaacuacaaggaccccugcaaggccgccgccuuccugggggacaucgcccucgacgaggaggaccugcgggcguuccagguccagcaggccguggaccugcgccggcacaccgcccgcaaguccagcaucaaggccgcggugcccggcaacacguccacccccagcugccaguccaccaacgggcagccgcagcggggcgccugcggccgcuggcgggggcgcagccggucccgccgggccgccaccagccgccccgagcgggucuggcccgacggcgugauccccuucgugaucgggggcaacuucacggggucccagcgcgccgucuuccggcaggcgaugcgccacugggagaagcacacgugcgugaccuuccucgagcggaccgacgaggacagcuacaucguguucaccuaccgcccgugcggcugcugcuccuacgucggccggcgcgggggcgggccccaggccaucagcaucggcaagaacugcgacaaguucggcaucguggugcacgagcuggggcacgucgugggcuucuggcacgagcacacccgccccgaccgggaccgccacguguccaucguccgggagaacauccagcccgggcaggaguacaacuuccugaagauggagccgcaggagguggagagccucggcgagaccuacgacuucgacuccaucaugcacuacgcccgcaacaccuucagccgggggaucuuccuggacacgaucgugcccaaguacgaggucaacggcgugaagccgcccaucggccagcgcacccggcuguccaagggggacaucgcccaggcccgcaagcucuacaagugccccgcgugcggcgagacccugcaggacagcaccgggaacuucuccagccccgaguaccccaacggcuacagcgcccacaugcacugcguguggcggaucuccgucacgcccggggagaagaucauccugaacuucaccagccucgaccuguaccgcucccggcugugcugguacgacuacguggaggugcgcgacggcuucuggcggaaggccccgcuccgcggccgguucugcgggagcaagcugcccgagcccaucgucuccaccgacagccgccuguggguggaguuccgguccagcuccaacugggucggcaagggguucuucgccguguacgaggccaucugcggcggggacgugaagaaggacuacggccacauccagagccccaacuacccggacgacuaccgccccuccaaggucugcaucuggcggauccaggugagcgagggcuuccacguggggcucaccuuccaguccuucgagaucgagcgccacgacagcugcgcguacgacuaccuggagguccgcgacggccacuccgagagcuccacgcugaucgggcgguacugcggcuacgagaagcccgacgacaucaagagcaccuccagccgccucuggcugaaguucgugagcgacggcuccaucaacaaggccggguucgccgugaacuucuucaaggaggucgacgagugcagccggccgaaccgcggcgggugcgagcagcggugccugaacacccucggcuccuacaagugcagcugcgaccccggguacgagcuggcccccgacaagcgccggugcgaggccgcgugcggcggcuuccugaccaagcucaacggguccaucacgagccccggcuggccgaaggaguacccgcccaacaagaacugcaucuggcagcugguggcccccacccaguaccgcaucucccugcaguucgacuucuucgagaccgaggggaacgacgugugcaaguacgacuucgucgaggugcggagcggccucaccgccgacuccaagcugcacgggaaguucugcggcagcgagaagcccgaggugaucacgucccaguacaacaacaugcgcgucgaguucaagagcgacaacaccguguccaagaagggcuucaaggcccacuucuucagcgacaaggacgagugcuccaaggacaacgggggcugccagcaggacugcgugaacaccuucgggagcuacgagugccagugccgguccggcuucguccugcacgacaacaagcacgacugcaaggaggcggggugcgaccacaaggugaccagcacgagcggcaccaucaccucccccaacuggcccgacaaguaccccagcaagaaggagugcaccugggccaucuccagcacgccgggccaccgcgugaagcucaccuucauggagauggacaucgagucccagcccgagugcgccuacgaccaccuggaggucuucgacgggcgggacgccaaggcccccgugcugggccgcuucugcgggagcaagaagcccgagccggugcucgcgaccggcucccggauguuccugcgcuucuacagcgacaacuccguccagcggaagggguuccaggccagccacgccaccgagugcggcggccaggugcgcgccgacgugaagaccaaggaccuguacucccacgcccaguucggggacaacaacuaccccggcggggucgacugcgagugggugaucguggcggaggagggcuacggcgucgagcugguguuccagacguucgagguggaggaggagaccgacugcggguacgacuacauggagcuguucgacggcuacgacagcaccgcgccccggcucgggcgcuacugcggcuccgggcccccggaggaggucuacagcgccggcgacuccgugcuggugaaguuccacagcgacgacaccaucacgaagaagggcuuccaccuccgguacaccuccaccaaguuccaggacacccugcacagccgcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1514 - RNA, 1408 nt, Artificial Sequence
  mRNA product Design1 comprising derived and/or modified sequence from Homo sapiens__NP_001191.1__HsBMP2 (opt1)
gggagaaagcuuaccaugguggccggcacccgcugccugcucgcccugcugcucccccagguccugcucgggggcgcggccgggcuggugccggagcugggccggcgcaaguucgccgccgccagcuccgggcggcccagcucccagcccagcgacgaggugcuguccgaguucgagcuccgccugcugagcauguucggccucaagcagcggcccaccccgucccgcgacgcggucgugccgcccuacaugcuggaccuguaccggcgccacagcggccagcccgggucccccgcccccgaccaccggcucgagcgcgccgccagccgggcgaacacggugcgcuccuuccaccacgaggagagccuggaggagcugcccgagaccuccggcaagaccacccggcgcuucuucuucaaccucagcuccauccccacggaggaguucaucaccagcgccgagcugcaggucuuccgggagcagaugcaggacgcccuggggaacaacuccagcuuccaccaccgcaucaacaucuacgagaucaucaagccggccaccgccaacuccaaguuccccgugacccggcuccuggacacgcgccuggugaaccagaacgcgagccggugggagagcuucgacgucacccccgccgugaugcgcuggaccgcccagggccacgccaaccacggguucguggucgagguggcccaccucgaggagaagcagggcguguccaagcggcacguccgcaucagccgcucccugcaccaggacgagcacagcuggucccagauccggccccugcucgugaccuucggccacgacgggaagggccacccgcugcacaagcgcgagaagcggcaggcgaagcacaagcagcgcaagcggcucaagagcuccugcaagcgccacccccuguacguggacuucagcgacgucggguggaacgacuggaucguggccccgcccggcuaccacgccuucuacugccacggcgagugccccuucccccuggccgaccaccugaacuccacgaaccacgccaucgugcagacccucgucaacagcgugaacuccaagauccccaaggcgugcugcgugcccaccgagcugagcgccaucuccaugcuguaccucgacgagaacgagaaggucgugcugaagaacuaccaggacauggucguggaggggugcggcugccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1515 - RNA, 1444 nt, Artificial Sequence
  mRNA product Design1 comprising derived and/or modified sequence from Homo sapiens__NP_001193.2__HsBMP4 (opt1)
gggagaaagcuuaccaugauccccggcaaccgcaugcugauggugguccuccugugccaggugcugcucgggggcgccagccacgccucccugaucccggagaccgggaagaagaagguggcggagauccagggccacgccgggggccggcgcagcggccagucccacgagcugcuccgggacuucgaggccacccugcugcagauguucgggcuccgccggcgcccccagcccagcaaguccgccgucauccccgacuacaugcgggaccuguaccgccugcagagcggcgaggaggaggaggagcagauccacuccacggggcucgaguacccggagcggcccgccagccgcgcgaacaccgugcgguccuuccaccacgaggagcaccuggagaacauccccggcaccagcgagaacuccgccuuccgcuuccuguucaaccucagcuccauccccgagaacgaggugaucagcuccgccgagcugcggcuguuccgcgagcaggucgaccaggggccggacugggagcggggcuuccaccgcaucaacaucuacgaggugaugaagccgcccgccgaggugguccccggccaccucaucacccggcugcuggacacgcgccucgugcaccacaacgugacccggugggagaccuucgacgucagccccgcggugcugcgcuggacccgggagaagcagcccaacuacgggcuggccaucgaggugacgcaccuccaccagacccgcacccaccagggccagcacguccgcaucucccggagccugccccagggguccggcaacugggcccagcugcgcccccuccuggugaccuucggccacgacgggcggggccacgcccugacgcgccggcgccgggccaagcgcagcccgaagcaccacagccagcgggcgcgcaagaagaacaagaacugccggcgccacucccucuacguggacuucagcgacgucggguggaacgacuggaucguggccccgcccggcuaccaggccuucuacugccacggggacugccccuucccccuggccgaccaccugaacuccaccaaccacgccaucgugcagacccucgucaacagcgugaacuccagcauccccaaggcgugcugcgugcccaccgagcuguccgccaucagcaugcuguaccucgacgaguacgacaaggucgugcugaagaacuaccaggagauggucguggagggcugcggcugccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1516 - RNA, 1759 nt, Artificial Sequence
  mRNA product Design1 comprising derived and/or modified sequence from Homo sapiens__NP_001709.1__HsBMP6 (opt1)
gggagaaagcuuaccaugcccggccuggggcgccgggcccaguggcucugcuggugguggggccugcugugcagcugcugcgggccgccgccccuccggccgccccugcccgccgcggccgccgccgccgcgggcgggcagcugcucggcgacggcgggucccccggccggaccgagcagcccccgcccagcccccaguccagcuccggguuccuguaccgccggcugaagacccaggagaagcgcgagaugcagaaggagauccucagcgugcugggccugccccaccggccccgcccccuccacgggcugcagcagccccagcccccggcccugcggcagcaggaggagcagcagcagcagcagcagcucccccgcggcgagcccccgcccggccggcugaaguccgcgccccuguucaugcucgaccuguacaacgcccugagcgccgacaacgacgaggacggggccuccgagggcgagcgccagcagagcuggccccacgaggccgccuccagcucccagcggcgccagcccccgcccggggccgcgcacccccucaaccgcaagagccugcuggcccccggcuccggcagcgggggcgccuccccgcucacgagcgcccaggacuccgccuuccugaacgacgcggacauggucaugagcuucgugaaccugguggaguacgacaaggaguucagcccccgccagcggcaccacaaggaguucaaguucaaccucucccagauccccgagggggaggucgugaccgccgccgaguuccgcaucuacaaggacugcgugaugggcagcuucaagaaccagaccuuccugaucuccaucuaccagguccugcaggagcaccagcaccgggacagcgaccucuuccugcuggacacccgcguggugugggccuccgaggagggguggcucgaguucgacaucacggccaccagcaaccugugggucgugaccccgcagcacaacaugggccugcagcucuccguggucacccgggacggcgugcacgugcacccccgcgcggccgggcuggucggccgcgacgggcccuacgacaagcagcccuucaugguggccuucuucaaggugagcgagguccacgugcggacgacccgcuccgccagcucccggcgccggcagcagagccgcaaccgguccacccagagccaggacguggcccgcgucuccagcgcguccgacuacaacagcuccgagcugaagaccgccugccggaagcacgagcucuacgugagcuuccaggaccugggcuggcaggacuggaucaucgccccgaagggguacgccgcgaacuacugcgacggcgagugcagcuucccccugaacgcccacaugaacgccacgaaccacgccaucgugcagacccucguccaccugaugaaccccgaguacgugcccaagccgugcugcgcccccaccaagcugaacgcgaucuccguccucuacuucgacgacaacagcaacgugauccugaagaaguaccgcaacauggugguccgggccugcggcugccacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1517 - RNA, 1513 nt, Artificial Sequence
  mRNA product Design1 comprising derived and/or modified sequence from Homo sapiens__NP_001710.1__HsBMP7 (opt1)
gggagaaagcuuaccaugcacgugcgcagccugcgggccgccgcgccccacuccuucgucgcccucugggccccgcuguuccugcuccgcagcgcccuggccgacuucucccuggacaacgaggugcacagcuccuucauccaccggcgccuccggagccaggagcgccgggagaugcagcgcgagauccuguccauccugggccucccccaccggccccgcccccaccuccaggggaagcacaacagcgcgccgauguucaugcuggaccuguacaacgccauggccguggaggagggcgggggccccgggggccagggcuucuccuaccccuacaaggccgucuucagcacccaggggcccccgcuggcgucccugcaggacagccacuuccucaccgacgccgacauggugauguccuucgugaaccuggucgagcacgacaaggaguucuuccacccccgguaccaccaccgcgaguuccgguucgaccugagcaagauccccgagggcgaggccgugacggccgccgaguuccgcaucuacaaggacuacauccgggagcgcuucgacaacgagaccuuccggaucuccguguaccagguccuccaggagcaccuggggcgcgagagcgaccuguuccuccuggacucccggacccugugggcgagcgaggagggcuggcucguguucgacaucaccgccacguccaaccacuggguggucaacccccgccacaaccuggggcugcagcucagcguggagacccuggacggccagagcaucaacccgaagcuggccggccucaucgggcggcacggcccccagaacaagcagcccuucaugguggccuucuucaaggccaccgagguccacuuccgcuccauccgcagcaccggguccaagcagcggagccagaaccgcuccaagacgcccaagaaccaggaggcgcugcggauggccaacguggccgagaacagcuccagcgaccagcgccaggccugcaagaagcacgagcuguacguguccuuccgggaccucggcuggcaggacuggaucaucgccccggagggcuacgcggccuacuacugcgagggggagugcgccuucccccugaacagcuacaugaacgccaccaaccacgccaucguccagacccuggugcacuucaucaaccccgagaccgugcccaagccgugcugcgcgcccacgcagcucaacgccaucuccguccuguacuucgacgacagcuccaacgugauccugaagaaguaccgcaacauggugguccgggccugcggcugccacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1518 - RNA, 517 nt, Artificial Sequence
  mRNA product Design1 comprising derived and/or modified sequence from Homo sapiens__NP_006264.2__HsCCL7 (opt1)
gggagaaagcuuaccaugaaggccagcgccgcgcugcucugccugcugcucaccgccgccgccuucagcccccagggccuggcccagccgguggggaucaacaccuccacgaccugcugcuaccgcuucaucaacaagaagauccccaagcagcggcuggaguccuaccgccggaccaccagcucccacugcccccgcgaggcggucaucuucaagacgaagcucgacaaggagaucugcgccgaccccacccagaagugggugcaggacuucaugaagcaccuggacaagaagacccagaccccgaagcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1519 - RNA, 3841 nt, Artificial Sequence
  mRNA product Design1 comprising derived and/or modified sequence from Homo sapiens__NP_001954.2__HsEGF (opt1)
gggagaaagcuuaccaugcugcucacccugaucauccugcuccccguggucagcaaguucuccuucgugagccuguccgcgccccagcacuggagcugccccgagggcacccuggccgggaacggcaacuccacgugcguggggcccgcccccuuccucaucuucagccacggcaacuccaucuuccgcaucgacaccgaggggaccaacuacgagcagcuggucguggacgccggcgugagcgucaucauggacuuccacuacaacgagaagcggaucuacuggguggaccuggagcgccagcuccugcagcggguguuccugaacggcucccgccaggagcgggucugcaacaucgagaagaacgugagcgggauggccaucaacuggaucaacgaggaggugaucugguccaaccagcaggagggcaucaucaccgucacggacaugaaggggaacaacagccacauccuccuguccgcccugaaguacccggccaacguggcgguggaccccgucgagcgcuucaucuucuggagcuccgagguggccggcagccucuaccgggccgaccuggacggggugggcgucaaggcccugcucgagaccuccgagaagaucaccgcggugagccuggacgugcuggacaagcgccucuucuggauccaguacaaccgggagggcuccaacagccugaucugcagcugcgacuacgacgggggcuccguccacaucagcaagcaccccacccagcacaaccuguucgccaugucccucuucggggaccgcaucuucuacagcacguggaagaugaagaccaucuggaucgccaacaagcacaccggcaaggacauggugcggaucaaccugcacuccagcuucgugccccugggcgagcucaaggucgugcacccgcuggcccagcccaaggccgaggacgacaccugggagcccgagcagaagcugugcaagcuccgcaaggggaacugcuccagcacggucugcggccaggaccugcagucccaccugugcaugugcgcggagggguacgcccucagccgggaccgcaaguacugcgaggacgugaacgagugcgccuucuggaaccacggcugcacccuggggugcaagaacacccccggcuccuacuacugcacgugcccggugggcuucguccugcuccccgacgggaagcggugccaccagcuggugagcugcccccgcaacguguccgagugcagccacgacugcguccugaccuccgagggcccccucugcuucugcccggaggggagcgugcuggagcgggacggcaagaccugcuccgggugcagcucccccgacaacggcggcugcagccagcugugcgugccccucagccccgucuccugggagugcgacugcuucccgggguacgaccugcagcuggacgagaaguccugcgccgccagcggcccccagcccuuccuccuguucgcgaacagccaggacauccgccacaugcacuucgacgggaccgacuacggcacccugcucucccagcagauggggaugguguacgcccuggaccacgaccccguggagaacaagaucuacuucgcccacacggcccugaaguggaucgagcgggccaacauggacggcagccagcgcgagcggcugaucgaggagggcgucgacgugccggaggggcucgcgguggacuggaucggccgccgcuucuacuggaccgaccgggggaagucccugaucggccgcagcgaccugaacggcaagcgguccaagaucaucaccaaggagaacaucagccagccccgcgggaucgccguccaccccauggccaagcgccucuucuggaccgacacgggcaucaacccccggaucgaguccagcucccugcaggggcugggccggcucgugaucgccagcuccgaccugaucuggccgagcgggaucaccaucgacuuccugaccgacaagcucuacuggugcgacgccaagcaguccgugaucgagauggcgaaccuggacggcagcaagcgccggcgccugacccagaacgacgucggccaccccuucgccguggccguguucgaggacuacgucugguucagcgacugggccaugcccuccgugaugcgggugaacaagcgcacggggaaggaccggguccgccuccagggcagcaugcugaagccguccagccugguggugguccacccccucgcgaagcccggggccgaccccugccuguaccagaacggcgggugcgagcacaucugcaagaagcggcugggcaccgccuggugcuccugccgcgagggcuucaugaaggccagcgacgggaagaccugccucgcccuggacggccaccagcugcucgccgggggcgagguggaccugaagaaccaggugaccccgcuggacauccucuccaagacgcgggucagcgaggacaacaucaccgagucccagcacaugcugguggccgagaucauggugagcgaccaggacgacugcgcccccgucgggugcuccauguacgcccgcugcaucagcgagggcgaggacgcgaccugccagugccugaagggcuucgcgggggacggcaagcucugcuccgacaucgacgagugcgagaugggggugcccgugugcccgccggccagcuccaagugcaucaacaccgagggcggguacgucugccggugcagcgagggcuaccagggcgacgggauccacugccuggacaucgacgagugccagcugggcgagcacuccugcggggagaacgccagcugcacgaacaccgagggcggcuacacgugcaugugcgccgggcgccucuccgagcccggccugaucugccccgacagcacgcccccgccccaccuccgcgaggacgaccaccacuacagcgugcggaacuccgacagcgagugcccccugucccacgacggguacugccugcacgacggcgugugcauguacaucgaggcccuggacaaguacgcgugcaacugcgucgugggguacaucggcgagcgcugccaguaccgggaccucaaguggugggagcugcgccacgccggccacgggcagcagcagaaggugaucgucguggccgugugcgucguggugcuggucaugcuccugcugcucagccuguggggcgcccacuacuaccggacccagaagcugcucuccaagaaccccaagaacccguacgaggagagcucccgcgacgugcggagccgccggcccgcggacaccgaggacgggauguccagcugcccccagcccugguucguggucaucaaggagcaccaggaccugaagaacggcgggcagccgguggccggcgaggacggccaggccgccgacggguccaugcagcccaccagcuggcgccaggagccccagcugugcggcauggggaccgagcagggcugcuggauccccgucuccagcgacaagggguccugcccccaggugauggagcggagcuuccacaugcccuccuacggcacccagacccucgagggcgggguggagaagccccacagccugcuguccgccaacccgcucuggcagcagcgcgcgcuggacccgccccaccagauggagcugacccagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1520 - RNA, 727 nt, Artificial Sequence
  mRNA product Design1 comprising derived and/or modified sequence from Homo sapiens__NP_001423.1__HsEREG (opt1)
gggagaaagcuuaccaugaccgccggccgccggauggagaugcugugcgccgggcgcgugcccgcgcuccugcugugccucggcuuccaccuccugcaggccguccugagcaccacggugaucccguccugcauccccggggagagcuccgacaacugcaccgcccuggugcagaccgaggacaacccccgggucgcccaggugagcaucaccaagugcuccagcgacaugaacggcuacugccugcacgggcagugcaucuaccucguggacaugucccagaacuacugccgcugcgaggucggcuacacgggcgugcggugcgagcacuucuuccugaccgugcaccagccccugagcaaggaguacgucgcccucaccgugauccugaucauccuguuccucaucaccguggucggguccacguacuacuucugccgcugguaccggaaccgcaagagcaaggagccgaagaaggaguacgagcgggugaccuccggcgaccccgagcugccccaggugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1521 - RNA, 685 nt, Artificial Sequence
  mRNA product Design1 comprising derived and/or modified sequence from Homo sapiens__NP_000791.1__HsFGF1 (opt1)
gggagaaagcuuaccauggccgagggcgagaucaccaccuucacggcccugaccgagaaguucaaccugcccccggggaacuacaagaagcccaagcuccuguacugcagcaacggcgggcacuuccuccgcauccugcccgacggcaccguggacgggacccgggaccgcuccgaccagcacauccagcugcagcucagcgcggaguccgucggcgagguguacaucaagagcacggagaccggccaguaccuggccauggacaccgacgggcugcucuacggcucccagacccccaacgaggagugccuguuccuggagcggcucgaggagaaccacuacaacacguacaucagcaagaagcacgccgagaagaacugguucguggggcugaagaagaacggcuccugcaagcgcgggccgcggacccacuacggccagaaggccauccuguuccucccccugcccgucagcuccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1522 - RNA, 1084 nt, Artificial Sequence
  mRNA product Design1 comprising derived and/or modified sequence from Homo sapiens__NP_001997.5__HsFGF2 (opt1)
gggagaaagcuuaccauggugggcgucgggggcggggacguggaggacgugaccccgcgcccgggcgggugccagaucagcggccggggcgcccgcgggugcaacggcauccccggggccgcggccugggaggccgcccugccccggcgccggccccgccggcacccguccgucaacccccgcagccgggccgcgggcagcccccgcacccgggggcgccggacggaggagcgccccuccggcucccggcucggcgaccgcgggcggggccgcgcccugcccgggggccggcugggcgggcgcggccgggggcgcgcccccgagcgcgugggcgggcggggccgcggccgggggaccgccgcgccccgcgccgcccccgccgcccggggcagccgcccggggcccgcgggcaccauggccgccggguccaucaccacgcuccccgcccugcccgaggacggcggcagcggggccuucccgcccggccacuucaaggaccccaagcggcuguacugcaagaacgggggcuucuuccuccgcauccaccccgacgggcggguggacggcguccgcgagaaguccgacccgcacaucaagcugcagcugcaggcggaggagcggggcguggugagcaucaagggggucugcgccaaccgcuaccucgccaugaaggaggacggccggcugcuggccuccaagugcgugaccgacgagugcuucuucuucgagcgccucgagagcaacaacuacaacaccuaccggucccgcaaguacaccagcugguacguggcccugaagcggacggggcaguacaagcugggcuccaagaccggccccgggcagaaggcgauccucuuccugcccaugagcgccaaguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1523 - RNA, 802 nt, Artificial Sequence
  mRNA product Design1 comprising derived and/or modified sequence from Homo sapiens__NP_002000.1__HsFGF7 (opt1)
gggagaaagcuuaccaugcacaaguggauccugaccuggauccuccccacccugcuguaccgcagcugcuuccacaucaucugccucgugggcacgaucucccuggccugcaacgacaugaccccggagcagauggccaccaacgucaacugcagcucccccgagcggcacacccgcagcuacgacuacauggagggcggggacauccgggugcgccggcuguucugccgcacgcagugguaccuccggaucgacaagcgcgggaaggugaagggcacccaggagaugaagaacaacuacaacaucauggagauccggaccgucgcgguggggaucguggccaucaagggcgucgaguccgaguucuaccuggccaugaacaaggagggcaagcuguacgccaagaaggagugcaacgaggacugcaacuucaaggagcucauccuggagaaccacuacaacaccuacgccagcgcgaaguggacgcacaacgggggcgagauguucguggcccugaaccagaaggggauccccgugcgcggcaagaagaccaagaaggagcagaagaccgcccacuuccuccccauggccaucaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1524 - RNA, 844 nt, Artificial Sequence
  mRNA product Design1 comprising derived and/or modified sequence from Homo sapiens__NP_001936.1__HsHBEGF (opt1)
gggagaaagcuuaccaugaagcugcuccccagcgugguccugaagcuguuccucgccgccgugcuguccgcgcuggugaccggcgagagccucgagcggcugcggcgcgggcuggccgccggcaccuccaacccggacccgcccacggucagcaccgaccagcuccugccccucgggggcgggcgggaccgcaaggugcgggaccugcaggaggccgaccuggaccugcuccgcgugacccuguccagcaagccccaggcccuggcgacccccaacaaggaggagcacggcaagcggaagaagaagggcaaggggcucggcaagaagcgcgaccccugccugcggaaguacaaggacuucugcauccacggggagugcaaguacgucaaggagcugcgcgcccccuccugcaucugccacccgggcuaccacggggagcggugccacggccucagccugcccguggagaaccgccuguacacguacgaccacaccaccauccucgccguggucgccguggugcuguccagcgucugccugcucgugaucgugggccugcugauguuccgguaccaccgccgcgggggcuacgacgucgagaacgaggagaaggugaagcucgggaugaccaacucccacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1525 - RNA, 2404 nt, Artificial Sequence
  mRNA product Design1 comprising derived and/or modified sequence from Homo sapiens__NP_000592.3__HsHGF (opt1)
gggagaaagcuuaccaugugggugaccaagcugcuccccgcccugcugcuccagcacguccugcugcaccuccugcugcucccgaucgccauccccuacgcggagggccagcgcaagcggcgcaacaccauccacgaguucaagaaguccgccaagacgacccugaucaagaucgaccccgcccugaagaucaagaccaagaaggugaacaccgccgaccagugcgccaaccggugcacgcgcaacaaggggcuccccuucacgugcaaggcguucguguucgacaaggcccggaagcagugccugugguucccguucaacagcaugagcuccggcgucaagaaggaguucgggcacgaguucgaccuguacgagaacaaggacuacauccgcaacugcaucaucggcaaggggcggagcuacaagggcaccguguccaucaccaagagcggcaucaagugccagcccugguccagcaugaucccccacgagcacuccuuccuccccagcuccuaccgcgggaaggaccugcaggagaacuacugccggaacccgcgcggcgaggagggcgggcccuggugcuucaccagcaaccccgaggugcgguacgaggucugcgacaucccccagugcuccgagguggagugcaugaccugcaacggggagagcuaccgcggccugauggaccacaccgaguccggcaagaucugccagcggugggaccaccagaccccgcaccgccacaaguuccuccccgagcgguaccccgacaagggguucgacgacaacuacugccgcaaccccgacggccagccgcggcccuggugcuacacgcuggacccccacacccgcugggaguacugcgccaucaagaccugcgccgacaacaccaugaacgacacggacgugccccuggagaccaccgagugcauccaggggcagggcgagggcuaccgggggaccgucaacacgaucuggaacggcaucccgugccagcgcugggacagccaguacccccacgagcacgacaugacccccgagaacuucaagugcaaggaccuccgggagaacuacugccgcaaccccgacggguccgagagcccguggugcuucaccaccgaccccaacauccgcgugggcuacugcucccagauccccaacugcgacaugagccacgggcaggacugcuaccggggcaacggcaagaacuacauggggaaccugagccagacgcgcuccggccugaccugcagcaugugggacaagaacauggaggaccuccaccggcacaucuucugggagcccgacgcguccaagcugaacgagaacuacugccgcaacccggacgacgacgcccacgggcccuggugcuacaccggcaacccccugaucccgugggacuacugccccaucagccggugcgagggggacaccacgcccaccaucgugaaccucgaccaccccgucaucuccugcgccaagaccaagcagcugcgcguggugaacggcaucccgacccggacgaacaucggcuggauggucagccugcgcuaccggaacaagcacaucugcgggggcucccucaucaaggagagcugggugcugaccgcccgccagugcuuccccucccgggaccugaaggacuacgaggccuggcucgggauccacgacgugcacggccgcggggacgagaagugcaagcagguccugaacgugagccagcugguguacggccccgagggcuccgaccucguccugaugaagcuggcgcggcccgccgugcucgacgacuucgugagcaccaucgaccugccgaacuacgggugcaccauccccgagaagacguccugcagcgucuacggcuggggguacaccggccugaucaacuacgacggccuccugcgcguggcccaccuguacaucauggggaacgagaagugcucccagcaccaccggggcaaggucacccucaacgagagcgagaucugcgccggggccgagaagaucggcuccgggcccugcgagggcgacuacggcgggccccuggugugcgagcagcacaagaugcgcauggugcugggcgucaucgugccggggcggggcugcgcgauccccaaccgccccgggaucuucgugcgggucgccuacuacgccaaguggauccacaagaucauccucaccuacaaggugccccagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1526 - RNA, 2143 nt, Artificial Sequence
  mRNA product Design1 comprising derived and/or modified sequence from Homo sapiens__NP_005336.3 __HsHSPA1A (opt1)
gggagaaagcuuaccauggccaaggccgcggccaucggcaucgaccuggggaccaccuacagcugcgugggcguguuccagcacgggaagguggagaucaucgccaacgaccagggcaaccgcacgacccccuccuacguggccuucaccgacaccgagcggcucaucggggacgccgcgaagaaccaggucgcccugaacccgcagaacacgguguucgacgccaagcgccugaucggccggaaguucggcgaccccgugguccagagcgacaugaagcacuggcccuuccaggugaucaacgacggggacaagcccaaggugcaggucuccuacaagggcgagaccaaggccuucuacccggaggagaucagcuccauggugcucaccaagaugaaggagaucgcggaggccuaccugggguaccccgugaccaacgccgucaucacggugcccgccuacuucaacgacagccagcgccaggccaccaaggacgcgggcgugaucgccgggcugaacguccuccggaucaucaacgagcccaccgccgccgccaucgcguacggccuggaccgcaccggcaagggggagcggaacgugcugaucuucgaccucggcgggggcacguucgacguguccauccugaccaucgacgacggcaucuucgaggucaaggccaccgccggggacacccaccugggcggggaggacuucgacaaccgccucgugaaccacuucguggaggaguucaagcggaagcacaagaaggacaucagccagaacaagcgcgccguccggcgccugcggacggccugcgagcgcgcgaagcggacccuguccagcuccacccaggccagccucgagaucgacucccuguucgagggcaucgacuucuacaccagcaucacgcgcgcccgguucgaggagcugugcuccgaccucuuccgcagcacccuggagccgguggagaaggcccugcgggacgccaagcucgacaaggcgcagauccacgaccuggugcuggucgggggcuccacccgcauccccaaggugcagaagcuccugcaggacuucuucaacggccgggaccugaacaagagcaucaaccccgacgaggccgucgccuacggggccgcggugcaggccgccauccucaugggcgacaaguccgagaacgugcaggaccugcugcuccuggacgucgcgccccugagccucgggcuggagaccgccggcggggugaugacggcccugaucaagcgcaacagcaccaucccgaccaagcagacccagaucuucacgaccuacuccgacaaccagcccggcgugcucauccaggucuacgagggcgagcgcgccaugaccaaggacaacaaccugcuggggcgguucgagcucagcggcaucccgcccgcgccccgcggggugccccagaucgaggugaccuucgacaucgacgccaacggcauccugaacgucacggccaccgacaaguccaccgggaaggccaacaagaucaccaucacgaacgacaagggccggcugagcaaggaggagaucgagcgcauggugcaggaggccgagaaguacaaggccgaggacgaggugcagcgggagcgcgucuccgccaagaacgcccucgagagcuacgcguucaacaugaaguccgccguggaggacgagggccugaaggggaagaucagcgaggccgacaagaagaaggugcuggacaagugccaggaggucaucuccuggcucgacgccaacacccuggcggagaaggacgaguucgagcacaagcggaaggagcuggagcaggucugcaaccccaucaucagcggccucuaccagggggccggcggccccgggccgggcggguucggcgcccaggggcccaagggcggcuccgggagcggccccaccaucgaggagguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1527 - RNA, 2143 nt, Artificial Sequence; identical to SEQ ID NO: 1526
  mRNA product Design1 comprising derived and/or modified sequence from Homo sapiens__NP_005337.2 __HsHSPA1B (opt1)

SEQ ID NO: 1528 - RNA, 2143 nt, Artificial Sequence
  mRNA product Design1 comprising derived and/or modified sequence from Homo sapiens__NP_005518.3 __HsHSPA1L (opt1)
gggagaaagcuuaccauggccaccgccaagggcaucgcgaucgggaucgaccugggcaccacguacagcugcgugggggucuuccagcacggcaagguggagaucaucgccaacgaccaggggaaccgcaccacccccuccuacguggccuucaccgacacggagcggcucaucggcgacgccgccaagaaccaggucgcgaugaacccgcagaacaccguguucgacgccaagcgccugaucggccggaaguucaacgaccccgugguccaggccgacaugaagcuguggcccuuccaggugaucaacgagggcgggaagcccaaggugcucgucagcuacaagggggagaacaaggccuucuacccggaggagaucuccagcauggugcugaccaagcugaaggagaccgcggaggccuuccucggccaccccgugacgaacgccgucaucaccgugcccgccuacuucaacgacucccagcgccaggccaccaaggacgcgggggugaucgccggccugaacguccugcggaucaucaacgagcccaccgccgccgccaucgcguacggccucgacaagggcgggcagggggagcgccacgugcugaucuucgaccugggcggcgggacguucgacgugagcauccucaccaucgacgacggcaucuucgaggucaaggccaccgccggggacacccaccugggcggggaggacuucgacaaccggcuggugucccacuucguggaggaguucaagcgcaagcacaagaaggacaucagccagaacaagcgggccguccgccggcuccgcacggccugcgagcgggcgaagcgcacccuguccagcuccacccaggccaaccuggagaucgacagccucuacgagggcaucgacuucuacaccuccaucacgcgggcccgcuucgaggagcugugcgccgaccuguuccggggcacccucgagccgguggagaaggcccugcgcgacgcgaagauggacaaggccaagauccacgacaucgugcuggucgggggcagcacccggauccccaaggugcagcgccuccugcaggacuacuucaacgggcgggaccugaacaaguccaucaaccccgacgaggccgucgccuacggcgcggccgugcaggccgccauccucaugggggacaagagcgagaaggugcaggaccugcugcuccuggacgucgcgccccugucccucggccuggagaccgccggcggggugaugacggcccugaucaagcgcaacagcaccaucccgaccaagcagacccagaucuucacgaccuacuccgacaaccagcccggcgugcucauccaggucuacgagggggagcgcgccaugaccaaggacaacaaccugcugggccgguucgaccucaccgggaucccgcccgcgccccgcggcgugccccagaucgaggugacguucgacaucgacgccaacggcauccugaacgucaccgccaccgacaagagcaccgggaaggugaacaagaucacgaucaccaacgacaagggccggcugagcaaggaggagaucgagcgcauggugcucgacgccgagaaguacaaggccgaggacgagguccagcgggagaagaucgccgccaagaacgcgcuggaguccuacgccuucaacaugaaguccguggugagcgacgaggggcugaagggcaagaucagcgaguccgacaagaacaagauccucgacaagugcaacgagcugcugagcuggcucgaggucaaccagcuggccgagaaggacgaguucgaccacaagcgcaaggagcuggagcagaugugcaaccccaucaucaccaagcuguaccagggcgggugcaccggccccgccugcgggaccggcuacgugccggggcggcccgcgacgggccccaccaucgaggagguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1529 - RNA, 2137 nt, Artificial Sequence
  mRNA product Design1 comprising derived and/or modified sequence from Homo sapiens__NP_068814.2 __HsHSPA2 (opt1)
gggagaaagcuuaccaugagcgcccgcggccccgccaucgggaucgaccugggcaccaccuacuccugcgugggggucuuccagcacggcaagguggagaucaucgcgaacgaccaggggaaccggacgaccccgagcuacguggccuucaccgacaccgagcgccucaucggcgacgccgccaagaaccaggucgccaugaaccccacgaacaccaucuucgacgcgaagcggcugaucggccgcaaguucgaggacgccaccgugcaguccgacaugaagcacuggcccuuccggguggucagcgagggcgggaagcccaagguccagguggaguacaagggggagaccaagacguucuucccggaggagaucuccagcauggugcugaccaagaugaaggagaucgccgaggccuaccucggcgggaaggugcacuccgcggugaucaccguccccgccuacuucaacgacagccagcgccaggccaccaaggacgccggcacgaucaccggccugaacgugcugcggaucaucaacgagcccaccgccgcggccaucgccuacgggcucgacaagaagggcugcgccgggggcgagaagaacgugcugaucuucgaccugggcgggggcaccuucgacgucuccauccucacgaucgaggacgggaucuucgaggucaagagcaccgccggcgacacccaccucgggggcgaggacuucgacaaccgcauggugucccaccuggcggaggaguucaagcggaagcacaagaaggacaucggccccaacaagcgcgccgugcggcgccugcggaccgccugcgagcgcgccaagcggacgcugagcuccagcacccaggccuccaucgagaucgacagccuguacgaggggguggacuucuacaccuccaucacccgcgcgcgguucgaggagcucaacgccgaccuguuccgcggcacgcuggagccgguggagaaggcccuccgggacgccaagcuggacaaggggcagauccaggagaucguccuggugggcgggagcacccgcauccccaagauccagaagcuccugcaggacuucuucaacggcaaggagcugaacaaguccaucaaccccgacgaggccguggcguacggcgccgccguccaggccgcgauccucaucggggacaagagcgagaacgugcaggaccugcugcuccuggacgucacgccccugagccucggcaucgagaccgccgggggcgugaugaccccgcugaucaagcggaacaccaccauccccaccaagcagacgcagaccuucaccaccuacuccgacaaccagagcuccgugcugguccagguguacgagggggagcgcgccaugacgaaggacaacaaccuccugggcaaguucgaccugaccggcaucccgcccgcgccccgcggggugccccagaucgaggucaccuucgacaucgacgccaacggcauccucaacgugaccgccgccgacaagagcaccgggaaggagaacaagaucacgaucaccaacgacaagggccggcuguccaaggacgacaucgaccgcauggugcaggaggccgagcgguacaagagcgaggacgaggccaaccgcgaccgggucgccgcgaagaacgcccuggaguccuacaccuacaacaucaagcagaccguggaggacgagaagcuccgcggcaagaucagcgagcaggacaagaacaagauccuggacaagugccaggaggugaucaacuggcuggaccggaaccagauggccgagaaggacgaguacgagcacaagcagaaggagcucgagcgcgucugcaaccccaucaucuccaagcuguaccagggcgggcccgggggcgggagcggcggcgggggcuccggggccagcggcgggccgacgaucgaggagguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1530 - RNA, 2740 nt, Artificial Sequence
  mRNA product Design1 comprising derived and/or modified sequence from Homo sapiens__NP_002145.3 __HsHSPA4 (opt1)
gggagaaagcuuaccaugagcguggucggcaucgaccugggguuccaguccugcuacguggccguggcccgcgcgggcgggaucgagaccaucgccaacgaguacagcgaccggugcacccccgccugcaucuccuucggcccgaagaaccgcagcaucggggccgccgcgaagucccaggucaucagcaacgccaagaacacggugcagggcuucaagcgguuccacggccgcgccuucuccgaccccuucguggaggccgagaaguccaaccucgcguacgacaucguccagcugcccaccgggcugaccggcaucaaggugaccuacauggaggaggagcggaacuucacgaccgagcaggucaccgccaugcuccugagcaagcugaaggagaccgccgagagcgugcucaagaagcccgugguggacugcgucguguccgugccgugcuucuacacggacgccgagcgccggagcgucauggacgccacccagaucgcggggcugaacugccugcgccucaugaacgagaccaccgccguggcccuggccuacggcaucuacaagcaggaccugcccgcccucgaggagaagccccggaacguggucuucguggacauggggcacuccgcguaccaggugagcgucugcgccuucaaccgcggcaagcugaaggugcuggccacggccuucgacaccacccucggcgggcggaaguucgacgaggugcuggucaaccacuucugcgaggaguucggcaagaaguacaagcuggacaucaaguccaagauccgcgcccuccugcggcugagccaggagugcgagaagcucaagaagcugauguccgcgaacgccagcgaccugccccucuccaucgagugcuucaugaacgacguggacgucagcgggaccaugaaccgcggcaaguuccuggagaugugcaacgaccugcucgcccggguggagccgccccugcgcagcgugcuggagcagacgaagcucaagaaggaggacaucuacgccgucgagaucgugggcggggccacccggauccccgcggugaaggagaagaucuccaaguucuucggcaaggagcugagcaccacccugaacgccgacgaggccgucacgcgcgggugcgcccuccagugcgcgauccugucccccgccuucaaggugcgggaguucagcaucaccgacguggucccguaccccaucucccugcgcuggaacagccccgccgaggagggcuccagcgacugcgagguguucuccaagaaccacgccgcccccuucagcaaggugcucaccuucuaccggaaggagccguucacccuggaggcguacuacuccagcccccaggaccugcccuaccccgacccggccaucgcccaguucuccguccagaaggugacgccccagagcgacggguccagcuccaaggugaaggucaaggugcgcgugaacguccacggcaucuucagcguguccagcgccagccucguggagguccacaaguccgaggagaacgaggagcccauggagaccgaccagaacgccaaggaggaggagaagaugcaggucgaccaggaggagccccacguggaggagcagcagcagcagaccccggcggagaacaaggccgagagcgaggagauggagaccucccaggccggcagcaaggacaagaagauggaccagccgccccaggccaagaaggccaaggugaagacguccaccguggaccugcccaucgagaaccagcugcucuggcagaucgaccgcgagaugcugaaccuguacaucgagaacgaggggaagaugaucaugcaggacaagcucgagaaggagcggaacgacgcgaagaacgccguggaggaguacgucuacgagaugcgcgacaagcugagcggcgaguacgagaaguucguguccgaggacgaccggaacagcuucacccugaagcucgaggacaccgagaacuggcuguacgaggacggggaggaccagcccaagcaggucuacguggacaagcuggccgagcugaagaaccucggccagcccaucaagauccgcuuccaggaguccgaggagcggcccaagcuguucgaggagcuggggaagcagauccagcaguacaugaagaucaucagcuccuucaagaacaaggaggaccaguacgaccaccucgacgccgcggacaugacgaagguggagaaguccaccaacgaggccauggaguggaugaacaacaagcugaaccugcagaacaagcagagccucaccauggacccgguggucaagagcaaggagaucgaggccaagaucaaggagcugaccuccacgugcagccccaucaucuccaagcccaagcccaagguggagccgcccaaggaggagcagaagaacgccgagcagaacggccccguggacggccagggggacaaccccggcccgcaggccgcggagcaggggaccgacaccgccguccccagcgacagcgacaagaagcugcccgagauggacaucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1531 - RNA, 2737 nt, Artificial Sequence
  mRNA product Design1 comprising derived and/or modified sequence from Homo sapiens__NP_055093.2 __HsHSPA4L (opt1)
gggagaaagcuuaccaugagcguggucggcaucgaccugggguuccucaacugcuacaucgccguggcccgcuccggcgggaucgagaccaucgcgaacgaguacagcgaccggugcacccccgccugcaucucccugggcagccgcacgcgggccaucgggaacgccgccaagucccagaucgugaccaacguccgcaacaccauccacggcuucaagaagcugcacggccggagcuucgacgacccgaucgugcagaccgagcgcauccggcuccccuacgagcugcagaagaugcccaacggguccgcgggcgugaagguccgcuaccuggaggaggagcggcccuucgccaucgagcaggucacggggaugcuccuggccaagcugaaggagaccagcgagaacgcccucaagaagccgguggcggacugcgugaucuccauccccagcuucuucaccgacgccgagcgccgguccgugauggccgccgcccagguggcgggccugaacugccugcgccucaugaacgagaccacggccgucgcccuggccuacgggaucuacaagcaggaccugccgccccucgacgagaagccccggaacgugguguucaucgacaugggccacagcgccuaccagguccuggugugcgcguucaacaagggcaagcugaaggugcucgccaccaccuucgaccccuaccucgggggccgcaacuucgacgaggcccuggucgacuacuucugcgacgaguucaagaccaaguacaagaucaacgugaaggagaacucccgggcccugcugcgccuguaccaggagugcgagaagcucaagaagcugaugagcgccaacgcguccgaccugccccucaacaucgagugcuucaugaacgaccuggacgugagcuccaagaugaaccgggcccaguucgagcagcugugcgccagccuccuggcccgcgucgagcccccgcugaaggccgugauggagcaggcgaaccuccagcgggaggacaucuccagcaucgagaucgucgggggcgccacgcgcauccccgccgugaaggagcagaucaccaaguucuuccugaaggacaucagcaccacccugaacgccgacgaggcgguggcccggggcugcgcccuccagugcgccauccugucccccgccuucaagguccgcgaguucagcaucacggaccuggugcccuacuccaucacccuccgcuggaagaccagcuucgaggacggguccggcgagugcgagguguucugcaagaaccacccggcgcccuucagcaaggucaucaccuuccacaagaaggagcccuucgagcuggaggccuucuacacgaaccugcacgaggugcccuacccggacgcccggaucggguccuucaccauccagaacguguucccccagagcgacggcgacuccagcaaggucaaggugaaggugcgcgucaacauccacgggaucuucuccguggccagcgccuccgugaucgagaagcagaaccucgagggcgaccacagcgacgcgcccauggagaccgagaccuccuucaagaacgagaacaaggacaacauggacaagaugcaggucgaccaggaggagggccaccagaagugccacgccgagcacacgcccgaggaggagaucgaccacaccggggccaagaccaagagcgccguguccgacaagcaggaccggcugaaccagacccugaagaagggcaaggucaagagcaucgaccucccgauccaguccagccugugccgccagcuggggcaggaccuccugaacagcuacaucgagaacgagggcaagaugaucaugcaggacaagcuggagaaggagcggaacgacgccaagaacgcgguggaggaguacguguacgacuuccgcgaccggcuggggacgguguacgagaaguucaucacccccgaggaccucuccaagcugagcgccguccuggaggacaccgagaacuggcucuacgaggacggcgaggaccagcccaagcaggucuacguggacaagcugcaggagcugaagaaguacggccagcccauccagaugaaguacauggagcacgaggagcgcccgaaggcccucaacgaccuggggaagaagauccagcuggugaugaaggugaucgaggccuaccggaacaaggacgagcgcuacgaccaccucgaccccaccgagauggagaagguggagaagugcaucuccgacgcgaugagcuggcugaacuccaagaugaacgcccagaacaagcugagccucacgcaggaccccgucgugaagguguccgagaucgucgccaagagcaaggagcuggacaacuucugcaacccgaucaucuacaagcccaagcccaaggccgaggugcccgaggacaagccgaaggccaacuccgagcacaacggccccauggacgggcagagcggcaccgagaccaaguccgacagcaccaaggacuccagccagcacacgaaguccagcggggagauggagguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1532 - RNA, 2182 nt, Artificial Sequence
  mRNA product Design1 comprising derived and/or modified sequence from Homo sapiens__NP_005338.1__HsHSPA5 (opt1)
gggagaaagcuuaccaugaagcugagccucguggccgccaugcugcugcuccuguccgcggcccgcgccgaggaggaggacaagaaggaggacgucggcaccgugguggggaucgaccugggcaccacguacagcugcgucgggguguucaagaacggccggguggagaucaucgccaacgaccaggggaaccgcaucacccccuccuacgucgccuucaccccggagggcgagcggcucaucggcgacgcggccaagaaccagcugaccagcaaccccgagaacacgguguucgacgccaagcgccugaucgggcggaccuggaacgaccccuccgugcagcaggacaucaaguuccuccccuucaaggucguggagaagaagaccaagccguacauccagguggacaucggcgggggccagaccaagacguucgcccccgaggagaucagcgcgaugguccugaccaagaugaaggagaccgccgaggccuaccuggggaagaaggugacccacgccguggucacggugcccgccuacuucaacgacgcgcagcgccaggccaccaaggacgccggcaccaucgccggccucaacgugaugcggaucaucaacgagcccaccgccgcggccaucgccuacgggcuggacaagcgcgagggcgagaagaacauccuggucuucgaccucgggggcggcacguucgacgugucccugcugaccaucgacaacgggguguucgaggucguggccaccaacggcgacacccaccucgggggcgaggacuucgaccagcgggugauggagcacuucaucaagcuguacaagaagaagacggggaaggacguccgcaaggacaaccgggccgugcagaagcugcgccgggaggucgagaaggcgaagcgcgcccucagcucccagcaccaggcccggaucgagaucgagagcuucuacgagggcgaggacuucuccgagacccugacccgcgccaaguucgaggagcugaacauggaccucuuccggagcaccaugaagccggugcagaaggugcuggaggacuccgaccugaagaaguccgacaucgacgagaucguccucgugggcgggagcacgcgcauccccaagauccagcagcuggugaaggaguucuucaacggcaaggagcccagccgggggaucaaccccgacgaggccgucgcguacggcgccgccgugcaggccggggugcuguccggcgaccaggacaccggcgaccucguccugcuggacgugugcccgcucacccuggggaucgagaccgugggcggggucaugacgaagcugaucccccgcaacaccguggugcccaccaagaagucccagaucuucagcaccgcgagcgacaaccagcccacggucaccaucaagguguacgagggcgagcggccgcucaccaaggacaaccaccuccuggggaccuucgaccugacgggcaucccgcccgcgccccgcggcgugccccagaucgaggucaccuucgagaucgacgugaacgggauccugcgcgugaccgccgaggacaagggcaccgggaacaagaacaagaucaccaucacgaacgaccagaaccggcugacccccgaggagaucgagcgcauggucaacgacgccgagaaguucgccgaggaggacaagaagcucaaggagcggaucgacacccgcaacgagcuggagagcuacgccuacucccugaagaaccagaucggcgacaaggagaagcucggcgggaagcugagcuccgaggacaaggagaccauggagaaggccguggaggagaagaucgaguggcuggagagccaccaggacgccgacaucgaggacuucaaggccaagaagaaggagcucgaggagaucgugcagcccaucaucuccaagcuguacggcagcgccgggcccccgcccacgggcgaggaggacaccgcggagaaggacgagcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1533 - RNA, 2149 nt, Artificial Sequence
  mRNA product Design1 comprising derived and/or modified sequence from Homo sapiens__NP_002146.2__HsHSPA6 (opt1)
gggagaaagcuuaccaugcaggcgccccgcgagcuggccgugggcaucgaccucgggaccaccuacagcugcgucggcguguuccagcaggggcggguggagauccuggccaacgaccagggcaaccgcacgaccccguccuacgucgccuucaccgacaccgagcggcuggugggggacgccgccaagagccaggccgcgcucaacccccacaacacgguguucgacgccaagcgccugaucggccggaaguucgccgacaccaccguccaguccgacaugaagcacuggcccuuccgcguggugagcgagggcgggaagcccaagguccgggugugcuaccgcggcgaggacaagaccuucuacccggaggagaucuccagcauggugcuguccaagaugaaggagacggccgaggcguaccucgggcagcccgucaagcacgccgugaucaccgugcccgccuacuucaacgacagccagcggcaggccaccaaggacgccggcgcgaucgccgggcugaacguccugcgcaucaucaacgagcccaccgccgccgccaucgcguacggccucgaccggcgcggcgccggggagcggaacgugcugaucuucgaccugggcgggggcacguucgacguguccguccucagcaucgacgccggcguguucgaggugaaggccaccgccggggacacccaccugggcggggaggacuucgacaaccgccuggucaaccacuucauggaggaguuccggcgcaagcacggcaaggaccucuccgggaacaagcgggcgcugcgccggcugcgcaccgccugcgagcgggccaagcgcacgcucagcuccagcacccaggccacccuggagaucgacucccuguucgagggcguggacuucuacaccagcaucacgcgcgcccgguucgaggagcucugcuccgaccuguuccgcagcacccuggagccgguggagaaggcgcuccgggacgccaagcuggacaaggcccagauccacgacgucgugcuggucggcggguccacccgcauccccaaggugcagaagcuccugcaggacuucuucaacggcaaggagcugaacaagagcaucaaccccgacgaggccguggcguacggggccgccguccaggccgccgugcucaugggcgacaagugcgagaaggugcaggaccugcugcuccuggacgucgcgccccugagccucgggcuggagaccgccggcggcgugaugacgacccugauccagcggaacgccaccaucccgaccaagcagacgcagaccuucaccaccuacuccgacaaccagcccgggguguucauccaggucuacgagggcgagcgcgccaugacgaaggacaacaaccuccuggggcgguucgagcugagcggcaucccgcccgcgccccgcggggugccccagaucgaggugaccuucgacaucgacgccaacggcauccucuccgucaccgccaccgaccggagcacgggcaaggccaacaagaucaccaucaccaacgacaaggggcgccuguccaaggaggagguggagcggauggugcacgaggccgagcaguacaaggccgaggacgaggcgcagcgcgaccgggucgccgccaagaacagccuggaggcccacguguuccacgugaagggcucccuccaggaggagagccugcgcgacaagauccccgaggaggaccggcgcaagaugcaggacaagugccgggagguccuggcguggcucgagcacaaccagcuggccgagaaggaggaguacgagcaccagaagcgcgagcuggagcagaucugccggcccaucuucucccgccuguacgggggcccgggcgugcccgggggcagcuccugcgggacccaggcccgccagggcgaccccagcaccgggcccaucaucgaggagguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1534 - RNA, 1321 nt, Artificial Sequence
  mRNA product Design1 comprising derived and/or modified sequence from Homo sapiens__P48741__HsHSPA7 (opt1)
gggagaaagcuuaccaugcaggcgccccgcgagcuggccgugggcaucgaccucgggaccaccuacagcugcgucggcguguuccagcaggggcggguggagauccuggccaacgaccagggcaaccgcacgaccccguccuacgucgccuucaccgacaccgagcggcuggugggggacgccgccaagagccaggccgcgcucaacccccacaacacgguguucgacgccaagcgccugaucggccggaaguucgccgacaccaccguccaguccgacaugaagcacuggcccuuccagguggugagcgagggcgggaagcccaagguccgcgugugcuaccggggcgaggacaagaccuucuacccggaggagaucuccagcauggugcuguccaagaugaaggagacggccgaggcguaccucgggcagcccgucaagcacgccgugaucaccgugcccaccuacuucagcaacucccagcgccaggccaccaaggacgccggcgccaucgcggggcugaagguccugcccaucaucaacgaggccacggccgccgccaucgcguacggccucgaccggcgcggcgccgggaagcggaacgugcugaucuucgaccugggcgggggcaccuucgacgugagcguccucuccaucgacgccggcguguucgaggugaaggccaccgccggggacacccaccugggcggggaggacuucgacaaccgccuggucaaccacuucauggaggaguuccggcgcaagcacggcaaggaccucagcgggaacaagcgggcgcugcgccggcugcgcacggccugcgagcgggccaagcgcaccccguccagcuccacccaggccacccucgagaucgacagccuguucgagggcguggacuucuacaaguccaucacgcgggcccgcuucgaggagcugugcagcgaccucuuccgcuccacccuggagcccguggagaaggcgcugcgggacgccaagcucgacaaggcccagauccacgacuucguccugggcgggggccugcacagccacccccagggggccgagguggcggccggccuccugcagcgccagggggccgagcaggagcaccagcccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1535 - RNA, 2158 nt, Artificial Sequence
  mRNA product Design1 comprising derived and/or modified sequence from Homo sapiens__NP_006588.1 __HsHSPA8 (opt1)
gggagaaagcuuaccaugagcaagggccccgccguggggaucgaccugggcaccaccuacuccugcgucgggguguuccagcacggcaagguggagaucaucgccaacgaccaggggaaccgcacgacccccagcuacgucgcguucaccgacaccgagcggcucaucggcgacgccgccaagaaccagguggccaugaaccccacgaacaccguguucgacgccaagcgccugaucggccggcgcuucgacgacgcggucgugcaguccgacaugaagcacuggcccuucaugguggucaacgacgccgggcggcccaagguccagguggaguacaagggcgagaccaagagcuucuacccggaggagguguccagcauggugcugaccaagaugaaggagaucgccgaggccuaccucgggaagacggugaccaacgcggucgugaccgugcccgccuacuucaacgacucccagcgccaggccaccaaggacgccggcacgaucgccgggcugaacguccugcggaucaucaacgagcccaccgcggccgccaucgccuacggccucgacaagaaggugggcgccgagcgcaacgugcugaucuucgaccucgggggcgggaccuucgacgucagcauccugaccaucgaggacggcaucuucgaggugaaguccacggcgggcgacacccaccucgggggcgaggacuucgacaaccggauggugaaccacuucaucgccgaguucaagcgcaagcacaagaaggacaucagcgagaacaagcgggccguccgccggcugcgcaccgccugcgagcgggccaagcgcacccuguccagcuccacgcaggcgagcaucgagaucgacucccuguacgaggggaucgacuucuacaccagcaucacccgggcccgcuucgaggagcugaacgccgaccucuuccggggcacccuggaccccguggagaaggcccugcgcgacgccaagcucgacaagucccagauccacgacaucguccuggucgggggcagcacgcggaucccgaagauccagaagcugcuccaggacuucuucaacggcaaggagcugaacaaguccaucaaccccgacgaggcgguggccuacggggccgccgugcaggcggccauccugagcggcgacaagagcgagaacgugcaggaccuccugcugcucgacgugacgccccugucccuggggaucgagaccgccggcggggucaugaccgugcucaucaagcgcaacaccaccauccccaccaagcagacccagacguucaccaccuacagcgacaaccagccgggcgugcugauccaggucuacgagggcgagcgcgccaugaccaaggacaacaaccugcucgggaaguucgagcugacgggcaucccgcccgcgccccgcggggugccccagaucgaggugaccuucgacaucgacgccaacggcauccugaacgucuccgccguggacaagagcaccgggaaggagaacaagaucaccaucaccaacgacaagggccggcucuccaaggaggacaucgagcggauggugcaggaggccgagaaguacaaggccgaggacgagaagcagcgcgacaaggucagcuccaagaacagccuggaguccuacgccuucaacaugaaggcgacgguggaggacgagaagcugcagggcaagaucaacgacgaggacaagcagaagauccucgacaagugcaacgagaucaucaacuggcuggacaagaaccagaccgccgagaaggaggaguucgagcaccagcagaaggagcuggagaaggugugcaaccccaucaucaccaagcucuaccagagcgccgggggcaugcccgggggcaugcccggcggguucccgggcgggggcgccccgcccuccgggggcgccagcuccggccccaccaucgaggaggucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1536 - RNA, 2257 nt, Artificial Sequence
  mRNA product Design1 comprising derived and/or modified sequence from Homo sapiens__NP_004125.3 __HsHSPA9 (opt1)
gggagaaagcuuaccaugaucagcgccucccgcgccgcggccgcccggcuggugggcgccgccgcgagccgcgggcccaccgccgcccggcaccaggacuccuggaacggccucagccacgaggccuuccgccuggucucccggcgcgacuacgcgagcgaggccaucaagggggccguggugggcaucgaccuggggaccacgaacuccugcgucgccgugauggagggcaagcaggccaaggugcucgagaacgcggagggcgcccggaccaccccgagcgucguggccuucaccgccgacggggagcgccuggugggcaugcccgccaagcggcaggcggucacgaaccccaacaacaccuucuacgccaccaagcgccugaucgggcggcgcuacgacgaccccgaggugcagaaggacaucaagaacgugccguucaagaucguccgggccuccaacggcgacgccuggguggaggcccacgggaagcucuacagccccucccagaucggcgcguucgugcugaugaagaugaaggagaccgccgagaacuaccugggccacacggccaagaacgccgucaucaccgugcccgccuacuucaacgacagccagcgccaggcgaccaaggacgccgggcagaucuccggccucaacgugcugcgggucaucaacgagcccaccgccgccgcgcuggccuacgggcucgacaagagcgaggacaaggugaucgccguguacgaccugggcggcgggacguucgacaucuccauccuggagauccagaagggcgucuucgaggucaagagcaccaacggggacaccuuccucggcggggaggacuucgaccaggcccugcugcgccacaucgugaaggaguucaagcgggagaccggcguggaccucacgaaggacaacauggcccugcagcgcgugcgggaggcggccgagaaggccaagugcgagcuguccagcuccguccagaccgacaucaaccucccguaccugaccauggacagcagcggccccaagcaccugaacaugaagcucacccgcgcccaguucgaggggaucgugacggaccugauccggcgcaccaucgcccccugccagaaggcgaugcaggacgccgagguguccaagagcgacaucggcgaggucauccuggucgggggcaugacccgcaugcccaaggugcagcagaccgugcaggaccucuucgggcgggccccguccaaggccgugaaccccgacgaggccguggcgaucggcgccgccauccagggcgggguccuggccggcgacgugacggacgugcugcuccuggacgucacgccccugagccucgggaucgagacccugggcgggguguucaccaagcugaucaaccgcaacaccaccauccccaccaagaagucccagguguucagcaccgcggccgacggccagacgcaggucgagaucaaggugugccagggcgagcgggagauggccggggacaacaagcuccugggccaguucacccugaucgggaucccgcccgcgccccgcggcgugccccagaucgaggucaccuucgacaucgacgccaacggcaucgugcacguguccgccaaggacaaggggaccggccgggagcagcagaucgucauccagagcuccgggggccucagcaaggacgacaucgagaacauggugaagaacgccgagaaguacgccgaggaggaccgccggaagaaggagcgcguggaggccgucaacauggccgaggggaucauccacgacacggagaccaagauggaggaguucaaggaccagcugccggcggacgagugcaacaagcugaaggaggagaucuccaagaugcgggagcuccuggcccgcaaggacagcgagaccggcgagaacauccggcaggccgccuccagccugcagcaggccucccucaagcuguucgagauggcguacaagaagauggccagcgagcgcgagggcuccgggagcuccggcaccggggagcagaaggaggaccagaaggaggagaagcagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1537 - RNA, 2245 nt, Artificial Sequence
  mRNA product Design1 comprising derived and/or modified sequence from Homo sapiens__NP_079291.2__HsHSPA12A (opt1)
gggagaaagcuuaccauggccgacaaggaggccggcgggagcgacggcccccgcgagaccgcgccgaccuccgccuacagcucccccgcccggagccugggggacacgggcaucacgccccucucccccagccacaucgugaacgacaccgacuccaacgucagcgagcagcaguccuuccuggugguggucgccguggacuucgggaccaccagcuccggcuacgccuacagcuucaccaaggagccggagugcauccacgugaugcgccggugggagggcggggaccccggcgucuccaaccagaagacccccaccacgauccugcucacccccgagcgcaaguuccacagcuucggguacgcggcccgggacuucuaccacgaccuggacccgaacgaggccaagcaguggcuguaccucgagaaguucaagaugaagcugcacaccaccggcgaccugacgauggacaccgaccucaccgccgcgaacgggaagaaggugaaggcccuggagaucuucgccuacgcccugcaguacuucaaggagcaggcccucaaggagcuguccgaccaggcgggcagcgaguucgagaacuccgacgugcgcugggucaucaccgugcccgccaucuggaagcagcccgccaagcaguucaugcggcaggccgccuaccaggcgggccuggccagccccgagaacuccgagcagcucaucaucgcccuggagccggaggccgccagcaucuacugccgcaagcugcggcuccaccagaugaucgagcugagcuccaaggcggccgugaacggguacagcggcuccgacacggucggggccggcuucacccaggccaaggagcacauccgccggaaccgccagagccggaccuuccugguggagaacgugaucggcgagaucugguccgagcucgaggagggggacaaguacgucgugguggacagcggcgggggcaccgucgaccugacggugcaccagauccgccugcccgaggggcaccucaaggagcuguacaaggccaccggcggccccuacgggucccugggcguggacuacgaguucgagaagcuccuguacaagaucuucggggaggacuucaucgagcaguucaagaucaagcggcccgcggccugggucgaccugaugaucgccuucgagagccgcaagcgggccgcggccccggaccgcaccaacccccucaacaucacccugcccuucuccuucaucgacuacuacaagaaguuccggggccacagcguggagcacgcccugcgcaaguccaacguggacuucgucaaguggagcucccaggggaugcuccggaugagccccgacgccaugaacgcccuguucaagccgacgaucgacuccaucaucgagcaccuccgcgaccuguuccagaagcccgaggugagcaccgucaaguuccuguuccuggugggcggcuucgcggaggcgccccuccugcagcaggccgugcaggccgccuucggggaccagugccgcaucaucaucccccaggacgucggccugaccauccucaagggggccgugcuguucggccuggacccggccgugaucaagguccggcgcagcccccucaccuacggggugggcgugcugaaccgguacgucgagggcaagcacccgcccgagaagcugcucgugaaggacgggacgcgcuggugcaccgacguguucgacaaguucaucuccgccgaccaguccgucgcccugggcgagcuggugaagcggagcuacacccccgccaagcccagccagcuggugaucgucaucaacaucuacuccagcgagcacgacaacguguccuucaucaccgaccccggggugaagaagugcggcacgcuccgccuggaccugaccggcaccagcgggaccgcggucccggcccggcgcgagauccagacgcucaugcaguucggcgacaccgagaucaaggccaccgccaucgacaucgcgaccuccaagagcgugaagguggggaucgacuuccugaacuacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1538 - RNA, 2278 nt, Artificial Sequence
  mRNA product Design1 comprising derived and/or modified sequence from Homo sapiens__NP_443202.3 __HsHSPA12B (opt1)
gggagaaagcuuaccaugcuggccgugcccgagaugggccuccaggggcuguacaucggcagcucccccgagcgcagccccguccccuccccgcccgggagcccccggacccaggaguccugcggcaucgccccgcugacccccagccagucccccaagcccgaggugcgcgcgccccagcaggccagcuucuccguggucguggccaucgacuucgggacgaccagcuccggcuacgccuucagcuucgccuccgaccccgaggcgauccacaugaugcggaagugggagggcggggacccgggcguggcccaccagaagaccccgaccugccuccugcugacgcccgagggggccuuccacagcuucggcuacaccgcccgcgacuacuaccacgaccucgaccccgaggaggcgcgggacuggcuguacuucgagaaguucaagaugaagauccacuccgccaccgaccugacccucaagacgcagcuggaggccgucaacgggaagaccaugcccgcccuggagguguucgcccacgcgcuccgcuucuuccgggagcacgcccugcaggagcugcgcgagcagagccccucccuccccgagaaggacaccgugcgguggguccugaccgugcccgccaucuggaagcagccggccaagcaguucaugcgcgaggccgcguaccuggccggccucgugagccgggagaacgccgagcagcugcugaucgcccucgagcccgaggccgcguccgucuacugccgcaagcugcggcugcaccagcuccuggaccugagcggccgcgcccccgggggcgggcggcucggcgagcgccggagcaucgacuccagcuuccgccaggcccgggagcagcugcgccggucccgccacagccgcacguuccugguggaguccggcgugggggagcucugggccgagaugcaggccggcgaccgguacgucguggcggacugcgggggcgggaccguggaccugaccguccaccagcuggagcagccccacggcacccucaaggagcuguacaaggccagcggcgggccguacggcgccguggggguggaccuggccuucgagcagcuccugugccgcaucuucggcgaggacuucaucgcgacguucaagcggcagcgccccgccgccugggucgaccugaccaucgccuucgaggcccggaagcgcaccgcggggccccaccgggccggcgcccucaacaucucccugcccuucagcuucaucgacuucuaccgcaagcagcggggccacaacguggagaccgcccugcgccgguccagcgugaacuucgucaagugguccagccaggggaugcuccgcauguccugcgaggccaugaacgagcuguuccagccgacggugagcggcaucauccagcacaucgaggcgcugcucgcccggcccgagguccagggggugaagcugcuguuccucgugggcggguucgccgaguccgccguccugcagcacgccgugcaggcggcccugggcgcccgcggccugcggguggucgugccccacgacguggggcucaccauccugaagggcgccguccuguucgggcaggcgccgggcguggugcgcguccggcgcagcccccucaccuacggcgugggggugcugaaccgguucguccccggccgccacccgcccgagaagcugcucgugcgcgacgggcggcgcuggugcaccgacguguucgagcgguucgucgccgccgagcaguccguggcccugggcgaggaggugcgccggagcuacugccccgcccgccccgggcagcggcgcguccugaucaaccucuacugcugcgcggccgaggacgcccgguucaucacggaccccggcgugcgcaagugcggcgcccugucccuggagcucgagccggccgacugcgggcaggacaccgcgggcgccccgcccgggcggcgcgagauccgggccgccaugcaguucggcgacaccgagaucaaggugaccgccgucgacgugagcacgaaccgcagcgugcgggcguccaucgacuuccugagcaacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1539 - RNA, 1633 nt, Artificial Sequence
  mRNA product Design1 comprising derived and/or modified sequence from Homo sapiens__NP_008879.3__HsHSPA13 (opt1)
gggagaaagcuuaccauggcccgggagaugaccauccugggcagcgccgugcucacccugcugcucgcgggguaccuggcccagcaguaccugccccucccgacgcccaaggucaucggcaucgaccuggggaccaccuacugcuccgugggcguguucuuccccgggaccggcaaggucaaggugauccccgacgagaacggccacaucagcaucccguccauggugagcuucacggacaacgacgucuacgugggguacgaguccguggagcuggccgacagcaacccccagaacaccaucuacgacgccaagcgguucaucggcaagaucuucaccgccgaggagcucgaggcggagaucgggcgcuaccccuucaagguccugaacaagaacggcaugguggaguucuccgugaccagcaacgagacgaucaccgucucccccgaguacguggggagccggcugcuccugaagcugaaggagauggccgaggccuaccucggcaugccgguggccaacgcggucaucuccgugcccgccgaguucgaccugaagcagcgcaacagcaccaucgaggccgccaaccuggccggccucaagauccugcgggugaucaacgagcccaccgcggccgccauggccuacgggcugcacaaggccgacgucuuccacgugcucgugaucgaccugggcgggggcacgcuggacgucucccuccugaacaagcagggcgggauguuccugacccgcgcgaugagcggcaacaacaagcucgggggccaggacuucaaccagcggcugcugcaguaccucuacaagcagaucuaccagaccuacggguucgugcccucccgcaaggaggagauccaccggcugcgccaggccguggagauggucaagcugaaccucacccugcaccagagcgcccagcuguccgugcuccugacggucgaggagcaggaccggaaggagccgcacagcuccgacaccgagcugcccaaggacaagcucagcagcgccgacgaccaccgcgugaacuccggcuucggccgggggcugagcgacaagaaguccggcgagagccaggugcuguucgagaccgagaucucccgcaagcuguucgacacccugaacgaggaccuguuccagaagauccucguccccauccagcagguccugaaggaggggcaccuggagaagacggagaucgacgagguggugcucgugggcgggagcacccggaucccccgcauccgccaggugauccaggaguucuucggcaaggacccgaacaccuccgucgaccccgaccuggccguggugaccggcgucgcgauccaggccgggaucgacggcgggagcuggccccuccagguguccgcccuggagauccccaacaagcaccuccagaagacgaacuucaacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1540 - RNA, 1747 nt, Artificial Sequence
  mRNA product Design1 comprising derived and/or modified sequence from Homo sapiens__NP_057383.2__HsHSPA14 (opt1)
gggagaaagcuuaccauggccgccaucggcgugcaccuggggugcaccagcgcgugcgucgccguguacaaggacggccgcgccgggguggucgccaacgacgccggcgaccgggugacccccgcgguggucgccuacuccgagaacgaggagaucguggggcucgccgccaagcagagccgcauccggaacaucuccaacacggugaugaaggucaagcagauccugggccgcagcuccagcgacccgcaggcgcagaaguacaucgccgaguccaagugccuggugaucgagaagaacggcaagcuccgguacgagaucgacaccggggaggagaccaaguucgugaaccccgaggacgucgcccgccugaucuucagcaagaugaaggagaccgcccacuccgugcugggcagcgacgccaacgacguggucaucacggugcccuucgacuucggggagaagcagaagaacgcgcucggcgaggccgcccgggccgccggguucaacgugcugcgccugauccacgagcccuccgcggcccuccuggccuacggcaucggccaggacagcccgaccgggaaguccaacauccuggucuucaagcucggcgggaccagccugucccugagcgugauggaggugaacuccggcaucuaccggguccucagcaccaacacggacgacaacaucggcggggcccacuucaccgagacccuggcccaguaccuggcguccgaguuccagcgcagcuucaagcacgacgugcggggcaacgcccgcgccaugaugaagcucaccaacagcgccgagguggccaagcacucccugagcacgcugggguccgcgaacugcuuccucgacagccuguacgagggccaggacuucgacugcaacgucucccgggcccgcuucgagcugcucugcagcccccuguucaacaagugcaucgaggccauccgggggcugcucgaccagaacggcuucaccgccgacgacaucaacaaggugguccugugcggcggguccagccgcauccccaagcugcagcagcucaucaaggaccuguuccccgcgguggagcugcucaacuccaucccgcccgacgaggugauccccaucggcgccgccaucgaggccgggauccugaucggcaaggagaaccugcucgucgaggacagccugaugaucgagugcuccgcccgggacauccuggugaaggggguggacgagagcggcgcgucccgcuucaccguccucuuccccagcggcaccccgcugcccgcccggcgccagcacacgcugcaggcccccggguccaucagcuccgugugccucgagcuguacgagagcgacggcaagaacuccgccaaggaggagaccaaguucgcccaggugguccugcaggaccucgacaagaaggagaacgggcugcgggacauccuggcggugcucaccaugaagcgcgacggcagccugcacgugaccugcacggaccaggagaccgggaagugcgaggccaucagcaucgagaucgccuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1541 - RNA, 2794 nt, Artificial Sequence
  mRNA product Design1 comprising derived and/or modified sequence from Homo sapiens__NP_006635.2 __HsHSPH1 (opt1)
gggagaaagcuuaccaugagcguggucggccuggacguggggucccagagcugcuacaucgccguggcccgcgcgggcgggaucgagaccaucgccaacgaguucuccgaccggugcacccccagcgucaucuccuucggcagcaagaaccgcaccaucgggguggccgccaagaaccagcagaucacccacgccaacaacaccguguccaacuucaagcgguuccacggccgcgcguucaacgacccguucauccagaaggagaaggagaaccucagcuacgaccuggucccccugaagaacggcggggugggcaucaaggugauguacaugggggaggagcaccucuucuccgucgagcagaucaccgccaugcugcugacgaagcucaaggagaccgccgagaacagccugaagaagcccgugaccgacugcgugaucuccguccccagcuucuucaccgacgccgagcggcgcuccgugcuggacgcggcccagaucgugggccucaacugccugcggcugaugaacgacaugacggccgucgcccucaacuacgggaucuacaagcaggaccugccgagccuggacgagaagccccgcaucgugguguucgucgacaugggccacuccgccuuccaggugagcgcgugcgccuucaacaagggcaagcucaaggugcuggggaccgccuucgaccccuuccugggcgggaagaacuucgacgagaagcucgucgagcacuucugcgccgaguucaagaccaaguacaagcuggacgccaaguccaagauccgggcgcugcuccgccuguaccaggagugcgagaagcugaagaagcucaugagcuccaacagcaccgaccugccccugaacaucgagugcuucaugaacgacaaggacgugagcggcaagaugaaccggucccaguucgaggagcucugcgccgagcugcugcagaagaucgaggugccgcucuacagccugcuggagcagacgcaccucaaggucgaggacguguccgccgucgagaucgugggcggggccacccgcauccccgccgugaaggagcggaucgcgaaguucuucggcaaggacaucagcaccacccugaacgccgacgaggccgucgcccgcgggugcgcccugcagugcgcgauccucucccccgccuucaaggugcgggaguucagcgugacggacgccguccccuucccgaucucccugaucuggaaccacgacagcgaggacaccgagggcgugcacgagguguucucccgcaaccacgccgcgcccuucagcaagguccugaccuuccuccggcgcgggcccuucgagcuggaggccuucuacuccgacccccagggcgugccguaccccgaggccaagaucggccgguucgugguccagaacgugagcgcccagaaggacggggagaagucccgcgugaaggucaaggugcgggugaacacccacggcaucuucacgaucagcaccgccuccauggucgagaaggugcccaccgaggagaacgagaugagcuccgaggcggacauggagugccugaaccagcggcccccggagaaccccgacaccgacaagaacgugcagcaggacaacagcgaggccgggacgcagccccagguccagaccgacgcccagcagaccucccagagcccgcccagccccgagcucaccuccgaggagaacaagauccccgacgccgacaaggccaacgagaagaagguggaccagcccccggaggcgaagaagcccaagaucaagguggucaacguggagcugcccaucgaggccaaccugguguggcagcucggcaaggaccugcugaacauguacaucgagacggaggggaagaugaucaugcaggacaagcucgagaaggagcgcaacgacgccaagaacgccgucgaggaguacguguacgaguuccgcgacaagcugugcggcccguacgagaaguucaucugcgagcaggaccaccagaacuuccugcgccugcucaccgagaccgaggacuggcuguacgaggagggcgaggaccaggccaagcaggcguacguggacaagcuggaggagcucaugaagaucgggacccccgucaaggugcgguuccaggaggccgaggagcgccccaagauguucgaggagcugggccagcggcugcagcacuacgccaagaucgccgcggacuuccgcaacaaggacgagaaguacaaccacaucgacgagagcgagaugaagaagguggagaaguccgucaacgaggugauggaguggaugaacaacgugaugaacgcccaggccaagaagucccucgaccaggaccccgucgugcgggcccaggagaucaagacgaagaucaaggagcugaacaacacgugcgagccgguggucacccagcccaagcccaagaucgagagccccaagcuggagcgcaccccgaacgggcccaacaucgacaagaaggaggaggaccucgaggacaagaacaacuucggcgccgagccgccccaccagaacggggagugcuaccccaacgagaagaacagcgugaacauggaccuggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1542 - RNA, 3217 nt, Artificial Sequence
  mRNA product Design1 comprising derived and/or modified sequence from Homo sapiens__NP_006380.1 __HsHYOU1 (opt1)
gggagaaagcuuaccauggccgacaaggugcgccggcagcgcccccggcgccgggucugcugggcccugguggcggugcuccuggccgaccugcucgcccugagcgacacccuggccgucauguccguggaccucggcagcgaguccaugaagguggccaucgucaagccgggggugcccauggagaucgugcugaacaaggagagccgccggaagacccccgucaucgugacgcugaaggagaacgagcgcuucuucggcgacuccgcggccagcauggccaucaagaaccccaaggccacccuccgguacuuccagcaccuccuggggaagcaggcggacaacccgcacguggcccuguaccaggcccgcuuccccgagcacgagcugaccuucgacccccagcggcagaccguccacuuccagaucuccagccagcugcaguucucccccgaggaggugcucggcauggugcugaacuacagccgcucccuggccgaggacuucgccgagcagccgaucaaggacgcggucaucacggugcccguguucuucaaccaggccgagcggcgcgccguccuccaggccgcccggauggcggggcugaaggugcugcagcucaucaacgacaacaccgccaccgcccugagcuacggcguguuccgccggaaggacaucaacaccacggcccagaacaucauguucuacgacaugggcuccgggagcaccgucugcaccaucgugaccuaccagauggugaagacgaaggaggccggcaugcagccccagcugcagauccgcggggucggcuucgaccggacccucgggggccuggagauggagcugcgccuccgggagcgccuggcgggccuguucaacgagcagcgcaaggggcagcgggccaaggacgugcgcgagaacccccgggccauggccaagcuccugcgcgaggccaaccggcugaagaccguccucuccgcgaacgccgaccacauggcccagaucgagggccugauggacgacguggacuucaaggccaaggugacccgcgucgaguucgaggagcugugcgcggaccucuucgagcgggugccggggcccgugcagcaggcccugcagagcgccgagaugucccuggacgagaucgagcaggucauccucgugggcggcgccacgcgcgugccccggguccaggaggugcugcugaaggccguggggaaggaggagcucggcaagaacaucaacgcggacgaggccgccgccaugggggccgucuaccaggcggccgcccugagcaaggccuucaaggugaagcccuucgugguccgcgacgccgugguguacccgauccuggucgaguucacccgggagguggaggaggagcccggcauccacucccucaagcacaacaagcgcgugcuguucagccggauggggcccuacccccagcgcaaggucaucaccuucaaccgguacagccacgacuucaacuuccacaucaacuacggcgaccugggcuuccucgggccggaggaccugcgcguguucggcucccagaaccugaccacggugaagcugaagggggucggcgacagcuucaagaaguaccccgacuacgaguccaaggggaucaaggcgcacuucaaccucgacgagagcggcgugcugucccuggaccggguggagagcgucuucgagacccucguggaggacuccgccgaggaggagagcacccugaccaagcugggcaacacgaucuccagccucuucgggggcgggaccacccccgacgccaaggagaacggcaccgacacggugcaggaggaggaggagucccccgccgaggggagcaaggacgagccgggcgagcaggucgagcugaaggaggaggcggaggcccccguggaggacggcucccagccgccgccgcccgagcccaagggggacgccacccccgagggcgagaaggccaccgagaaggagaacggggacaagagcgaggcccagaagcccuccgagaaggcggaggccggccccgagggcguggcccccgcccccgagggggagaagaagcagaagcccgcccgcaagcggcgcauggucgaggagaucggcguggagcuggugguccucgaccugcccgaccugcccgaggacaagcucgcgcagagcgugcagaagcugcaggaccugacccuccgcgaccuggagaagcaggagcgggagaaggccgccaacucccuggaggccuucaucuucgagacgcaggacaagcucuaccagccggaguaccaggaggugagcaccgaggagcagcgcgaggagaucuccgggaagcugagcgccgcgagcaccuggcuggaggacgagggcgucggggccaccacggugaugcucaaggagaagcuggccgagcugcggaagcucugccagggccuguucuuccgcguggaggagcggaagaaguggcccgagcgccuguccgcccucgacaaccugcugaaccacagcuccauguuccucaagggcgcgcggcugauccccgagauggaccagaucuucaccgaggucgagaugaccacccuggagaaggugaucaacgagaccugggccuggaagaacgccacgcucgccgagcaggccaagcugcccgcgaccgagaagccggugcugcucagcaaggacaucgaggccaagaugauggcccuggaccgcgagguccaguaccugcucaacaaggccaaguucaccaagccccggccccgccccaaggacaagaacgggacccgggccgagccgccccugaacgcguccgccagcgaccagggcgagaaggugaucccgcccgccgggcagacggaggacgccgagcccaucuccgagcccgagaagguggagaccggcagcgagcccggggacaccgagccccuggagcucggcggcccgggggccgagcccgagcagaaggagcaguccaccggccagaagcgcccccugaagaacgacgagcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1543 - RNA, 2416 nt, Artificial Sequence
  mRNA product Design1 comprising derived and/or modified sequence from Homo sapiens__NP_005339.3 __HsHSP90AA1 (opt1)
gggagaaagcuuaccaugcccgaggagacccagacccaggaccagcccauggaggaggaggagguggagacguucgccuuccaggccgagaucgcgcagcugaugagccucaucaucaacaccuucuacuccaacaaggagaucuuccugcgcgagcugaucagcaacuccagcgacgcccucgacaagauccgguacgagucccugaccgaccccagcaagcuggacuccggcaaggagcuccacaucaaccugauccccaacaagcaggaccgcacccugacgaucgucgacaccgggaucggcaugaccaaggccgaccucaucaacaaccuggggaccaucgccaagagcggcacgaaggccuucauggaggcgcugcaggccggggccgacaucuccaugaucggccaguucggcgugggguucuacagcgccuaccucguggcggagaaggucaccgugaucaccaagcacaacgacgacgagcaguacgccugggaguccagcgccggcggguccuucaccgugcggacggacaccggcgagcccauggggcgcggcaccaaggucauccugcaccugaaggaggaccagaccgaguaccucgaggagcggcgcaucaaggagaucgugaagaagcacagccaguucaucggcuacccgaucacgcuguucguggagaaggagcgggacaaggaggucuccgacgacgaggccgaggagaaggaggacaaggaggaggagaaggagaaggaggagaaggagagcgaggacaagcccgagaucgaggacgugggguccgacgaggaggaggagaagaaggacggcgacaagaagaagaagaagaagaucaaggagaaguacaucgaccaggaggagcugaacaagaccaagcccaucuggacccgcaaccccgacgacaucaccaacgaggaguacggggaguucuacaagagccucacgaacgacugggaggaccaccuggccgugaagcacuucuccgucgagggccagcuggaguuccgggcgcuccuguucgugccgcgccgggcccccuucgaccuguucgagaaccgcaagaagaagaacaacaucaagcucuacgugcggcgcgucuucaucauggacaacugcgaggagcugauccccgaguaccugaacuucauccggggcgugguggacagcgaggaccucccccugaacaucagccgcgagaugcugcagcaguccaagauccucaaggucauccggaagaaccuggugaagaagugccuggagcuguucaccgagcucgccgaggacaaggagaacuacaagaaguucuacgagcaguucagcaagaacaucaagcuggggauccacgaggacucccagaaccgcaagaagcucagcgagcugcugcgguacuacaccuccgccagcggcgacgagauggugucccucaaggacuacugcacccgcaugaaggagaaccagaagcacaucuacuacaucacgggggagaccaaggaccaggucgccaacagcgcguucguggagcggcugcgcaagcacggccuggaggugaucuacaugaucgagccgaucgacgaguacugcguccagcagcucaaggaguucgaggggaagacccugguguccgucaccaaggagggccuggagcuccccgaggacgaggaggagaagaagaagcaggaggagaagaagacgaaguucgagaaccugugcaagaucaugaaggacauccuggagaagaagguggagaagguggucgugagcaaccgccucgugaccucccccugcugcaucgucaccagcaccuacggcuggacggccaacauggagcggaucaugaaggcccaggcccugcgcgacaacuccaccaugggguacauggccgcgaagaagcaccuggagaucaaccccgaccacagcaucaucgagacccugcggcagaaggccgaggccgacaagaacgacaaguccgugaaggaccucgugauccugcuguacgagaccgcccuccugagcuccggcuucagccuggaggacccgcagacgcacgccaaccgcaucuaccggaugaucaagcucgggcugggcaucgacgaggacgaccccaccgcggacgacaccuccgccgccgucaccgaggagaugccgccccuggagggggacgacgacaccagccgcauggaggagguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1544 - RNA, 556 nt, Artificial Sequence
  mRNA product Design1 comprising derived and/or modified sequence from Homo sapiens__NG_005218__HsHSP90AA3P (opt1)
gggagaaagcuuaccauggacagcuccaagcuggacagcggcaaggggcuccacaucaaccuggugcccaacaagcagaaccagacccugaccaucgucgacacgcgcaucggcaugaccaagaccgaccucaucaacaaccuggggaccgugacgaaguccggcaccaaggccuucauggaggcccugcaggcggacgccgacaucagcaugaucgggcacuucggcgugggcuucuacuccgccuaccucgucgccaagaaggugaccgugaucagcaagcacaacaacgacgagcaguacaccugggaguccagcgccgggggcuccuucacgguccggaccgacgagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1545 - RNA, 2392 nt, Artificial Sequence
  mRNA product Design1 comprising derived and/or modified sequence from Homo sapiens__NP_031381.2__HsHSP90AB1 (opt1)
gggagaaagcuuaccaugcccgaggaggugcaccacggcgaggaggaggucgagaccuucgccuuccaggccgagaucgcgcagcugaugagccucaucaucaacaccuucuacuccaacaaggagaucuuccugcgcgagcugaucagcaacgccuccgacgcccucgacaagauccgguacgagagccugacggacccguccaagcuggacagcgggaaggagcucaagaucgacaucauccccaacccccaggagcgcacccugacccugguggacaccggcaucgggaugacgaaggccgaccucaucaacaaccugggcaccaucgccaaguccgggaccaaggcguucauggaggcccugcaggccggcgccgacaucagcaugaucggccaguucggggugggcuucuacuccgcguaccucgucgccgagaaggugguggucaucaccaagcacaacgacgacgagcaguacgccugggagagcuccgccgggggcagcuucacggugcgggccgaccacggggagcccaucggccgcggcaccaaggugauccugcaccugaaggaggaccagaccgaguaccucgaggagcggcgcgucaaggagguggugaagaagcacucccaguucaucggguacccgaucacccuguaccuggagaaggagcgggagaaggagaucagcgacgacgaggcggaggaggagaagggcgagaaggaggaggaggacaaggacgacgaggagaagcccaagaucgaggacgucggguccgacgaggaggacgacagcggcaaggacaagaagaagaagacgaagaagaucaaggagaaguacaucgaccaggaggagcucaacaagaccaagcccaucuggacccgcaaccccgacgacaucacccaggaggaguacggcgaguucuacaagucccugacgaacgacugggaggaccaccuggccgugaagcacuucagcguggaggggcagcucgaguuccgggcccugcuguucaucccgcgccgggcccccuucgaccucuucgagaacaagaagaagaagaacaacaucaagcuguacguccgccggguguucaucauggacuccugcgacgagcugauccccgaguaccucaacuucauccgcggcguggucgacagcgaggaccugccccugaacaucagccgggagaugcuccagcaguccaagauccugaaggugauccgcaagaacaucgugaagaagugccuggagcuguucagcgagcucgccgaggacaaggagaacuacaagaaguucuacgaggcguucuccaagaaccugaagcucgggauccacgaggacagcaccaaccggcgccggcuguccgagcugcuccgcuaccacaccagccaguccggcgacgagaugaccagccuguccgaguacgucagccggaugaaggagacgcagaaguccaucuacuacaucaccggggagagcaaggagcaggucgccaacuccgccuucguggagcgcgugcgcaagcggggcuucgagguggucuacaugaccgagccgaucgacgaguacugcgugcagcagcugaaggaguucgacggcaagagccucguguccgucaccaaggaggggcuggagcugcccgaggacgaggaggagaagaagaagauggaggagagcaaggccaaguucgagaaccucugcaagcugaugaaggagauccuggacaagaagguggagaaggugacgaucuccaaccgccucgucagcucccccugcugcaucgugaccagcaccuacggcuggaccgccaacauggagcggaucaugaaggcgcaggcccugcgcgacaacagcacgaugggguacaugauggccaagaagcaccuggagaucaaccccgaccacccgaucguggagacccugcggcagaaggccgaggccgacaagaacgacaaggcggucaaggaccucguggugcugcuguucgagaccgcccuccuguccagcggcuucucccuggaggacccccagacccacagcaaccgcaucuaccggaugaucaagcucgggcugggcaucgacgaggacgaggucgccgccgaggagcccaacgcggccgugcccgacgagaucccgccccuggagggcgacgaggacgccucccgcauggaggagguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1546 - RNA, 2629 nt, Artificial Sequence
  mRNA product Design1 comprising derived and/or modified sequence from Homo sapiens__NP_003290.1__HsHSP90B1 (opt1)
gggagaaagcuuaccaugcgcgcccugugggugcucggccugugcugcguccugcucaccuucgggagcgugcgggccgacgacgagguggacgucgacggcaccguggaggaggaccuggggaagucccgcgagggcagccggacggacgacgaggugguccagcgcgaggaggaggcgauccagcuggacgggcucaacgccucccagauccgggagcugcgcgagaaguccgagaaguucgccuuccaggccgaggugaaccggaugaugaagcugaucaucaacagccucuacaagaacaaggagaucuuccugcgcgagcugaucagcaacgccuccgacgcgcucgacaagauccggcugaucagccugaccgacgagaacgcccucuccggcaacgaggagcugaccgugaagaucaagugcgacaaggagaagaaccugcuccacgucaccgacacgggcguggggaugacccgcgaggagcuggugaagaaccugggcaccaucgccaagagcgggaccuccgaguuccucaacaagaugacggaggcccaggaggacggccagagcaccuccgagcugaucgggcaguucggcgucggcuucuacagcgcguuccugguggccgacaaggugaucgucaccuccaagcacaacaacgacacccagcacaucugggagagcgacuccaacgaguucagcgugaucgccgacccccgggggaacacgcucggccgcgggaccaccaucacccuggugcugaaggaggaggccuccgacuaccucgagcuggacacgaucaagaaccuggucaagaaguacagccaguucaucaacuucccgaucuacguguggagcuccaagaccgagaccguggaggagcccauggaggaggaggaggccgcgaaggaggagaaggaggagagcgacgacgaggccgccgucgaggaggaggaggaggagaagaagcccaagaccaagaagguggagaagacggugugggacugggagcucaugaacgacaucaagcccaucuggcagcggccguccaaggaggucgaggaggacgaguacaaggccuucuacaagagcuucuccaaggagagcgacgaccccauggccuacauccacuucaccgcggagggcgaggugaccuucaaguccauccuguucguccccaccagcgcgccccgcggccuguucgacgaguacggguccaagaaguccgacuacaucaagcucuacgugcggcgcguguucaucacggacgacuuccacgacaugaugccgaaguaccugaacuucgucaagggcgugguggacagcgacgaccugccccucaacgucagccgggagacccugcagcagcacaagcugcucaaggugauccgcaagaagcuggugcggaagacccuggacaugaucaagaagaucgccgacgacaaguacaacgacaccuucuggaaggaguucgggacgaacaucaagcucggcgucaucgaggaccacuccaaccgcacccggcuggccaagcugcuccgcuuccagagcucccaccaccccaccgacaucaccagccuggaccaguacguggagcgcaugaaggagaagcaggacaagaucuacuucauggccggguccagccggaaggaggccgaguccagccccuucguggagcgccugcucaagaagggcuacgaggucaucuaccugacggagccgguggacgaguacugcauccaggcccugcccgaguucgacggcaagcgguuccagaacguggccaaggagggggucaaguucgacgagagcgagaagaccaaggagucccgcgaggccguggagaaggaguucgagccccugcucaacuggaugaaggacaaggcccugaaggacaagaucgagaaggcgguggucagccagcggcugaccgagucccccugcgcccucguggccagccaguacggcugguccgggaacauggagcgcaucaugaaggcccaggcguaccagaccggcaaggacaucagcacgaacuacuacgccucccagaagaagaccuucgagaucaacccgcggcacccccugauccgcgacaugcugcggcgcaucaaggaggacgaggacgacaagaccgugcucgaccuggccgucgugcuguucgagaccgccacccuccggagcggguaccugcugcccgacacgaaggccuacggcgaccgcaucgagcggaugcuccgccugucccugaacaucgaccccgacgcgaagguggaggaggagccggaggaggagcccgaggagaccgccgaggacaccaccgaggacacggagcaggacgaggacgaggagauggacgucggcaccgacgaggaggaggagaccgccaaggagagcaccgccgagaaggacgagcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1547 - RNA, 2332 nt, Artificial Sequence
  mRNA product Design1 comprising derived and/or modified sequence from Homo sapiens__NP_057376.2__HsTRAP1 (opt1)
gggagaaagcuuaccauggcccgcgagcugcgggcccuccugcuguggggccgccggcuccgcccccugcugcgggcgccggcccucgccgccgugcccgggggcaagcccauccugugcccccgccggaccaccgcccagcuggggccgcgccggaaccccgcguggagccuccaggccggccgccuguucuccacgcagaccgccgaggacaaggaggagccccugcacagcaucaucuccagcaccgaguccguccaggggagcaccuccaagcacgaguuccaggccgagacgaagaagcuccuggacaucguggcgcggagccuguacuccgagaaggagguguucauccgcgagcucaucagcaacgccuccgacgcccuggagaagcugcggcacaagcucgucagcgacggccaggcccugcccgagauggagauccaccuccagaccaacgccgagaagggcaccaucaccauccaggacacggggaucggcaugacccaggaggagcugguguccaaccuggggaccaucgcgcgcagcggcuccaaggccuuccuggacgcccuccagaaccaggccgaggccagcuccaagaucaucgggcaguucggcgugggcuucuacagcgcguucauggucgccgaccggguggagguguacucccgcagcgccgccccggggagccugggcuaccaguggcuguccgacgggagcggcgucuucgagaucgccgaggcguccggcgugcggaccgggacgaagaucaucauccaccucaagagcgacugcaaggaguucuccagcgaggcccgcgugcgggacgucgugaccaaguacuccaacuucgugagcuucccccuguaccugaacggccgccggaugaacacccuccaggccaucuggaugauggaccccaaggacguccgcgaguggcagcacgaggaguucuaccgcuacguggcccaggcccacgacaagccccgguacacccugcacuacaagacggacgcgccgcugaacauccgcuccaucuucuacgugcccgacaugaagcccagcauguucgacgucucccgggagcucgggagcuccguggcccuguacagccgcaaggugcugauccagaccaaggccaccgacauccuccccaaguggcugcgguucauccgcggcgucguggacuccgaggacaucccgcugaaccucagccgggagcugcugcaggaguccgcccucauccgcaagcugcgggacgugcugcagcagcgccucaucaaguucuucaucgaccagagcaagaaggacgcggagaaguacgccaaguucuucgaggacuacgggcuguucaugcgggagggcaucgucaccgccacggagcaggaggugaaggaggacaucgccaagcugcuccgcuacgaguccagcgcccugcccagcggccagcugaccucccugagcgaguacgcgucccggaugcgcgccgggacccggaacaucuacuaccucugcgcccccaaccgccaccuggccgagcacagccccuacuacgaggccaugaagaagaaggacaccgagguccuguucugcuucgagcaguucgacgagcucacgcugcugcaccuccgggaguucgacaagaagaagcugaucuccguggagaccgacaucguggucgaccacuacaaggaggagaaguucgaggaccgcagcccggcggccgagugccuguccgagaaggagaccgaggagcucauggccuggaugcggaacgugcugggcagccgcgugaccaacgucaaggugacgcugcgccucgacacccaccccgccauggugaccguccuggagaugggggccgcgcggcacuuccugcgcaugcagcagcucgccaagacccaggaggagcgggcccagcugcugcagcccacgcucgagaucaacccccgccacgcccugaucaagaagcugaaccagcuccgggcguccgagccgggccuggcccagcugcucguggaccagaucuacgagaacgccaugaucgccgccgggcugguggacgacccccgcgcgauggucggccggcugaacgagcuccuggugaaggcccuggagcgccacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1548 - RNA, 679 nt, Artificial Sequence
  mRNA product Design1 comprising derived and/or modified sequence from Homo sapiens__NP_000609.1__HsIGF1 (opt1)
gggagaaagcuuaccaugggcaagaucagcucccugcccacccagcuguucaagugcugcuucugcgacuuccucaaggugaagaugcacaccaugagcuccagccaccuguucuaccucgcccugugccugcucacguucaccuccagcgccaccgcggggccggagacccugugcggcgccgagcuggucgacgcccuccaguucgugugcggggaccgcggcuucuacuucaacaagcccacgggguacggcuccagcucccggcgcgcgccccagaccggcaucguggacgagugcugcuuccggagcugcgaccugcgccggcuggagauguacugcgcgccccucaagccggccaaguccgcccgcagcguccgggcccagcgccacaccgacaugcccaagacccagaaggaggugcaccugaagaacgccucccgggggagcgccggcaacaagaacuaccgcaugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1549 - RNA, 760 nt, Artificial Sequence
  mRNA product Design1 comprising derived and/or modified sequence from Homo sapiens__NP_000603.1__HsIGF2 (opt1)
gggagaaagcuuaccaugggcauccccauggggaaguccaugcuggugcuccugaccuuccuggccuucgccagcugcugcaucgcggccuaccgcccgagcgagacccucugcggcggggagcuggucgacacgcugcaguucgugugcggcgaccggggguucuacuucucccgccccgccagccgggugucccgccggagccgcggcaucgucgaggagugcugcuuccgguccugcgaccucgcccugcuggagaccuacugcgccacccccgccaagagcgagcgcgacguguccacgcccccgaccgugcuccccgacaacuucccccgguaccccgucggcaaguucuuccaguacgacaccuggaagcagagcacccagcgccugcggcgcgggcugccggcgcuccugcgggcccgccggggccacgugcuggccaaggagcucgaggcguuccgcgaggccaagcggcaccgcccccugaucgcccugcccacccaggaccccgcccacgggggcgccccgcccgagauggcguccaaccggaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1550 - RNA, 856 nt, Artificial Sequence
  mRNA product Design1 comprising derived and/or modified sequence from Homo sapiens__NP_000591.1__HsIL6 (opt1)
gggagaaagcuuaccaugaacagcuucuccaccagcgccuucggccccguggccuucucccuggggcuccugcugguccucccggcggccuuccccgcccccgugcccccgggcgaggacagcaaggacguggccgcgccccaccgccagccccugaccuccagcgagcggaucgacaagcagauccgcuacauccuggacgggaucuccgcccuccggaaggagacgugcaacaagagcaacaugugcgaguccagcaaggaggcccuggccgagaacaaccugaaccuccccaagauggccgagaaggacggcugcuuccaguccggguucaacgaggagaccugccuggucaagaucaucaccggccugcucgaguucgagguguaccuggaguaccugcagaaccgcuucgagagcuccgaggagcaggcgcgggccgugcagaugagcaccaagguccucauccaguuccugcagaagaaggccaagaaccuggacgccaucacgaccccggaccccaccaccaacgccucccuccugacgaagcugcaggcgcagaaccaguggcuccaggacaugaccacccaccugauccugcgcagcuucaaggaguuccuccaguccagccugcgggcccugcgccagaugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1551 - RNA, 1498 nt, Artificial Sequence
  mRNA product Design1 comprising derived and/or modified sequence from Homo sapiens__NP_002183.1__HsINHBA (opt1)
gggagaaagcuuaccaugccccugcucuggcugcgcggcuuccugcucgccagcugcuggaucaucgugcgguccagcccgacccccggguccgagggccacagcgccgcgcccgacugccccuccugcgcccuggccgcccugccgaaggacguccccaacagccagcccgagaugguggaggccgugaagaagcacauccucaacaugcugcaccugaagaagcgccccgacgucacccagccggugcccaaggcggcccuccugaacgccauccggaagcugcacguggggaaggucggcgagaacggguacguggagaucgaggacgacaucggccgccgggccgagaugaacgagcucauggagcagacguccgagaucaucaccuucgcggagagcggcaccgcccgcaagacccugcacuucgagaucuccaaggaggggagcgaccuguccguggucgagcgggccgagguguggcuguuccucaaggugcccaaggccaaccgcacgcggaccaaggucaccauccgccuguuccagcagcagaagcacccccagggcagccucgacaccggggaggaggccgaggaggugggccugaagggggagcgguccgagcugcuccugagcgagaagguggucgacgcgcgcaaguccacguggcacguguucccggugagcuccagcauccagcggcugcucgaccagggcaaguccagccuggacguccgcaucgccugcgagcagugccaggagagcggcgccucccuggugcuccuggggaagaagaagaagaaggaggaggagggcgaggggaagaagaagggcggcggggagggcggggccggcgccgacgaggagaaggagcagagccaccggcccuuccugaugcuccaggcgcgccaguccgaggaccacccccaccggcgccggcgccgggggcuggagugcgacggcaaggugaacaucugcugcaagaagcaguucuucgucagcuucaaggacaucggcuggaacgacuggaucaucgcccccuccggguaccacgccaacuacugcgagggcgagugcccgagccacaucgccgggaccuccggcagcucccugagcuuccacuccaccgugaucaaccacuaccgcaugcgcgggcacagccccuucgccaaccucaaguccugcugcgugcccaccaagcugcggcccaugagcaugcuguacuacgacgacggccagaacaucaucaagaaggacauccagaacaugaucgucgaggagugcggcugcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1552 - RNA, 1441 nt, Artificial Sequence
  mRNA product Design1 comprising derived and/or modified sequence from Homo sapiens__NP_002184.2__HsINHBB (opt1)
gggagaaagcuuaccauggacggccugcccgggcgcgcccucggcgccgcgugccugcugcuccuggccgccggguggcugggcccggaggccugggggagccccaccccgcccccgacccccgccgcgcccccgcccccgcccccgcccggcucccccggcgggagccaggacacgugcaccuccugcggcggguuccggcgccccgaggagcucggccggguggacggggacuuccuggaggccgucaagcgccacauccugagccggcuccagaugcgcggccggcccaacaucacccacgccgugcccaaggccgcgauggugaccgcccugcgcaagcugcacgccggcaagguccgggaggacgggcgcguggagaucccccaccucgacggccacgccucccccggggccgacggccaggagcgggugagcgagaucaucuccuucgcggagacggacggccuggccagcucccgcguccggcuguacuucuucaucagcaacgaggggaaccagaaccucuucguggugcaggccucccuguggcuguaccucaagcugcugcccuacguccucgagaagggcagccgccggaaggugcgcgugaaggucuacuuccaggagcaggggcacggcgaccgguggaacaugguggagaagcgcguggaccugaagcgguccggguggcacaccuucccccugaccgaggccauccaggcccucuucgagcgcggcgagcggcgccugaaccuggacguccagugcgacagcugccaggagcucgcgguggugcccgucuucguggaccccggcgaggagucccaccgccccuucguggucgugcaggcccggcugggggacagccgccaccggauccgcaagcggggccuggagugcgacgggcgcaccaaccucugcugccggcagcaguucuucaucgacuuccgccugaucggcuggaacgacuggaucaucgccccgacgggguacuacggcaacuacugcgagggcuccugccccgccuaccuggccggggugcccggcagcgcguccagcuuccacaccgccgucgugaaccaguaccggaugcgcgggcucaaccccggcaccgucaacagcugcugcaucccgaccaagcuguccacgaugagcaugcuguacuucgacgacgaguacaacaucgugaagcgggacgugcccaacaugaucgucgaggagugcgggugcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1553 - RNA, 3676 nt, Artificial Sequence
  mRNA product Design1 comprising derived and/or modified sequence from Homo sapiens__NP_000623.2__HsITGAM (opt1)
gggagaaagcuuaccauggcccugcgcgugcuccugcugaccgcccucacccugugccacggcuucaaccuggacacggagaacgcgaugaccuuccaggagaacgcccggggguucggccagagcgucgugcagcuccaggggucccgcguggucgugggcgccccccaggagaucguggccgccaaccagcgggggagccuguaccagugcgacuacuccaccggcagcugcgagccgauccgccugcagguccccguggaggcggugaacaugucccucggccugagccuggccgccaccacgucccccccccagcuccuggccugcgggccgaccguccaccagaccugcagcgagaacaccuacgugaagggccugugcuuccucuucggguccaaccugcggcagcagccccagaaguuccccgaggcgcugcgcggcugcccccaggaggacagcgacaucgccuuccucaucgacggguccggcagcaucaucccgcacgacuuccggcgcaugaaggaguucguguccacggucauggagcagcugaagaaguccaagacccuguucucccucaugcaguacagcgaggaguuccggauccacuucaccuucaaggaguuccagaacaaccccaacccccgcucccuggugaagcccaucacccagcugcucggccggacgcacaccgccaccgggauccgcaaggugguccgggagcuguucaacaucaccaacggcgcccgcaagaacgccuucaagauccugguggugaucacggacggggagaaguucggcgacccgcucggcuacgaggacgucauccccgaggcggaccgggagggggugauccgcuacgugaucggcgucggggacgccuuccggagcgagaagucccgccaggagcugaacaccaucgccagcaagcccccccgggaccacguguuccaggugaacaacuucgaggcccugaagaccauccagaaccagcuccgcgagaagaucuucgccaucgagggcacccagacggggagcuccagcuccuucgagcacgagaugagccaggagggcuucuccgcggccaucaccagcaacggcccgcugcuguccaccgucgggagcuacgacugggccggcgggguguuccucuacaccuccaaggagaaguccacguucaucaacaugacccgggucgacuccgacaugaacgacgccuaccugggcuacgccgcggccaucauccugcgcaaccgcgugcagagccucgugcugggggccccccgguaccagcacaucggccuggucgccauguuccgccagaacaccggcaugugggaguccaacgccaacgugaaggggacccagaucggcgcguacuucggggccagccucugcuccguggacgucgacagcaacggcuccacggaccuggugcugaucggggccccccacuacuacgagcagacccggggcggccaggugagcgucugcccccucccgcgcgggcgggcccgcuggcagugcgacgcggugcuguacggcgagcaggggcagcccuggggccgguucggcgccgcccugaccgugcucggggacgucaacggcgacaagcugaccgacguggccaucggggcccccggcgaggaggacaaccgcggggcgguguaccuguuccacggcacguccggcagcgggaucagccccucccacagccagcggaucgccggcuccaagcucagcccgcgccugcaguacuucgggcagucccugagcggcgggcaggaccugaccauggacggccucgucgaccugaccgugggcgcccaggggcacgugcugcuccugcggucccagcccguccugcgcgugaaggccaucauggaguucaacccccgggagguggcccgcaacgucuucgagugcaacgaccagguggugaagggcaaggaggcgggggagguccgggugugccuccacgugcagaaguccacccgcgaccggcugcgcgagggccagauccaguccgucgugacguacgaccuggcccucgacagcgggcggccccacucccgcgccguguucaacgagaccaagaacagcacccgccggcagacccagguccugggccugacccagacgugcgagacccucaagcugcagcugccgaacugcaucgaggaccccgugucccccaucgugcuccgccugaacuucagccuggucggcaccccgcucuccgccuucgggaaccugcggcccgugcuggccgaggacgcgcagcgccucuucaccgcccuguuccccuucgagaagaacugcggcaacgacaacaucugccaggacgaccugagcaucacguucuccuucaugagccucgacugccugguggucgggggcccccgggaguucaacgugaccgugaccguccgcaacgacggggaggacagcuaccggacccaggugacguucuucuucccgcuggaccucuccuaccgcaaggugagcacccugcagaaccagcggucccagcgcagcuggcggcuggccugcgaguccgccagcuccaccgaggucagcggcgcgcucaaguccaccagcugcuccaucaaccaccccaucuuccccgagaacagcgaggugacguucaacaucaccuucgacguggacuccaaggccagccugggcaacaagcugcuccugaaggccaacgucaccuccgagaacaacaugccccgcaccaacaagacggaguuccagcuggagcucccggugaaguacgccguguacauggucgugaccagccacgggguguccaccaaguaccugaacuucaccgccagcgagaacacgucccgggucaugcagcaccaguaccaggugagcaaccugggccagcgcagccuccccaucucccuggucuuccuggugcccgugcggcucaaccagaccgucaucugggaccgcccccaggugaccuucagcgagaaccuguccagcacaugccacacgaaggagcggcugccgucccacagcgacuuccucgcggagcugcgcaaggcccccguggucaacugcuccaucgccgugugccagcggauccagugcgacauccccuucuucgggauccaggaggaguucaacgccacccugaagggcaaccucagcuucgacugguacaucaagaccucccacaaccaccuccugaucgugagcaccgccgagauccucuucaacgacuccgucuucacgcugcugcccggccagggggcguucgugcgcagccagaccgagaccaagguggagccguucgagguccccaacccccucccccugaucgugggcuccagcguggggggccugcuccugcuggcccucaucaccgccgcccuguacaagcugggguucuucaagcggcaguacaaggacaugauguccgagggcggcccgcccggggccgagccccagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1554 - RNA, 1621 nt, Artificial Sequence
  mRNA product Design1 comprising derived and/or modified sequence from Homo sapiens__NP_002415.1__HsMMP8 (opt1)
gggagaaagcuuaccauguucagccugaagacccuccccuuccugcugcuccugcacgugcagaucuccaaggccuucccggucagcuccaaggagaagaacaccaagacggugcaggacuaccuggagaaguucuaccagcuccccagcaaccaguaccaguccacccgcaagaacggcaccaacgugaucgucgagaagcugaaggagaugcagcgguucuucgggcugaacgugaccggcaagcccaacgaggagacgcucgacaugaugaagaagccccgcugcggggugccggacagcggcggguucaugcugacccccggcaaccccaagugggagcggaccaaccugaccuaccgcauccggaacuacacgccccagcucuccgaggccgaggucgagcgcgcgaucaaggacgccuucgagcuguggagcguggccuccccgcugaucuucacccggaucagccagggcgaggccgacaucaacaucgccuucuaccagcgcgaccacggggacaacucccccuucgacggccccaacgggauccucgcgcacgccuuccagcccggccaggggaucggcggcgacgcccacuucgacgccgaggagaccuggaccaacacgagcgcgaacuacaaccuguuccugguggccgcccacgaguucgggcacucccucggccuggcccacagcuccgacccgggggcccugauguaccccaacuacgcguuccgggagaccagcaacuacucccucccccaggacgacaucgacggcauccaggccaucuacggccugagcuccaaccccauccagccgaccgggcccagcacccccaagcccugcgacccgagccugacguucgacgccaucaccacccuccgcggcgagauccuguucuucaaggaccgguacuucuggcgccggcacccccagcugcagcgcgucgagaugaacuucaucucccucuucuggcccagccugcccaccgggauccaggccgccuacgaggacuucgaccgggaccugaucuuccucuucaagggcaaccaguacugggcgcuguccggguacgacauccugcagggcuacccgaaggacaucagcaacuacggcuuccccuccagcgugcaggccaucgacgccgccguguucuaccgcuccaagacguacuucuucgucaacgaccaguucuggcgguacgacaaccagcgccaguucauggagcccggguaccccaagagcaucuccggcgccuucccggggaucgagagcaagguggacgcgguguuccagcaggagcacuucuuccacgucuucuccggcccccgguacuacgccuucgaccucaucgcccagcgcgugacccggguggcccgcgggaacaaguggcugaacugccgcuacggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1555 - RNA, 2341 nt, Artificial Sequence
  mRNA product Design1 comprising derived and/or modified sequence from Homo sapiens__NP_004985.2__HsMMP9 (opt1)
gggagaaagcuuaccaugagccuguggcagccccucgugcugguccugcucgugcugggcugcugcuucgccgccccgcgccagcggcaguccacccugguccucuuccccggggaccugcgcaccaaccugacggaccggcagcucgcggaggaguaccuguaccgcuacggcuacacccggguggccgagaugcgcggggagagcaagucccugggccccgcccuccugcugcuccagaagcagcugagccugcccgagaccggggagcucgacuccgccacccugaaggccaugcggacgccgcgcugcggcgugcccgaccugggccgguuccagaccuucgagggggaccucaaguggcaccaccacaacaucaccuacuggauccagaacuacagcgaggaccugccccgcgcggugaucgacgacgccuucgcccgggccuucgcgcugugguccgccgucacgccccucaccuucacccgcguguacagccgggacgccgacaucgugauccaguucggcgucgccgagcacggggacggcuacccguucgacgggaaggacggccugcuggcccacgcguucccgcccggccccgggauccagggcgacgcccacuucgacgacgacgagcucuggucccuggggaagggcguggugguccccacccgcuucggcaacgccgacggggccgccugccacuuccccuucaucuucgagggccggagcuacuccgcgugcaccacggacgggcgcagcgacggccugcccuggugcuccaccaccgccaacuacgacaccgacgaccgguucggguucugccccagcgagcgccucuacacgcaggacggcaacgccgacggcaagccgugccaguuccccuucaucuuccaggggcaguccuacagcgccugcaccaccgacggccgguccgacggguaccgcuggugcgccaccacggcgaacuacgaccgggacaagcuguucggcuucugccccacccgcgccgacagcaccgugaugggcggcaacuccgccggcgagcugugcguguuccccuucaccuuccucgggaaggaguacagcacgugcaccagcgagggccgcggggacggccggcuguggugcgccaccaccuccaacuucgacagcgacaagaaguggggguucugcccggaccagggcuacucccuguuccucgucgccgcgcacgaguucggccacgcccuggggcuggaccacagcuccgugcccgaggcccucauguaccccauguaccgcuucacggaggggcccccgcugcacaaggacgacgugaacgggauccggcaccuguacggcccccgccccgagcccgagccgcggccgcccaccaccaccacgccccagcccaccgccccgcccaccgucugccccaccggcccgcccacggugcaccccagcgagcgccccaccgcggggcccaccggcccgcccuccgccgggcccaccggcccgcccaccgccgggcccagcacggccaccaccgugccccucucccccgucgacgacgccugcaacgugaacaucuucgacgcgaucgccgagaucggcaaccagcuguaccuguucaaggacggcaaguacuggcgguucagcgaggggcgcggcucccggccccaggggcccuuccucaucgccgacaaguggccggcccugccccgcaagcuggacagcguguucgaggagcggcucuccaagaagcuguucuucuucagcggccgccaggucuggguguacaccggggccuccguccugggcccccggcgccuggacaagcucggccugggggcggacguggcccaggugacgggcgcccugcggagcgggcgcggcaagaugcuccuguucuccgggcggcgccuguggcgguucgacgucaaggcccagaugguggacccccgcagcgccuccgagguggaccgcauguucccgggcgucccccucgacacccacgacguguuccaguaccgggagaaggcguacuucugccaggaccgcuucuacuggcgggugagcagccgcuccgagcugaaccaggucgaccaggugggcuacgugaccuacgacauccugcagugccccgaggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1556 - RNA, 1633 nt, Artificial Sequence
  mRNA product Design1 comprising derived and/or modified sequence from Homo sapiens__NP_002418.1__HsMMP13 (opt1)
gggagaaagcuuaccaugcaccccggcgugcuggccgccuuccucuuccugagcuggacccacugccgcgcgcugccgcuccccuccgggggcgacgaggacgaccugagcgaggaggaccugcaguucgccgagcgguaccuccgcuccuacuaccaccccaccaaccuggccgggauccugaaggagaacgccgccagcuccaugacggagcggcuccgcgagaugcagagcuucuucggccuggaggucaccgggaagcuggacgacaacacccucgacgugaugaagaagccccggugcggcgugccggacgucggcgaguacaacguguucccccgcacccugaagugguccaagaugaaccugacguaccggaucgugaacuacacccccgacaugacccacagcgaggucgagaaggcguucaagaaggccuucaaggugugguccgacgugacgccccucaacuucacccgccugcacgacgggaucgccgacaucaugaucagcuucggcaucaaggagcacggggacuucuacccguucgacggccccuccgggcugcucgcccacgcguucccgcccggccccaacuacggcggggacgcccacuucgacgacgacgagaccuggaccagcuccagcaagggcuacaaccuguuccuggucgccgcccacgaguucgggcacucccucggccuggaccacagcaaggaccccggcgcccugauguuccccaucuacaccuacacggggaagucccacuucaugcuccccgacgacgacgugcagggcauccagagccuguacgggccgggcgacgaggaccccaaccccaagcaccccaagaccccggacaagugcgaccccucccugagccucgacgcgaucaccagccugcgcggggagaccaugaucuucaaggaccgguucuucuggcggcugcacccccagcaggucgacgccgagcuguuccugacgaaguccuucuggcccgagcugccgaaccgcaucgacgccgccuacgagcaccccagccacgaccucaucuucaucuuccggggccgcaaguucugggcccugaacggcuacgacauccuggagggguaccccaagaagaucuccgagcucggccugcccaaggaggugaagaagaucagcgcggccgugcacuucgaggacaccgggaagacccuccucuucuccggcaaccagguguggcgguacgacgacaccaaccacaucauggacaaggacuacccgcgccugaucgaggaggacuuccccgggaucggcgacaaggucgacgccguguacgagaagaacggcuacaucuacuucuucaacgggcccauccaguucgaguacagcaucugguccaaccggaucgugcgcgucaugccggccaacagcauccuguggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1557 - RNA, 1285 nt, Artificial Sequence
  mRNA product Design1 comprising derived and/or modified sequence from Homo sapiens__NP_001286.1__HsCCR1 (opt1)
gggagaaagcuuaccauggagacccccaacaccacggaggacuacgacaccaccaccgaguucgacuacggcgacgccacgccgugccagaaggugaacgagcgcgccuucggggcgcagcugcucccgccccuguacagccuggucuucgugaucggccucguggggaacauccuggucgugcuggugcucguccaguacaagcggcugaagaacaugaccuccaucuaccugcucaaccuggccaucagcgaccuccucuuccuguucacccugcccuucuggaucgacuacaagcucaaggacgacuggguguucggcgacgccaugugcaagauccuguccggguucuacuacaccggccuguacagcgagaucuucuucaucauccuccugacgaucgaccgcuaccuggccaucgugcacgccgucuucgcgcuccgggcccgcaccgugaccuucggcgugaucaccuccaucaucaucugggcccuggccauccuggcgagcaugcccgggcucuacuucuccaagacgcagugggaguucacccaccacacgugcagccugcacuucccccacgagucccugcgggaguggaagcuguuccaggcccugaagcugaaccucuucggccugguccugccccuccuggugaugaucaucugcuacaccgggaucaucaagauccugcuccgccggcccaacgagaagaaguccaaggccgugcgccugaucuucgucaucaugaucaucuucuuccuguucuggaccccguacaaccucaccauccugaucagcguguuccaggacuuccuguucacccacgagugcgagcagagccggcaccucgaccuggccgugcaggucaccgaggugaucgccuacacgcacugcugcgugaaccccgucaucuacgcguucgugggcgagcgcuuccggaaguaccugcgccagcuguuccaccggcgcguggccguccaccucgugaaguggcugcccuuccucuccgucgaccggcuggagcgcgugagcuccaccagccccuccaccggggagcacgagcugagcgccggcuucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1558 - RNA, 853 nt, Artificial Sequence
  mRNA product Design1 comprising derived and/or modified sequence from Homo sapiens__NP_002598.4__HsPDGFA (opt1)
gggagaaagcuuaccaugcgcacccuggccugccuccugcugcucggcugcggguaccuggcccacgugcuggcggaggaggccgagaucccccgggaggugaucgagcgccucgcccggagccagauccacuccauccgcgaccugcagcggcugcucgagaucgacagcgugggcuccgaggacagccuggacaccucccugcgcgcccacggggugcacgccacgaagcacgucccggagaagcggccccuccccauccgccggaagcgcagcaucgaggaggcggugcccgccgugugcaagacccggaccgucaucuacgagaucccgcgcucccagguggaccccaccagcgccaacuuccugaucuggccgcccugcguggaggucaagcggugcacgggcugcugcaacaccuccagcgugaagugccagcccucccgcgugcaccaccggagcgucaagguggccaagguggaguacguccgcaagaagcccaagcugaaggagguccaggugcggcucgaggagcaccuggagugcgcgugcgccaccaccucccugaaccccgacuaccgcgaggaggacacggggcggccccgcgagagcggcaagaagcggaagcgcaagcgccucaagccgaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1559 - RNA, 943 nt, Artificial Sequence
  mRNA product Design1 comprising derived and/or modified sequence from Homo sapiens__NP_002599.1__HsPDGFB (opt1)
gggagaaagcuuaccaugaaccgcugcugggcccuguuccucagccugugcugcuaccugcggcucguguccgccgagggcgaccccaucccggaggagcuguacgagaugcugagcgaccacuccauccgcagcuucgacgaccuccagcggcugcugcacggggaccccggcgaggaggacggggcggagcucgaccugaacaugacccgcucccacagcggcggggagcuggagucccucgcccggggccgccggagccugggcucccugaccaucgccgagcccgccaugaucgccgagugcaagacgcgcaccgaggucuucgagaucagccggcgccucaucgaccggaccaacgcgaacuuccugguguggcccccgugcguggagguccagcgcugcuccgggugcugcaacaaccggaacgugcagugccgccccacccaggugcagcugcggcccguccaggugcgcaagaucgagaucgugcggaagaagcccaucuucaagaaggccacggucacccucgaggaccaccuggccugcaagugcgagaccguggccgcggcccgcccggugacccggagccccggcgggucccaggagcagcgcgccaagacgccccagacccgggucaccauccgcaccgugcgcgugcggcggcccccgaagggcaagcaccgcaaguucaagcacacgcacgacaagaccgcccugaaggagacccucggggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1560 - RNA, 1255 nt, Artificial Sequence
  mRNA product Design1 comprising derived and/or modified sequence from Homo sapiens__NP_057289.1__HsPDGFC (opt1)
gggagaaagcuuaccaugagccuguucggccuccugcugcucaccuccgcccuggccgggcagcgccagggcacccaggcggagagcaaccuguccagcaaguuccaguucuccagcaacaaggagcagaacggggugcaggacccccagcacgagcggaucaucacggucuccaccaacggcagcauccacuccccgcgcuucccccacaccuacccccggaacaccgugcucguguggcgccuggucgccguggaggagaacguguggauccagcugacguucgacgagcgguucgggcucgaggaccccgaggacgacaucugcaaguacgacuucgucgagguggaggagccgagcgacggcaccauccugggccgcuggugcggguccggcaccgugcccgggaagcagaucagcaagggcaaccagauccggauccgcuucgucuccgacgaguacuuccccagcgagcccggguucugcauccacuacaacaucgugaugccgcaguucaccgaggccgugucccccagcguccugccgcccuccgcccucccccuggaccugcucaacaacgccaucacggcguucagcacccuggaggaccugauccgguaccucgagcccgagcgcuggcagcuggaccuggaggaccucuaccggcccaccuggcagcugcugggcaaggccuucguguucggccgcaagucccggguggucgaccucaaccugcugaccgaggaggugcgccucuacagcugcacgccccggaacuucagcguguccauccgcgaggagcugaagcggaccgacaccaucuucuggccggggugccugcucgucaagcgcugcggcgggaacugcgccugcugccugcacaacugcaacgagugccagugcgugcccagcaaggugaccaagaaguaccacgagguccugcagcuccggcccaagacgggcgugcgcggccugcacaagucccugaccgacguggcccucgagcaccacgaggagugcgacugcgucugccgggggagcaccggcgggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1561 - RNA, 1312 nt, Artificial Sequence
  mRNA product Design1 comprising derived and/or modified sequence from Homo sapiens__NP_149126.1__HsPDGFD (opt1)
gggagaaagcuuaccaugcaccgccugaucuucguguacacccucaucugcgccaacuucugcagcugccgggacaccuccgccacgccccagagcgcguccaucaaggcccugcgcaacgccaaccugcggcgcgacgaccucuaccggcgcgacgagaccauccaggucaagggcaacggguacgugcagagcccccgguuccccaacuccuacccccgcaaccugcugcucaccuggcggcugcacagccaggagaacacccgcauccagcugguguucgacaaccaguucggccucgaggaggccgagaacgacaucugccgguacgacuucgucgagguggaggacaucuccgagaccagcaccaucauccgcgggcgguggugcggccacaaggaggugcccccgcgcaucaagucccggaccaaccagaucaagaucaccuucaagagcgacgacuacuucgucgccaagcccggguucaagaucuacuacucccugcuggaggacuuccagcccgcggccgccagcgagacgaacugggaguccgugaccagcuccaucagcggcguguccuacaacagccccuccgucaccgacccgacccucaucgccgacgcgcuggacaagaagaucgccgaguucgacacgguggaggaccugcucaaguacuucaaccccgagagcuggcaggaggaccuggagaacauguaccuggacaccccgcgcuaccggggccgcagcuaccacgaccggaaguccaagguggaccucgaccgccugaacgacgacgccaagcgguacagcugcacgccccgcaacuacuccgucaacauccgcgaggagcugaagcucgccaacgugguguucuucccccggugccugcugguccagcgcugcgggggcaacugcgggugcggcaccgugaacuggcggagcugcacgugcaacuccgggaagaccgugaagaaguaccacgagguccuccaguucgagcccggccacaucaagcgccggggccgcgccaagaccauggcgcugguggacauccagcuggaccaccacgagcggugcgacugcaucugcagcucccgcccgccccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1562 - RNA, 895 nt, Artificial Sequence
  mRNA product Design1 comprising derived and/or modified sequence from Homo sapiens__NP_003946.3__HsSOCS3 (opt1)
gggagaaagcuuaccauggugacccacagcaaguuccccgccgccggcaugucccgcccgcuggacaccagccuccggcugaagacguucuccagcaaguccgaguaccagcuggucgugaacgcggugcgcaagcuccaggagagcggguucuacugguccgccgucaccggcggggaggccaaccugcugcucagcgccgagcccgccggcaccuuccugauccgggacuccagcgaccagcgccacuucuucacccuguccgugaagacgcagagcgggaccaagaaccuccggauccagugcgagggcggcuccuucagccugcaguccgacccccgcagcacccagcccgugccgcgguucgacugcguccugaagcucgugcaccacuacaugcccccgcccggggcgcccuccuuccccagcccgcccaccgagcccuccagcgaggugcccgagcagcccagcgcccagccccugccgggcuccccgccccgccgggccuacuacaucuacagcgggggcgagaagaucccccugguccucucccgcccccugagcuccaacguggccacgcugcagcaccucugccggaagaccgugaacgggcaccuggacagcuacgagaaggucacccagcugcccggccccauccgcgaguuccucgaccaguacgacgcgccccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1563 - RNA, 700 nt, Artificial Sequence
  mRNA product Design1 comprising derived and/or modified sequence from Homo sapiens__NP_003227.1__HsTGFA (opt1)
gggagaaagcuuaccauggugcccagcgccggccagcuggcccucuucgcgcuggggaucguccuggccgccugccaggcccucgagaacuccaccagcccgcuguccgccgacccgcccguggcggccgccguggucagccacuucaacgacugccccgacucccacacccaguucugcuuccacggcacgugccgcuuccuggugcaggaggacaagcccgccugcgugugccacagcggguacgucggcgcgcggugcgagcacgccgaccuccuggccgugguggccgccucccagaagaagcaggcgaucaccgcccuggucguggugagcaucgucgcccucgccgugcugaucaucacgugcgugcugauccacugcugccagguccgcaagcacugcgaguggugccgggcccucaucugccgccacgagaagcccuccgcgcugcugaaggggcggaccgccugcugccacagcgagaccguggugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1564 - RNA, 1390 nt, Artificial Sequence
  mRNA product Design1 comprising derived and/or modified sequence from Homo sapiens__NP_000651.3__HsTGFB1 (opt1)
gggagaaagcuuaccaugcccccgagcggccugcgccuccugccccugcuccugccccugcucuggcugcuggugcucacccccgggcggccggccgccggccuguccacgugcaagaccaucgacauggagcuggucaagcgcaagcggaucgaggcgauccgcgggcagauccucagcaagcugcggcuggccuccccgcccagccagggcgaggugccgcccgggccccuccccgaggccgugcuggcccuguacaacuccacccgcgaccgggucgccggcgagagcgcggagcccgagcccgagcccgaggccgacuacuacgccaaggaggugacccgcgugcucauggucgagacccacaacgagaucuacgacaaguucaagcaguccacgcacagcaucuacauguucuucaacaccuccgagcugcgggaggccgugcccgagcccgugcugcucagccgcgcggagcugcggcugcuccgccugaagcugaaggucgagcagcacguggagcucuaccagaaguacuccaacaacagcuggcgguaccuguccaaccgccugcucgccccgagcgacucccccgaguggcugagcuucgacgugaccggcgucgugcggcaguggcugucccgcgggggcgagaucgagggguuccggcucagcgcccacugcuccugcgacagccgcgacaacacccuccagguggacaucaacggcuucacgaccgggcggcgcggcgaccuggccaccauccacggcaugaaccggcccuuccugcugcugauggccacgccccucgagcgcgcgcagcaccuccagagcucccgccaccggcgcgcccuggacaccaacuacugcuucagcuccaccgagaagaacugcugcguccggcagcuguacaucgacuuccgcaaggaccugggguggaaguggauccacgagccgaagggcuaccacgccaacuucugccuggggcccugccccuacaucuggagccucgacacccaguacuccaaggugcuggcccuguacaaccagcacaaccccggcgccagcgcggccccgugcugcgugccccaggcccucgagccccugcccaucgucuacuacgugggccggaagccgaagguggagcagcuguccaacaugaucguccgcagcugcaagugcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1565 - RNA, 1462 nt, Artificial Sequence
  mRNA product Design1 comprising derived and/or modified sequence from Homo sapiens__NP_003229.1__HsTGFB2 (opt1)
gggagaaagcuuaccaugcacuacugcgugcugagcgccuuccucauccugcaccuggucaccguggcccucucccugagcacgugcuccacccuggacauggaccaguucaugcgcaagcggaucgaggcgauccgcggccagauccucagcaagcugaagcugaccagcccgcccgaggacuaccccgagcccgaggaggugcccccggaggucaucuccaucuacaacuccacccgggaccuccugcaggagaaggccagccgccgggccgccgccugcgagcgcgagcgguccgacgaggaguacuacgcgaaggagguguacaagaucgacaugccgcccuucuuccccagcgagaacgccaucccgcccaccuucuaccgccccuacuuccggaucgugcgcuucgacgucuccgccauggagaagaacgccagcaaccuggugaaggcggaguuccggguguuccgccuccagaaccccaaggcccggguccccgagcagcgcaucgagcuguaccagauccugaaguccaaggaccucacgagccccacccagcgguacaucgacuccaagguggugaagacccgcgccgagggggaguggcugagcuucgacgucaccgacgccgugcacgaguggcugcaccacaaggaccggaaccucggcuucaagaucucccugcacugccccugcugcacguucgugcccagcaacaacuacaucaucccgaacaaguccgaggagcuggaggcccgcuucgcggggaucgacggcaccagcaccuacaccagcggggaccagaagacgaucaaguccacccggaagaagaacagcggcaagacgccccaccuccugcugaugcuccugcccuccuaccgccuggagagccagcagaccaaccggcgcaagaagcgcgcccucgacgccgccuacugcuuccggaacguccaggacaacugcugccugcgcccccuguacaucgacuucaagcgggaccucggcuggaaguggauccacgagccgaagggguacaacgccaacuucugcgcgggcgccugccccuaccugugguccagcgacacccagcacucccgcgugcugagccucuacaacaccaucaaccccgaggccuccgccagccccugcugcgugucccaggaccuggagccgcugaccauccucuacuacaucgggaagacccccaagaucgagcagcugagcaacaugaucgucaaguccugcaagugcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1566 - RNA, 1456 nt, Artificial Sequence
  mRNA product Design1 comprising derived and/or modified sequence from Homo sapiens__NP_003230.1__HsTGFB3 (opt1)
gggagaaagcuuaccaugaagaugcaccuccagcgcgcccucguggugcuggcccugcucaacuucgcgaccgugagccugucccugagcacgugcaccacccucgacuucggccacaucaagaagaagcggguggaggccauccgcgggcagauccuguccaagcugcggcucaccagcccgcccgagcccaccgucaugacgcacgugcccuaccaggugcuggcccuguacaacuccacccgcgagcuccuggaggagaugcacggcgagcgggaggaggggugcacccaggagaacaccgagagcgaguacuacgccaaggagauccacaaguucgacaugauccagggccuggccgagcacaacgagcucgcggucugccccaaggggaucacguccaagguguuccgcuucaacgugagcuccgucgagaagaaccggaccaaccuguuccgcgccgaguuccgggugcugcgcgugccgaaccccagcuccaagcggaacgagcagcgcaucgagcuguuccagauccugcggcccgacgagcacaucgccaagcagcgcuacaucggcggcaagaaccugcccacccgggggaccgccgaguggcucagcuucgacgucacggacaccgugcgcgaguggcugcugcggcgcgaguccaaccucggccuggagaucagcauccacugcccgugccacaccuuccagcccaacggggacauccuggagaacauccacgaggugauggagaucaaguucaagggcgucgacaacgaggacgaccacgggcggggcgaccucggccgccugaagaagcagaaggaccaccacaacccccaccugauccucaugaugaucccgccccaccggcuggacaaccccgggcagggcgggcagcgcaagaagcgcgcgcuggacaccaacuacugcuuccggaaccucgaggagaacugcugcgugcgcccccuguacaucgacuuccggcaggaccugggcuggaagugggugcacgagcccaagggcuacuacgccaacuucugcuccgggccgugccccuaccuccgcagcgccgacacgacccacuccaccguccugggccuguacaacacccucaaccccgaggccagcgccucccccugcugcgugccgcaggaccuggagccccugacgauccucuacuacguggggcggacccccaaggucgagcagcugagcaacaugguggucaagagcugcaagugcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1567 - RNA, 1603 nt, Artificial Sequence
  mRNA product Design1 comprising derived and/or modified sequence from Homo sapiens__NP_001057.1__HsTNFRSF1B (opt1)
gggagaaagcuuaccauggcccccguggccgucugggcggcccuggccgugggccucgagcugugggccgccgcgcacgcccugccggcccagguggccuucacccccuacgcgcccgagcccgggagcacgugccgccuccgggaguacuacgaccagaccgcccagaugugcugcuccaagugcagcccgggccagcacgccaaggucuucugcaccaagaccuccgacaccgugugcgacagcugcgaggacuccacguacacccagcuguggaacugggugcccgagugccugagcugcgggucccgcugcagcuccgaccaggucgagacccaggccugcacccgggagcagaaccgcaucugcacgugccggcccggcugguacugcgcccucagcaagcaggaggggugccgccugugcgcgccccugcggaagugccgcccgggcuucggcguggcccggcccgggaccgagaccuccgacguggucugcaagcccugcgcccccggcaccuucagcaacacgaccuccagcaccgacaucugccgcccgcaccagaucugcaacgugguggccauccccgggaacgccuccauggacgcggucugcaccagcacgucccccacccggagcauggcccccggcgccgugcaccucccgcagcccguguccacccgcagccagcacacccagcccacgcccgagccgagcaccgcccccuccaccagcuuccugcugcccauggggcccuccccgcccgccgagggcagcaccggcgacuucgcgcuccccgucgggcugaucgugggcgugacggcccuggggcuccugaucaucggcgucgugaacugcgugaucaugacccaggucaagaagaagccccugugccuccagcgggaggccaaggugccgcaccuccccgccgacaaggcccgcggcacccaggggcccgagcagcagcaccuccugaucaccgcgccguccagcuccagcuccagccuggaguccagcgccuccgcccuggaccggcgcgcccccacgcggaaccagccccaggcgcccggcguggaggccagcggggccggcgaggcccgcgccuccaccgggagcuccgacagcuccccgggcggccacgggacccaggucaacgugaccugcaucgucaacgugugcagcagcuccgaccacagcucccagugcagcucccaggcgagcuccacgaugggcgacaccgacagcucccccagcgagucccccaaggacgagcagguccccuucagcaaggaggagugcgccuuccggucccagcuggagaccccggagacccugcuggggagcacggaggagaagccccucccccugggcgugcccgacgccgggaugaagccguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1568 - RNA, 730 nt, Artificial Sequence
  mRNA product Design1 comprising derived and/or modified sequence from Homo sapiens__NP_002623.2__HsPGF (opt1)
gggagaaagcuuaccaugcccgugaugcgccuguucccgugcuuccuccagcugcuggccggccucgcccugcccgcggucccgccccagcagugggcccugagcgccgggaacggcuccagcgagguggaggugguccccuuccaggaggugugggggcgguccuacugccgcgcccucgagcggcugguggacgucgugagcgaguaccccuccgagguggagcacauguucagccccuccugcgucagccugcuccgcugcaccggcugcugcggggacgagaaccugcacugcgugcccguggagaccgccaacgucacgaugcagcugcucaagauccgguccggcgaccgcccgagcuacguggagcugaccuucucccagcacgugcggugcgagugccgcccccugcgggagaagaugaagcccgagcgccggcgccccaagggccgggggaagcgccggcgcgagaagcagcggccgaccgacugccaccucugcggcgacgcggucccccgccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1569 - RNA, 1456 nt, Artificial Sequence
  mRNA product Design1 comprising derived and/or modified sequence from Homo sapiens__NP_001020537.2__HsVEGFA (opt1)
gggagaaagcuuaccaugaccgaccgccagaccgacacggcccccagcccguccuaccaccuccugcccggccggcgccggaccguggacgccgcggccagccgcgggcagggccccgagcccgcccccgggggcggggucgagggcgugggcgcccgcgggguggcccugaagcuguucguccagcuccugggcugcucccgguucgggggcgcgguggugcgggccggggaggccgagcccagcggcgccgcgcgcuccgccagcuccggccgggaggagccccagcccgaggagggggaggaggaggaggagaaggaggaggagcgcggcccgcaguggcggcugggggcccgcaagcccggcagcuggaccggcgaggccgccgucugcgcggacuccgcccccgccgcccgggccccgcaggcgcucgcccgcgccagcgggcggggcgggcgcguggcccggcgcggcgccgaggaguccgggccgccccacagccccucccggcgcggcagcgcgucccgggccggccccgggcgcgccagcgagaccaugaacuuccugcuguccugggugcacuggagccucgcccugcugcucuaccugcaccacgccaaguggucccaggcggccccgauggccgagggcgggggccagaaccaccacgaggucgugaaguucauggacguguaccagcgcagcuacugccaccccaucgagacgcuggucgacaucuuccaggaguaccccgacgagaucgaguacaucuucaagcccagcugcgugccgcucaugcggugcgggggcugcugcaacgacgagggccuggagugcgugcccaccgaggaguccaacaucaccaugcagaucaugcgcaucaagccccaccaggggcagcacaucggcgagaugagcuuccugcagcacaacaagugcgagugccggcccaagaaggaccgcgcccggcaggagaagaaguccguccgcgggaagggcaaggggcagaagcggaagcgcaagaagucccgguacaagagcuggagcguguacgugggcgcgcgcugcugccucaugccguggucccugcccggcccccaccccugcgggccgugcagcgagcggcgcaagcaccuguucguccaggacccccagaccugcaagugcuccugcaagaacacggacagccggugcaaggcccgccagcucgagcugaacgagcggaccugccgcugcgacaagccccggcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1570 - RNA, 916 nt, Artificial Sequence
  mRNA product Design1 comprising derived and/or modified sequence from Homo sapiens__NP_001165094.1__HsVEGFA (opt1)
gggagaaagcuuaccaugaacuuccugcucagcugggugcacuggucccuggcccugcuccuguaccugcaccacgccaaguggagccaggcggcccccauggccgagggcgggggccagaaccaccacgaggucgugaaguucauggacguguaccagcgcuccuacugccacccgaucgagacccucgucgacaucuuccaggaguaccccgacgagaucgaguacaucuucaagcccagcugcgugccccugaugcggugcgggggcugcugcaacgacgaggggcuggagugcgugccgaccgaggaguccaacaucacgaugcagaucaugcgcaucaagccccaccagggccagcacaucggcgagaugagcuuccuccagcacaacaagugcgagugccggcccaagaaggaccgcgcccggcaggagaagaaguccguccgcgggaagggcaaggggcagaagcggaagcgcaagaagucccgguacaagagcuggagcguguacgugggcgcccgcugcugccugaugcccuggucccugccggggccccaccccugcggccccugcagcgagcggcgcaagcaccucuucguccaggacccgcagaccugcaagugcuccugcaagaacaccgacagccggugcaaggcgcgccagcuggagcugaacgagcggaccugccgcugcgacaagccccggcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1571 - RNA, 841 nt, Artificial Sequence
  mRNA product Design1 comprising derived and/or modified sequence from Homo sapiens__NP_003368.1__HsVEGFB (opt1)
gggagaaagcuuaccaugagcccccugcuccgccggcugcugcucgccgcccugcugcagcucgcgccggcccaggcccccgugucccagcccgacgcccccggccaccagcgcaaggucgugagcuggaucgacguguacacccgggcgaccugccagccgcgcgaggucguggugccccugacggucgagcugauggggaccguggccaagcagcucgugcccuccugcgucaccgugcagcggugcggcgggugcugccccgacgacggccuggagugcgugccgaccgggcagcaccagguccgcaugcagauccugaugauccgguaccccagcucccagcucggcgagaugagccuggaggagcacucccagugcgagugccgccccaagaagaaggacagcgccgugaagcccgaccgggccgccacgccgcaccaccgcccccagccccgguccgugcccggcugggacagcgcgccgggggcccccucccccgccgacaucacccaccccaccccggcccccggccccagcgcccacgcggcccccuccaccacgagcgcccugaccccggggcccgccgccgcggccgccgacgccgccgcguccagcgucgccaagggcggggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1572 - RNA, 1477 nt, Artificial Sequence
  mRNA product Design1 comprising derived and/or modified sequence from Homo sapiens__NP_005420.1__HsVEGFC (opt1)
gggagaaagcuuaccaugcaccuccugggcuucuucagcguggccugcucccugcuggccgcggcccuccugcccgggccgcgcgaggcccccgccgccgcggccgccuucgagagcggccuggaccucuccgacgccgagcccgacgcgggggaggccaccgccuacgccagcaaggaccuggaggagcagcugcgguccgucagcuccguggacgagcucaugaccgugcuguaccccgaguacuggaagauguacaagugccagcugcgcaagggcggguggcagcacaaccgggagcaggccaaccucaacagccgcacggaggagaccaucaaguucgcggccgcccacuacaacaccgagauccugaaguccaucgacaacgaguggcggaagacccagugcaugccgcgcgaggucugcaucgacgugggcaaggaguucggcguggccacgaacaccuucuucaagccgcccugcgucagcguguaccggugcgggggcugcugcaacuccgaggggcugcagugcaugaacaccagcaccuccuaccucagcaagacgcuguucgagaucaccgugccccugucccagggccccaagcccgucaccaucagcuucgccaaccacaccuccugccgcugcaugagcaagcucgacguguaccgccaggugcacuccaucauccggcggagccugcccgcgacgcugccccagugccaggccgccaacaagaccugcccgaccaacuacauguggaacaaccacaucugccgcugccucgcccaggaggacuucauguucagcuccgacgccggggacgacagcaccgacggcuuccacgacaucugcggccccaacaaggagcuggacgaggagacgugccagugcgucugccgggcggggcugcgccccgccuccugcggcccccacaaggagcucgaccggaacagcugccagugcgugugcaagaacaagcuguucccgucccagugcggggccaaccgcgaguucgacgagaacacgugccagugcgugugcaagcggaccugcccccgcaaccagccccugaaccccggcaagugcgccugcgagugcaccgagagcccgcagaagugccuccugaagggcaagaaguuccaccaccagaccugcuccugcuaccggcgccccugcaccaaccggcagaaggccugcgagcccggguucagcuacuccgaggaggucugccgcugcgugcccagcuacuggaagcgcccgcagauguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1573 - RNA, 1282 nt, Artificial Sequence
  mRNA product Design1 comprising derived and/or modified sequence from Homo sapiens__NP_004460.1__HsVEGFD (opt1)
gggagaaagcuuaccauguaccgcgaguggguggucgugaacguguucaugaugcuguacguccagcucgugcagggcagcuccaacgagcacgggcccgugaagcggagcucccagagcacccuggagcgcuccgagcagcagauccgggccgccagcucccuggaggagcuccugcgcaucacccacagcgaggacuggaagcuguggcggugccgccuccggcugaaguccuucacgagcauggacucccgcagcgcgucccaccggagcacccgcuucgccgccaccuucuacgacaucgagacccugaaggucaucgacgaggaguggcagcggacgcagugcuccccgcgcgagaccugcguggagguggccagcgagcucggcaaguccaccaacaccuucuucaagccgcccugcgucaacguguuccggugcgggggcugcugcaacgaggagagccugaucugcaugaacacguccaccagcuacaucagcaagcagcuguucgagaucuccgugccccucaccagcguccccgagcuggugcccgugaaggucgccaaccacaccgggugcaagugccugcccacggcgccccgccacccguacuccaucauccggcgcagcauccagauccccgaggaggaccggugcucccacagcaagaagcucugccccaucgacaugcugugggacuccaacaagugcaagugcgugcugcaggaggagaacccccucgccggcaccgaggaccacagccaccuccaggagccggcccugugcggcccccacaugauguucgacgaggaccgcugcgagugcgugugcaagacccccugccccaaggaccugauccagcacccgaagaacugcuccugcuucgagugcaaggagagccuggagaccugcugccagaagcacaagcuguuccaccccgacacgugcuccugcgaggaccggugccccuuccacacccgccccugcgccagcgggaagaccgcgugcgccaagcacugccgguucccgaaggagaagcgcgccgcccagggcccccacucccgcaagaaccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1574 - RNA, 847 nt, Artificial Sequence
  mRNA product Design1 comprising derived and/or modified sequence from Homo sapiens__NP_061986.1__HsFGF21 (opt2)
gggagaaagcuuaccauggacuccgacgagaccggcuucgagcacuccggccucugggucuccguccucgccggccuccuccucggcgccugccaggcccaccccauccccgacuccuccccccuccuccaguucggcggccagguccgccagcgcuaccucuacaccgacgacgcccagcagaccgaggcccaccucgagauccgcgaggacggcaccgucggcggcgccgccgaccagucccccgagucccuccuccagcucaaggcccucaagcccggcgucauccagauccucggcgucaagaccucccgcuuccucugccagcgccccgacggcgcccucuacggcucccuccacuucgaccccgaggccugcuccuuccgcgagcuccuccucgaggacggcuacaacgucuaccaguccgaggcccacggccucccccuccaccuccccggcaacaaguccccccaccgcgaccccgccccccgcggccccgcccgcuuccucccccuccccggccucccccccgcccuccccgagccccccggcauccucgccccccagccccccgacgucggcuccuccgacccccucuccauggucggccccucccagggccgcucccccuccuacgccuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1575 - RNA, 1627 nt, Artificial Sequence
  mRNA product Design1 comprising derived and/or modified sequence from Homo sapiens__NP_002412.1__HsMMP1 (opt2)
gggagaaagcuuaccaugcacuccuuccccccccuccuccuccuccucuucuggggcgucgucucccacuccuuccccgccacccucgagacccaggagcaggacgucgaccucguccagaaguaccucgagaaguacuacaaccucaagaacgacggccgccaggucgagaagcgccgcaacuccggccccgucgucgagaagcucaagcagaugcaggaguucuucggccucaaggucaccggcaagcccgacgccgagacccucaaggucaugaagcagccccgcugcggcguccccgacgucgcccaguucguccucaccgagggcaacccccgcugggagcagacccaccucaccuaccgcaucgagaacuacacccccgaccucccccgcgccgacgucgaccacgccaucgagaaggccuuccagcucugguccaacgucaccccccucaccuucaccaaggucuccgagggccaggccgacaucaugaucuccuucguccgcggcgaccaccgcgacaacucccccuucgacggccccggcggcaaccucgcccacgccuuccagcccggccccggcaucggcggcgacgcccacuucgacgaggacgagcgcuggaccaacaacuuccgcgaguacaaccuccaccgcgucgccgcccacgagcucggccacucccucggccucucccacuccaccgacaucggcgcccucauguaccccuccuacaccuucuccggcgacguccagcucgcccaggacgacaucgacggcauccaggccaucuacggccgcucccagaaccccguccagcccaucggcccccagacccccaaggccugcgacuccaagcucaccuucgacgccaucaccaccauccgcggcgaggucauguucuucaaggaccgcuucuacaugcgcaccaaccccuucuaccccgaggucgagcucaacuucaucuccgucuucuggccccagcuccccaacggccucgaggccgccuacgaguucgccgaccgcgacgagguccgcuucuucaagggcaacaaguacugggccguccagggccagaacguccuccacggcuaccccaaggacaucuacuccuccuucggcuucccccgcaccgucaagcacaucgacgccgcccucuccgaggagaacaccggcaagaccuacuucuucgucgccaacaaguacuggcgcuacgacgaguacaagcgcuccauggaccccggcuaccccaagaugaucgcccacgacuuccccggcaucggccacaaggucgacgccgucuucaugaaggacggcuucuucuacuucuuccacggcacccgccaguacaaguucgaccccaagaccaagcgcauccucacccuccagaaggccaacuccugguucaacugccgcaagaacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1576 - RNA, 1387 nt, Artificial Sequence
  mRNA product Design1 comprising derived and/or modified sequence from Homo sapiens__NP_002412.1__HsMMP1(1-19,100-469) (opt2)
gggagaaagcuuaccaugcacuccuuccccccccuccuccuccuccucuucuggggcgucgucucccacuccuucguccucaccgagggcaacccccgcugggagcagacccaccucaccuaccgcaucgagaacuacacccccgaccucccccgcgccgacgucgaccacgccaucgagaaggccuuccagcucugguccaacgucaccccccucaccuucaccaaggucuccgagggccaggccgacaucaugaucuccuucguccgcggcgaccaccgcgacaacucccccuucgacggccccggcggcaaccucgcccacgccuuccagcccggccccggcaucggcggcgacgcccacuucgacgaggacgagcgcuggaccaacaacuuccgcgaguacaaccuccaccgcgucgccgcccacgagcucggccacucccucggccucucccacuccaccgacaucggcgcccucauguaccccuccuacaccuucuccggcgacguccagcucgcccaggacgacaucgacggcauccaggccaucuacggccgcucccagaaccccguccagcccaucggcccccagacccccaaggccugcgacuccaagcucaccuucgacgccaucaccaccauccgcggcgaggucauguucuucaaggaccgcuucuacaugcgcaccaaccccuucuaccccgaggucgagcucaacuucaucuccgucuucuggccccagcuccccaacggccucgaggccgccuacgaguucgccgaccgcgacgagguccgcuucuucaagggcaacaaguacugggccguccagggccagaacguccuccacggcuaccccaaggacaucuacuccuccuucggcuucccccgcaccgucaagcacaucgacgccgcccucuccgaggagaacaccggcaagaccuacuucuucgucgccaacaaguacuggcgcuacgacgaguacaagcgcuccauggaccccggcuaccccaagaugaucgcccacgacuuccccggcaucggccacaaggucgacgccgucuucaugaaggacggcuucuucuacuucuuccacggcacccgccaguacaaguucgaccccaagaccaagcgcauccucacccuccagaaggccaacuccugguucaacugccgcaagaacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1577 - RNA, 3574 nt, Artificial Sequence
  mRNA product Design1 comprising derived and/or modified sequence from Clostridium histolyticum__BAA77453.1__ColG (opt2)
gggagaaagcuuaccaugaagaagaacauccucaagauccucauggacuccuacuccaaggaguccaagauccagaccguccgccgcgucaccuccgucucccuccucgccgucuaccucaccaugaacaccuccucccucguccucgccaagcccaucgagaacaccaacgacaccuccaucaagaacgucgagaagcuccgcaacgcccccaacgaggagaacuccaagaaggucgaggacuccaagaacgacaaggucgagcacgucaagaacaucgaggaggccaaggucgagcaggucgcccccgaggucaaguccaaguccacccuccgcuccgccuccaucgccaacaccaacuccgagaaguacgacuucgaguaccucaacggccucuccuacaccgagcucaccaaccucaucaagaacaucaaguggaaccagaucaacggccucuucaacuacuccaccggcucccagaaguucuucggcgacaagaaccgcguccaggccaucaucaacgcccuccaggaguccggccgcaccuacaccgccaacgacaugaagggcaucgagaccuucaccgagguccuccgcgccggcuucuaccucggcuacuacaacgacggccucuccuaccucaacgaccgcaacuuccaggacaagugcauccccgccaugaucgccauccagaagaaccccaacuucaagcucggcaccgccguccaggacgaggucaucaccucccucggcaagcucaucggcaacgccuccgccaacgccgaggucgucaacaacugcguccccguccucaagcaguuccgcgagaaccucaaccaguacgcccccgacuacgucaagggcaccgccgucaacgagcucaucaagggcaucgaguucgacuucuccggcgccgccuacgagaaggacgucaagaccaugcccugguacggcaagaucgaccccuucaucaacgagcucaaggcccucggccucuacggcaacaucaccuccgccaccgagugggccuccgacgucggcaucuacuaccucuccaaguucggccucuacuccaccaaccgcaacgacaucguccagucccucgagaaggccgucgacauguacaaguacggcaagaucgccuucgucgccauggagcgcaucaccugggacuacgacggcaucggcuccaacggcaagaaggucgaccacgacaaguuccucgacgacgccgagaagcacuaccuccccaagaccuacaccuucgacaacggcaccuucaucauccgcgccggcgacaaggucuccgaggagaagaucaagcgccucuacugggccucccgcgaggucaagucccaguuccaccgcgucgucggcaacgacaaggcccucgaggucggcaacgccgacgacguccucaccaugaagaucuucaacucccccgaggaguacaaguucaacaccaacaucaacggcgucuccaccgacaacggcggccucuacaucgagccccgcggcaccuucuacaccuacgagcgcaccccccagcaguccaucuucucccucgaggagcucuuccgccacgaguacacccacuaccuccaggcccgcuaccucgucgacggccucuggggccagggccccuucuacgagaagaaccgccucaccugguucgacgagggcaccgccgaguucuucgccggcuccacccgcaccuccggcguccucccccgcaaguccauccucggcuaccucgccaaggacaaggucgaccaccgcuacucccucaagaagacccucaacuccggcuacgacgacuccgacuggauguucuacaacuacggcuucgccgucgcccacuaccucuacgagaaggacaugcccaccuucaucaagaugaacaaggccauccucaacaccgacgucaaguccuacgacgagaucaucaagaagcucuccgacgacgccaacaagaacaccgaguaccagaaccacauccaggagcucgccgacaaguaccagggcgccggcaucccccucgucuccgacgacuaccucaaggaccacggcuacaagaaggccuccgaggucuacuccgagaucuccaaggccgccucccucaccaacaccuccgucaccgccgagaagucccaguacuucaacaccuucacccuccgcggcaccuacaccggcgagaccuccaagggcgaguucaaggacugggacgagauguccaagaagcucgacggcacccucgagucccucgccaagaacuccugguccggcuacaagacccucaccgccuacuucaccaacuaccgcgucaccuccgacaacaagguccaguacgacgucgucuuccacggcguccucaccgacaacgccgacaucuccaacaacaaggcccccaucgccaaggucaccggccccuccaccggcgccgucggccgcaacaucgaguucuccggcaaggacuccaaggacgaggacggcaagaucgucuccuacgacugggacuucggcgacggcgccaccucccgcggcaagaacuccguccacgccuacaagaaggccggcaccuacaacgucacccucaaggucaccgacgacaagggcgccaccgccaccgaguccuucaccaucgagaucaagaacgaggacaccaccacccccaucaccaaggagauggagcccaacgacgacaucaaggaggccaacggccccaucgucgagggcgucaccgucaagggcgaccucaacggcuccgacgacgccgacaccuucuacuucgacgucaaggaggacggcgacgucaccaucgagcuccccuacuccggcuccuccaacuucaccuggcucgucuacaaggagggcgacgaccagaaccacaucgccuccggcaucgacaagaacaacuccaaggucggcaccuucaaguccaccaagggccgccacuacgucuucaucuacaagcacgacuccgccuccaacaucuccuacucccucaacaucaagggccucggcaacgagaagcucaaggagaaggagaacaacgacuccuccgacaaggccaccgucauccccaacuucaacaccaccaugcagggcucccuccucggcgacgacucccgcgacuacuacuccuucgaggucaaggaggagggcgaggucaacaucgagcucgacaagaaggacgaguucggcgucaccuggacccuccaccccgaguccaacaucaacgaccgcaucaccuacggccaggucgacggcaacaaggucuccaacaaggucaagcuccgccccggcaaguacuaccuccucgucuacaaguacuccggcuccggcaacuacgagcuccgcgucaacaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1578 - RNA, 3298 nt, Artificial Sequence
  mRNA product Design1 comprising derived and/or modified sequence from Clostridium histolyticum__BAA77453.1__HsALB(1-18)_ColG(111-1118) (opt2)
gggagaaagcuuaccaugaagugggucaccuucaucucccuccucuuccucuucuccuccgccuacuccaucgccaacaccaacuccgagaaguacgacuucgaguaccucaacggccucuccuacaccgagcucaccaaccucaucaagaacaucaaguggaaccagaucaacggccucuucaacuacuccaccggcucccagaaguucuucggcgacaagaaccgcguccaggccaucaucaacgcccuccaggaguccggccgcaccuacaccgccaacgacaugaagggcaucgagaccuucaccgagguccuccgcgccggcuucuaccucggcuacuacaacgacggccucuccuaccucaacgaccgcaacuuccaggacaagugcauccccgccaugaucgccauccagaagaaccccaacuucaagcucggcaccgccguccaggacgaggucaucaccucccucggcaagcucaucggcaacgccuccgccaacgccgaggucgucaacaacugcguccccguccucaagcaguuccgcgagaaccucaaccaguacgcccccgacuacgucaagggcaccgccgucaacgagcucaucaagggcaucgaguucgacuucuccggcgccgccuacgagaaggacgucaagaccaugcccugguacggcaagaucgaccccuucaucaacgagcucaaggcccucggccucuacggcaacaucaccuccgccaccgagugggccuccgacgucggcaucuacuaccucuccaaguucggccucuacuccaccaaccgcaacgacaucguccagucccucgagaaggccgucgacauguacaaguacggcaagaucgccuucgucgccauggagcgcaucaccugggacuacgacggcaucggcuccaacggcaagaaggucgaccacgacaaguuccucgacgacgccgagaagcacuaccuccccaagaccuacaccuucgacaacggcaccuucaucauccgcgccggcgacaaggucuccgaggagaagaucaagcgccucuacugggccucccgcgaggucaagucccaguuccaccgcgucgucggcaacgacaaggcccucgaggucggcaacgccgacgacguccucaccaugaagaucuucaacucccccgaggaguacaaguucaacaccaacaucaacggcgucuccaccgacaacggcggccucuacaucgagccccgcggcaccuucuacaccuacgagcgcaccccccagcaguccaucuucucccucgaggagcucuuccgccacgaguacacccacuaccuccaggcccgcuaccucgucgacggccucuggggccagggccccuucuacgagaagaaccgccucaccugguucgacgagggcaccgccgaguucuucgccggcuccacccgcaccuccggcguccucccccgcaaguccauccucggcuaccucgccaaggacaaggucgaccaccgcuacucccucaagaagacccucaacuccggcuacgacgacuccgacuggauguucuacaacuacggcuucgccgucgcccacuaccucuacgagaaggacaugcccaccuucaucaagaugaacaaggccauccucaacaccgacgucaaguccuacgacgagaucaucaagaagcucuccgacgacgccaacaagaacaccgaguaccagaaccacauccaggagcucgccgacaaguaccagggcgccggcaucccccucgucuccgacgacuaccucaaggaccacggcuacaagaaggccuccgaggucuacuccgagaucuccaaggccgccucccucaccaacaccuccgucaccgccgagaagucccaguacuucaacaccuucacccuccgcggcaccuacaccggcgagaccuccaagggcgaguucaaggacugggacgagauguccaagaagcucgacggcacccucgagucccucgccaagaacuccugguccggcuacaagacccucaccgccuacuucaccaacuaccgcgucaccuccgacaacaagguccaguacgacgucgucuuccacggcguccucaccgacaacgccgacaucuccaacaacaaggcccccaucgccaaggucaccggccccuccaccggcgccgucggccgcaacaucgaguucuccggcaaggacuccaaggacgaggacggcaagaucgucuccuacgacugggacuucggcgacggcgccaccucccgcggcaagaacuccguccacgccuacaagaaggccggcaccuacaacgucacccucaaggucaccgacgacaagggcgccaccgccaccgaguccuucaccaucgagaucaagaacgaggacaccaccacccccaucaccaaggagauggagcccaacgacgacaucaaggaggccaacggccccaucgucgagggcgucaccgucaagggcgaccucaacggcuccgacgacgccgacaccuucuacuucgacgucaaggaggacggcgacgucaccaucgagcuccccuacuccggcuccuccaacuucaccuggcucgucuacaaggagggcgacgaccagaaccacaucgccuccggcaucgacaagaacaacuccaaggucggcaccuucaaguccaccaagggccgccacuacgucuucaucuacaagcacgacuccgccuccaacaucuccuacucccucaacaucaagggccucggcaacgagaagcucaaggagaaggagaacaacgacuccuccgacaaggccaccgucauccccaacuucaacaccaccaugcagggcucccuccucggcgacgacucccgcgacuacuacuccuucgaggucaaggaggagggcgaggucaacaucgagcucgacaagaaggacgaguucggcgucaccuggacccuccaccccgaguccaacaucaacgaccgcaucaccuacggccaggucgacggcaacaaggucuccaacaaggucaagcuccgccccggcaaguacuaccuccucgucuacaaguacuccggcuccggcaacuacgagcuccgcgucaacaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1579 - RNA, 3646 nt, Artificial Sequence
  mRNA product Design1 comprising derived and/or modified sequence from Clostridium histolyticum__BAA77453.1__HsALB(1-18)_ColG(1-110)_CS-F_ColG(111-1 118) (opt2)
gggagaaagcuuaccaugaagugggucaccuucaucucccuccucuuccucuucuccuccgccuacuccaugaagaagaacauccucaagauccucauggacuccuacuccaaggaguccaagauccagaccguccgccgcgucaccuccgucucccuccucgccgucuaccucaccaugaacaccuccucccucguccucgccaagcccaucgagaacaccaacgacaccuccaucaagaacgucgagaagcuccgcaacgcccccaacgaggagaacuccaagaaggucgaggacuccaagaacgacaaggucgagcacgucaagaacaucgaggaggccaaggucgagcaggucgcccccgaggucaaguccaaguccacccuccgcuccgccucccgccgccgccgcaagcgcaucgccaacaccaacuccgagaaguacgacuucgaguaccucaacggccucuccuacaccgagcucaccaaccucaucaagaacaucaaguggaaccagaucaacggccucuucaacuacuccaccggcucccagaaguucuucggcgacaagaaccgcguccaggccaucaucaacgcccuccaggaguccggccgcaccuacaccgccaacgacaugaagggcaucgagaccuucaccgagguccuccgcgccggcuucuaccucggcuacuacaacgacggccucuccuaccucaacgaccgcaacuuccaggacaagugcauccccgccaugaucgccauccagaagaaccccaacuucaagcucggcaccgccguccaggacgaggucaucaccucccucggcaagcucaucggcaacgccuccgccaacgccgaggucgucaacaacugcguccccguccucaagcaguuccgcgagaaccucaaccaguacgcccccgacuacgucaagggcaccgccgucaacgagcucaucaagggcaucgaguucgacuucuccggcgccgccuacgagaaggacgucaagaccaugcccugguacggcaagaucgaccccuucaucaacgagcucaaggcccucggccucuacggcaacaucaccuccgccaccgagugggccuccgacgucggcaucuacuaccucuccaaguucggccucuacuccaccaaccgcaacgacaucguccagucccucgagaaggccgucgacauguacaaguacggcaagaucgccuucgucgccauggagcgcaucaccugggacuacgacggcaucggcuccaacggcaagaaggucgaccacgacaaguuccucgacgacgccgagaagcacuaccuccccaagaccuacaccuucgacaacggcaccuucaucauccgcgccggcgacaaggucuccgaggagaagaucaagcgccucuacugggccucccgcgaggucaagucccaguuccaccgcgucgucggcaacgacaaggcccucgaggucggcaacgccgacgacguccucaccaugaagaucuucaacucccccgaggaguacaaguucaacaccaacaucaacggcgucuccaccgacaacggcggccucuacaucgagccccgcggcaccuucuacaccuacgagcgcaccccccagcaguccaucuucucccucgaggagcucuuccgccacgaguacacccacuaccuccaggcccgcuaccucgucgacggccucuggggccagggccccuucuacgagaagaaccgccucaccugguucgacgagggcaccgccgaguucuucgccggcuccacccgcaccuccggcguccucccccgcaaguccauccucggcuaccucgccaaggacaaggucgaccaccgcuacucccucaagaagacccucaacuccggcuacgacgacuccgacuggauguucuacaacuacggcuucgccgucgcccacuaccucuacgagaaggacaugcccaccuucaucaagaugaacaaggccauccucaacaccgacgucaaguccuacgacgagaucaucaagaagcucuccgacgacgccaacaagaacaccgaguaccagaaccacauccaggagcucgccgacaaguaccagggcgccggcaucccccucgucuccgacgacuaccucaaggaccacggcuacaagaaggccuccgaggucuacuccgagaucuccaaggccgccucccucaccaacaccuccgucaccgccgagaagucccaguacuucaacaccuucacccuccgcggcaccuacaccggcgagaccuccaagggcgaguucaaggacugggacgagauguccaagaagcucgacggcacccucgagucccucgccaagaacuccugguccggcuacaagacccucaccgccuacuucaccaacuaccgcgucaccuccgacaacaagguccaguacgacgucgucuuccacggcguccucaccgacaacgccgacaucuccaacaacaaggcccccaucgccaaggucaccggccccuccaccggcgccgucggccgcaacaucgaguucuccggcaaggacuccaaggacgaggacggcaagaucgucuccuacgacugggacuucggcgacggcgccaccucccgcggcaagaacuccguccacgccuacaagaaggccggcaccuacaacgucacccucaaggucaccgacgacaagggcgccaccgccaccgaguccuucaccaucgagaucaagaacgaggacaccaccacccccaucaccaaggagauggagcccaacgacgacaucaaggaggccaacggccccaucgucgagggcgucaccgucaagggcgaccucaacggcuccgacgacgccgacaccuucuacuucgacgucaaggaggacggcgacgucaccaucgagcuccccuacuccggcuccuccaacuucaccuggcucgucuacaaggagggcgacgaccagaaccacaucgccuccggcaucgacaagaacaacuccaaggucggcaccuucaaguccaccaagggccgccacuacgucuucaucuacaagcacgacuccgccuccaacaucuccuacucccucaacaucaagggccucggcaacgagaagcucaaggagaaggagaacaacgacuccuccgacaaggccaccgucauccccaacuucaacaccaccaugcagggcucccuccucggcgacgacucccgcgacuacuacuccuucgaggucaaggaggagggcgaggucaacaucgagcucgacaagaaggacgaguucggcgucaccuggacccuccaccccgaguccaacaucaacgaccgcaucaccuacggccaggucgacggcaacaaggucuccaacaaggucaagcuccgccccggcaaguacuaccuccucgucuacaaguacuccggcuccggcaacuacgagcuccgcgucaacaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1580 - RNA, 3322 nt, Artificial Sequence
  mRNA product Design1 comprising derived and/or modified sequence from Clostridium histolyticum__BAA34542.1__ColH (opt2)
gggagaaagcuuaccaugaacuuccucaagaucauccucaaccgcggcaagaccaugaagcgcaagugccucuccaagcgccucaugcucgccaucaccauggccaccaucuucaccgucaacuccacccuccccaucuacgccgccgucgacaagaacaacgccaccgccgccguccagaacgaguccaagcgcuacaccgucuccuaccucaagacccucaacuacuacgaccucgucgaccuccucgucaagaccgagaucgagaaccuccccgaccucuuccaguacuccuccgacgccaaggaguucuacggcaacaagacccgcauguccuucaucauggacgagaucggccgccgcgccccccaguacaccgagaucgaccacaagggcauccccacccucgucgaggucguccgcgccggcuucuaccucggcuuccacaacaaggagcucaacgagaucaacaagcgcuccuucaaggagcgcgucauccccuccauccucgccauccagaagaaccccaacuucaagcucggcaccgagguccaggacaagaucgucuccgccaccggccuccucgccggcaacgagaccgccccccccgaggucgucaacaacuucacccccauccuccaggacugcaucaagaacaucgaccgcuacgcccucgacgaccucaaguccaaggcccucuucaacguccucgccgcccccaccuacgacaucaccgaguaccuccgcgccaccaaggagaagcccgagaacacccccugguacggcaagaucgacggcuucaucaacgagcucaagaagcucgcccucuacggcaagaucaacgacaacaacuccuggaucaucgacaacggcaucuaccacaucgccccccucggcaagcuccacuccaacaacaagaucggcaucgagacccucaccgaggucaugaaggucuaccccuaccucuccaugcagcaccuccaguccgccgaccagaucaagcgccacuacgacuccaaggacgccgagggcaacaagaucccccucgacaaguucaagaaggagggcaaggagaaguacugccccaagaccuacaccuucgacgacggcaaggucaucaucaaggccggcgcccgcgucgaggaggagaaggucaagcgccucuacugggccuccaaggaggucaacucccaguucuuccgcgucuacggcaucgacaagccccucgaggagggcaaccccgacgacauccucaccauggucaucuacaacucccccgaggaguacaagcucaacuccguccucuacggcuacgacaccaacaacggcggcauguacaucgagcccgagggcaccuucuucaccuacgagcgcgaggcccaggaguccaccuacacccucgaggagcucuuccgccacgaguacacccacuaccuccagggccgcuacgccguccccggccaguggggccgcaccaagcucuacgacaacgaccgccucaccugguacgaggagggcggcgccgagcucuucgccggcuccacccgcaccuccggcauccucccccgcaaguccaucgucuccaacauccacaacaccacccgcaacaaccgcuacaagcucuccgacaccguccacuccaaguacggcgccuccuucgaguucuacaacuacgccugcauguucauggacuacauguacaacaaggacaugggcauccucaacaagcucaacgaccucgccaagaacaacgacgucgacggcuacgacaacuacauccgcgaccucuccuccaacuacgcccucaacgacaaguaccaggaccacaugcaggagcgcaucgacaacuacgagaaccucaccguccccuucgucgccgacgacuaccucguccgccacgccuacaagaaccccaacgagaucuacuccgagaucuccgaggucgccaagcucaaggacgccaaguccgaggucaagaagucccaguacuucuccaccuucacccuccgcggcuccuacaccggcggcgccuccaagggcaagcucgaggaccagaaggccaugaacaaguucaucgacgacucccucaagaagcucgacaccuacuccugguccggcuacaagacccucaccgccuacuucaccaacuacaaggucgacuccuccaaccgcgucaccuacgacgucgucuuccacggcuaccuccccaacgagggcgacuccaagaacucccuccccuacggcaagaucaacggcaccuacaagggcaccgagaaggagaagaucaaguucuccuccgagggcuccuucgaccccgacggcaagaucgucuccuacgagugggacuucggcgacggcaacaaguccaacgaggagaaccccgagcacuccuacgacaaggucggcaccuacaccgucaagcucaaggucaccgacgacaagggcgaguccuccgucuccaccaccaccgccgagaucaaggaccucuccgagaacaagcuccccgucaucuacaugcacguccccaaguccggcgcccucaaccagaaggucgucuucuacggcaagggcaccuacgaccccgacggcuccaucgccggcuaccagugggacuucggcgacggcuccgacuucuccuccgagcagaaccccucccacgucuacaccaagaagggcgaguacaccgucacccuccgcgucauggacuccuccggccagauguccgagaagaccaugaagaucaagaucaccgaccccgucuaccccaucggcaccgagaaggagcccaacaacuccaaggagaccgccuccggccccaucguccccggcauccccgucuccggcaccaucgagaacaccuccgaccaggacuacuucuacuucgacgucaucacccccggcgaggucaagaucgacaucaacaagcucggcuacggcggcgccaccugggucgucuacgacgagaacaacaacgccgucuccuacgccaccgacgacggccagaaccucuccggcaaguucaaggccgacaagcccggccgcuacuacauccaccucuacauguucaacggcuccuacaugcccuaccgcaucaacaucgagggcuccgucggccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1581 - RNA, 3283 nt, Artificial Sequence
  mRNA product Design1 comprising derived and/or modified sequence from Clostridium histolyticum__BAA34542.1__ColH (opt2)
gggagaaagcuuaccaugaagcgcaagugccucuccaagcgccucaugcucgccaucaccauggccaccaucuucaccgucaacuccacccuccccaucuacgccgccgucgacaagaacaacgccaccgccgccguccagaacgaguccaagcgcuacaccgucuccuaccucaagacccucaacuacuacgaccucgucgaccuccucgucaagaccgagaucgagaaccuccccgaccucuuccaguacuccuccgacgccaaggaguucuacggcaacaagacccgcauguccuucaucauggacgagaucggccgccgcgccccccaguacaccgagaucgaccacaagggcauccccacccucgucgaggucguccgcgccggcuucuaccucggcuuccacaacaaggagcucaacgagaucaacaagcgcuccuucaaggagcgcgucauccccuccauccucgccauccagaagaaccccaacuucaagcucggcaccgagguccaggacaagaucgucuccgccaccggccuccucgccggcaacgagaccgccccccccgaggucgucaacaacuucacccccauccuccaggacugcaucaagaacaucgaccgcuacgcccucgacgaccucaaguccaaggcccucuucaacguccucgccgcccccaccuacgacaucaccgaguaccuccgcgccaccaaggagaagcccgagaacacccccugguacggcaagaucgacggcuucaucaacgagcucaagaagcucgcccucuacggcaagaucaacgacaacaacuccuggaucaucgacaacggcaucuaccacaucgccccccucggcaagcuccacuccaacaacaagaucggcaucgagacccucaccgaggucaugaaggucuaccccuaccucuccaugcagcaccuccaguccgccgaccagaucaagcgccacuacgacuccaaggacgccgagggcaacaagaucccccucgacaaguucaagaaggagggcaaggagaaguacugccccaagaccuacaccuucgacgacggcaaggucaucaucaaggccggcgcccgcgucgaggaggagaaggucaagcgccucuacugggccuccaaggaggucaacucccaguucuuccgcgucuacggcaucgacaagccccucgaggagggcaaccccgacgacauccucaccauggucaucuacaacucccccgaggaguacaagcucaacuccguccucuacggcuacgacaccaacaacggcggcauguacaucgagcccgagggcaccuucuucaccuacgagcgcgaggcccaggaguccaccuacacccucgaggagcucuuccgccacgaguacacccacuaccuccagggccgcuacgccguccccggccaguggggccgcaccaagcucuacgacaacgaccgccucaccugguacgaggagggcggcgccgagcucuucgccggcuccacccgcaccuccggcauccucccccgcaaguccaucgucuccaacauccacaacaccacccgcaacaaccgcuacaagcucuccgacaccguccacuccaaguacggcgccuccuucgaguucuacaacuacgccugcauguucauggacuacauguacaacaaggacaugggcauccucaacaagcucaacgaccucgccaagaacaacgacgucgacggcuacgacaacuacauccgcgaccucuccuccaacuacgcccucaacgacaaguaccaggaccacaugcaggagcgcaucgacaacuacgagaaccucaccguccccuucgucgccgacgacuaccucguccgccacgccuacaagaaccccaacgagaucuacuccgagaucuccgaggucgccaagcucaaggacgccaaguccgaggucaagaagucccaguacuucuccaccuucacccuccgcggcuccuacaccggcggcgccuccaagggcaagcucgaggaccagaaggccaugaacaaguucaucgacgacucccucaagaagcucgacaccuacuccugguccggcuacaagacccucaccgccuacuucaccaacuacaaggucgacuccuccaaccgcgucaccuacgacgucgucuuccacggcuaccuccccaacgagggcgacuccaagaacucccuccccuacggcaagaucaacggcaccuacaagggcaccgagaaggagaagaucaaguucuccuccgagggcuccuucgaccccgacggcaagaucgucuccuacgagugggacuucggcgacggcaacaaguccaacgaggagaaccccgagcacuccuacgacaaggucggcaccuacaccgucaagcucaaggucaccgacgacaagggcgaguccuccgucuccaccaccaccgccgagaucaaggaccucuccgagaacaagcuccccgucaucuacaugcacguccccaaguccggcgcccucaaccagaaggucgucuucuacggcaagggcaccuacgaccccgacggcuccaucgccggcuaccagugggacuucggcgacggcuccgacuucuccuccgagcagaaccccucccacgucuacaccaagaagggcgaguacaccgucacccuccgcgucauggacuccuccggccagauguccgagaagaccaugaagaucaagaucaccgaccccgucuaccccaucggcaccgagaaggagcccaacaacuccaaggagaccgccuccggccccaucguccccggcauccccgucuccggcaccaucgagaacaccuccgaccaggacuacuucuacuucgacgucaucacccccggcgaggucaagaucgacaucaacaagcucggcuacggcggcgccaccugggucgucuacgacgagaacaacaacgccgucuccuacgccaccgacgacggccagaaccucuccggcaaguucaaggccgacaagcccggccgcuacuacauccaccucuacauguucaacggcuccuacaugcccuaccgcaucaacaucgagggcuccgucggccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1582 - RNA, 3217 nt, Artificial Sequence
  mRNA product Design1 comprising derived and/or modified sequence from Clostridium histolyticum__BAA34542.1__HsALB(1-18)_ColH(41-1021) (opt2)
gggagaaagcuuaccaugaagugggucaccuucaucucccuccucuuccucuucuccuccgccuacuccguccagaacgaguccaagcgcuacaccgucuccuaccucaagacccucaacuacuacgaccucgucgaccuccucgucaagaccgagaucgagaaccuccccgaccucuuccaguacuccuccgacgccaaggaguucuacggcaacaagacccgcauguccuucaucauggacgagaucggccgccgcgccccccaguacaccgagaucgaccacaagggcauccccacccucgucgaggucguccgcgccggcuucuaccucggcuuccacaacaaggagcucaacgagaucaacaagcgcuccuucaaggagcgcgucauccccuccauccucgccauccagaagaaccccaacuucaagcucggcaccgagguccaggacaagaucgucuccgccaccggccuccucgccggcaacgagaccgccccccccgaggucgucaacaacuucacccccauccuccaggacugcaucaagaacaucgaccgcuacgcccucgacgaccucaaguccaaggcccucuucaacguccucgccgcccccaccuacgacaucaccgaguaccuccgcgccaccaaggagaagcccgagaacacccccugguacggcaagaucgacggcuucaucaacgagcucaagaagcucgcccucuacggcaagaucaacgacaacaacuccuggaucaucgacaacggcaucuaccacaucgccccccucggcaagcuccacuccaacaacaagaucggcaucgagacccucaccgaggucaugaaggucuaccccuaccucuccaugcagcaccuccaguccgccgaccagaucaagcgccacuacgacuccaaggacgccgagggcaacaagaucccccucgacaaguucaagaaggagggcaaggagaaguacugccccaagaccuacaccuucgacgacggcaaggucaucaucaaggccggcgcccgcgucgaggaggagaaggucaagcgccucuacugggccuccaaggaggucaacucccaguucuuccgcgucuacggcaucgacaagccccucgaggagggcaaccccgacgacauccucaccauggucaucuacaacucccccgaggaguacaagcucaacuccguccucuacggcuacgacaccaacaacggcggcauguacaucgagcccgagggcaccuucuucaccuacgagcgcgaggcccaggaguccaccuacacccucgaggagcucuuccgccacgaguacacccacuaccuccagggccgcuacgccguccccggccaguggggccgcaccaagcucuacgacaacgaccgccucaccugguacgaggagggcggcgccgagcucuucgccggcuccacccgcaccuccggcauccucccccgcaaguccaucgucuccaacauccacaacaccacccgcaacaaccgcuacaagcucuccgacaccguccacuccaaguacggcgccuccuucgaguucuacaacuacgccugcauguucauggacuacauguacaacaaggacaugggcauccucaacaagcucaacgaccucgccaagaacaacgacgucgacggcuacgacaacuacauccgcgaccucuccuccaacuacgcccucaacgacaaguaccaggaccacaugcaggagcgcaucgacaacuacgagaaccucaccguccccuucgucgccgacgacuaccucguccgccacgccuacaagaaccccaacgagaucuacuccgagaucuccgaggucgccaagcucaaggacgccaaguccgaggucaagaagucccaguacuucuccaccuucacccuccgcggcuccuacaccggcggcgccuccaagggcaagcucgaggaccagaaggccaugaacaaguucaucgacgacucccucaagaagcucgacaccuacuccugguccggcuacaagacccucaccgccuacuucaccaacuacaaggucgacuccuccaaccgcgucaccuacgacgucgucuuccacggcuaccuccccaacgagggcgacuccaagaacucccuccccuacggcaagaucaacggcaccuacaagggcaccgagaaggagaagaucaaguucuccuccgagggcuccuucgaccccgacggcaagaucgucuccuacgagugggacuucggcgacggcaacaaguccaacgaggagaaccccgagcacuccuacgacaaggucggcaccuacaccgucaagcucaaggucaccgacgacaagggcgaguccuccgucuccaccaccaccgccgagaucaaggaccucuccgagaacaagcuccccgucaucuacaugcacguccccaaguccggcgcccucaaccagaaggucgucuucuacggcaagggcaccuacgaccccgacggcuccaucgccggcuaccagugggacuucggcgacggcuccgacuucuccuccgagcagaaccccucccacgucuacaccaagaagggcgaguacaccgucacccuccgcgucauggacuccuccggccagauguccgagaagaccaugaagaucaagaucaccgaccccgucuaccccaucggcaccgagaaggagcccaacaacuccaaggagaccgccuccggccccaucguccccggcauccccgucuccggcaccaucgagaacaccuccgaccaggacuacuucuacuucgacgucaucacccccggcgaggucaagaucgacaucaacaagcucggcuacggcggcgccaccugggucgucuacgacgagaacaacaacgccgucuccuacgccaccgacgacggccagaaccucuccggcaaguucaaggccgacaagcccggccgcuacuacauccaccucuacauguucaacggcuccuacaugcccuaccgcaucaacaucgagggcuccgucggccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1583 - RNA, 3355 nt, Artificial Sequence
  mRNA product Design1 comprising derived and/or modified sequence from Clostridium histolyticum__BAA34542.1__HsALB(1-18)_ColH(1-40)_CS-F_ColH(41-102 1) (opt2)
gggagaaagcuuaccaugaagugggucaccuucaucucccuccucuuccucuucuccuccgccuacuccaugaagcgcaagugccucuccaagcgccucaugcucgccaucaccauggccaccaucuucaccgucaacuccacccuccccaucuacgccgccgucgacaagaacaacgccaccgccgcccgccgccgccgcaagcgcguccagaacgaguccaagcgcuacaccgucuccuaccucaagacccucaacuacuacgaccucgucgaccuccucgucaagaccgagaucgagaaccuccccgaccucuuccaguacuccuccgacgccaaggaguucuacggcaacaagacccgcauguccuucaucauggacgagaucggccgccgcgccccccaguacaccgagaucgaccacaagggcauccccacccucgucgaggucguccgcgccggcuucuaccucggcuuccacaacaaggagcucaacgagaucaacaagcgcuccuucaaggagcgcgucauccccuccauccucgccauccagaagaaccccaacuucaagcucggcaccgagguccaggacaagaucgucuccgccaccggccuccucgccggcaacgagaccgccccccccgaggucgucaacaacuucacccccauccuccaggacugcaucaagaacaucgaccgcuacgcccucgacgaccucaaguccaaggcccucuucaacguccucgccgcccccaccuacgacaucaccgaguaccuccgcgccaccaaggagaagcccgagaacacccccugguacggcaagaucgacggcuucaucaacgagcucaagaagcucgcccucuacggcaagaucaacgacaacaacuccuggaucaucgacaacggcaucuaccacaucgccccccucggcaagcuccacuccaacaacaagaucggcaucgagacccucaccgaggucaugaaggucuaccccuaccucuccaugcagcaccuccaguccgccgaccagaucaagcgccacuacgacuccaaggacgccgagggcaacaagaucccccucgacaaguucaagaaggagggcaaggagaaguacugccccaagaccuacaccuucgacgacggcaaggucaucaucaaggccggcgcccgcgucgaggaggagaaggucaagcgccucuacugggccuccaaggaggucaacucccaguucuuccgcgucuacggcaucgacaagccccucgaggagggcaaccccgacgacauccucaccauggucaucuacaacucccccgaggaguacaagcucaacuccguccucuacggcuacgacaccaacaacggcggcauguacaucgagcccgagggcaccuucuucaccuacgagcgcgaggcccaggaguccaccuacacccucgaggagcucuuccgccacgaguacacccacuaccuccagggccgcuacgccguccccggccaguggggccgcaccaagcucuacgacaacgaccgccucaccugguacgaggagggcggcgccgagcucuucgccggcuccacccgcaccuccggcauccucccccgcaaguccaucgucuccaacauccacaacaccacccgcaacaaccgcuacaagcucuccgacaccguccacuccaaguacggcgccuccuucgaguucuacaacuacgccugcauguucauggacuacauguacaacaaggacaugggcauccucaacaagcucaacgaccucgccaagaacaacgacgucgacggcuacgacaacuacauccgcgaccucuccuccaacuacgcccucaacgacaaguaccaggaccacaugcaggagcgcaucgacaacuacgagaaccucaccguccccuucgucgccgacgacuaccucguccgccacgccuacaagaaccccaacgagaucuacuccgagaucuccgaggucgccaagcucaaggacgccaaguccgaggucaagaagucccaguacuucuccaccuucacccuccgcggcuccuacaccggcggcgccuccaagggcaagcucgaggaccagaaggccaugaacaaguucaucgacgacucccucaagaagcucgacaccuacuccugguccggcuacaagacccucaccgccuacuucaccaacuacaaggucgacuccuccaaccgcgucaccuacgacgucgucuuccacggcuaccuccccaacgagggcgacuccaagaacucccuccccuacggcaagaucaacggcaccuacaagggcaccgagaaggagaagaucaaguucuccuccgagggcuccuucgaccccgacggcaagaucgucuccuacgagugggacuucggcgacggcaacaaguccaacgaggagaaccccgagcacuccuacgacaaggucggcaccuacaccgucaagcucaaggucaccgacgacaagggcgaguccuccgucuccaccaccaccgccgagaucaaggaccucuccgagaacaagcuccccgucaucuacaugcacguccccaaguccggcgcccucaaccagaaggucgucuucuacggcaagggcaccuacgaccccgacggcuccaucgccggcuaccagugggacuucggcgacggcuccgacuucuccuccgagcagaaccccucccacgucuacaccaagaagggcgaguacaccgucacccuccgcgucauggacuccuccggccagauguccgagaagaccaugaagaucaagaucaccgaccccgucuaccccaucggcaccgagaaggagcccaacaacuccaaggagaccgccuccggccccaucguccccggcauccccgucuccggcaccaucgagaacaccuccgaccaggacuacuucuacuucgacgucaucacccccggcgaggucaagaucgacaucaacaagcucggcuacggcggcgccaccugggucgucuacgacgagaacaacaacgccgucuccuacgccaccgacgacggccagaaccucuccggcaaguucaaggccgacaagcccggccgcuacuacauccaccucuacauguucaacggcuccuacaugcccuaccgcaucaacaucgagggcuccgucggccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1584 - RNA, 793 nt, Artificial Sequence
  mRNA product Design1 comprising derived and/or modified sequence from Homo sapiens__NP_001133.1__HsAMELX (opt2)
gggagaaagcuuaccaugggcaccuggauccucuucgccugccuccucggcgccgccuucgccaugccccuccccccccaccccggccaccccggcuacaucaacuucuccuacgagguccucaccccccucaagugguaccaguccauccgcccccccuaccccuccuacggcuacgagcccaugggcggcuggcuccaccaccagaucauccccguccucucccagcagcacccccccacccacacccuccagccccaccaccacauccccgucguccccgcccagcagcccgucaucccccagcagcccaugaugcccguccccggccagcacuccaugacccccauccagcaccaccagcccaaccuccccccccccgcccagcagcccuaccagccccagcccguccagccccagccccaccagcccaugcagccccagccccccguccaccccaugcagccccuccccccccagcccccccucccccccauguuccccaugcagccccucccccccaugcuccccgaccucacccucgaggccuggcccuccaccgacaagaccaagcgcgaggaggucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1585 - RNA, 352 nt, Artificial Sequence
  mRNA product Design1 comprising derived and/or modified sequence from Homo sapiens__NP_001133.1__HsAMELX-TRAP (opt2)
gggagaaagcuuaccaugccccuccccccccaccccggccaccccggcuacaucaacuucuccuacgagguccucaccccccucaagugguaccaguccauccgcccccccuaccccuccuacggcuacgagcccaugggcggcuggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1586 - RNA, 385 nt, Artificial Sequence
  mRNA product Design1 comprising derived and/or modified sequence from Homo sapiens__NP_001133.1__HsAMELX-LRAP (opt2)
gggagaaagcuuaccaugccccuccccccccaccccggccaccccggcuacaucaacuucuccuacgagguccucaccccccucaagugguaccaguccauccgccccccccccaugcuccccgaccucacccucgaggccuggcccuccaccgacaagaccaagcgcgaggaggucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1587 - RNA, 424 nt, Artificial Sequence
  mRNA product Design1 comprising derived and/or modified sequence from Homo sapiens__NP_001133.1__HLA-A2-SP_HsAMELX(17-60) (opt2)
gggagaaagcuuaccauggccgucauggccccccgcacccucguccuccuccucuccggcgcccucgcccucacccagaccugggccaugccccuccccccccaccccggccaccccggcuacaucaacuucuccuacgagguccucaccccccucaagugguaccaguccauccgcccccccuaccccuccuacggcuacgagcccaugggcggcuggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1588 - RNA, 457 nt, Artificial Sequence
  mRNA product Design1 comprising derived and/or modified sequence from Homo sapiens__NP_001133.1__HLA-A2-SP_HsAMELX(17-47,168-191) (opt2)
gggagaaagcuuaccauggccgucauggccccccgcacccucguccuccuccucuccggcgcccucgcccucacccagaccugggccaugccccuccccccccaccccggccaccccggcuacaucaacuucuccuacgagguccucaccccccucaagugguaccaguccauccgccccccccccaugcuccccgaccucacccucgaggccuggcccuccaccgacaagaccaagcgcgaggaggucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1589 - RNA, 796 nt, Artificial Sequence
  mRNA product Design1 comprising derived and/or modified sequence from Homo sapiens__NP_001134.1__HsAMELY (opt2)
gggagaaagcuuaccaugggcaccuggauccucuucgccugccucgucggcgccgccuucgccaugccccuccccccccaccccggccaccccggcuacaucaacuucuccuacgagguccucaccccccucaagugguaccaguccaugauccgcccccccuacuccuccuacggcuacgagcccaugggcggcuggcuccaccaccagaucauccccgucgucucccagcagcacccccucacccacacccuccagucccaccaccacauccccgucguccccgcccagcagccccgcguccgccagcaggcccucaugcccguccccggccagcaguccaugacccccacccagcaccaccagcccaaccucccccuccccgcccagcagcccuuccagccccagcccguccagccccagccccaccagcccaugcagccccagccccccguccagcccaugcagccccuccucccccagcccccccucccccccauguucccccuccgcccccucccccccauccuccccgaccuccaccucgaggccuggcccgccaccgacaagaccaagcaggaggaggucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1590 - RNA, 355 nt, Artificial Sequence
  mRNA product Design1 comprising derived and/or modified sequence from Homo sapiens__NP_001134.1__HsAMELY-TRAP (opt2)
gggagaaagcuuaccaugccccuccccccccaccccggccaccccggcuacaucaacuucuccuacgagguccucaccccccucaagugguaccaguccaugauccgcccccccuacuccuccuacggcuacgagcccaugggcggcuggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1591 - RNA, 388 nt, Artificial Sequence
  mRNA product Design1 comprising derived and/or modified sequence from Homo sapiens__NP_001134.1__HsAMELY-LRAP (opt2)
gggagaaagcuuaccaugccccuccccccccaccccggccaccccggcuacaucaacuucuccuacgagguccucaccccccucaagugguaccaguccaugauccgccccccccccauccuccccgaccuccaccucgaggccuggcccgccaccgacaagaccaagcaggaggaggucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1592 - RNA, 427 nt, Artificial Sequence
  mRNA product Design1 comprising derived and/or modified sequence from Homo sapiens__NP_001134.1__HLA-A2-SP_HsAMELY(17-61) (opt2)
gggagaaagcuuaccauggccgucauggccccccgcacccucguccuccuccucuccggcgcccucgcccucacccagaccugggccaugccccuccccccccaccccggccaccccggcuacaucaacuucuccuacgagguccucaccccccucaagugguaccaguccaugauccgcccccccuacuccuccuacggcuacgagcccaugggcggcuggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1593 - RNA, 460 nt, Artificial Sequence
  mRNA product Design1 comprising derived and/or modified sequence from Homo sapiens__NP_001134.1__HLA-A2-SP_HsAMELY(17-48,169-192) (opt2)
gggagaaagcuuaccauggccgucauggccccccgcacccucguccuccuccucuccggcgcccucgcccucacccagaccugggccaugccccuccccccccaccccggccaccccggcuacaucaacuucuccuacgagguccucaccccccucaagugguaccaguccaugauccgccccccccccauccuccccgaccuccaccucgaggccuggcccgccaccgacaagaccaagcaggaggaggucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1594 - RNA, 787 nt, Artificial Sequence
  mRNA product Design1 comprising derived and/or modified sequence from Sus scrofa__NP_999071.1__SsAMELX-001-1 (opt2)
gggagaaagcuuaccaugggcaccuggauccucuucgccugccuccucggcgccgccuucuccaugccccuccccccccaccccggccaccccggcuacaucaacuucuccuacgagguccucaccccccucaagugguaccagaacaugauccgccaccccuacaccuccuacggcuacgagcccaugggcggcuggcuccaccaccagaucauccccgucgucucccagcagaccccccagucccacgcccuccagccccaccaccacauccccaugguccccgcccagcagcccggcaucccccagcagcccaugaugccccuccccggccagcacuccaugacccccacccagcaccaccagcccaaccucccccuccccgcccagcagcccuuccagccccagcccguccagccccagccccaccagccccuccagccccagucccccaugcaccccauccagccccuccucccccagcccccccucccccccauguucuccaugcagucccuccuccccgaccucccccucgaggccuggcccgccaccgacaagaccaagcgcgaggaggucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1595 - RNA, 355 nt, Artificial Sequence
  mRNA product Design1 comprising derived and/or modified sequence from Sus scrofa__NP_999071.1__SsAMELX-TRAP (opt2)
gggagaaagcuuaccaugccccuccccccccaccccggccaccccggcuacaucaacuucuccuacgagguccucaccccccucaagugguaccagaacaugauccgccaccccuacaccuccuacggcuacgagcccaugggcggcuggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1596 - RNA, 388 nt, Artificial Sequence
  mRNA product Design1 comprising derived and/or modified sequence from Sus scrofa__NP_999071.1__SsAMELX-LRAP (opt2)
gggagaaagcuuaccaugccccuccccccccaccccggccaccccggcuacaucaacuucuccuacgagguccucaccccccucaagugguaccagaacaugauccgccaccccucccuccuccccgaccucccccucgaggccuggcccgccaccgacaagaccaagcgcgaggaggucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1597 - RNA, 427 nt, Artificial Sequence
  mRNA product Design1 comprising derived and/or modified sequence from Sus scrofa__NP_999071.1__HLA-A2-SP_SsAMEL(17-61) (opt2)
gggagaaagcuuaccauggccgucauggccccccgcacccucguccuccuccucuccggcgcccucgcccucacccagaccugggccaugccccuccccccccaccccggccaccccggcuacaucaacuucuccuacgagguccucaccccccucaagugguaccagaacaugauccgccaccccuacaccuccuacggcuacgagcccaugggcggcuggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1598 - RNA, 460 nt, Artificial Sequence
  mRNA product Design1 comprising derived and/or modified sequence from Sus scrofa__NP_999071.1__HLA-A2-SP_SsAMEL(17-49,167-189) (opt2)
gggagaaagcuuaccauggccgucauggccccccgcacccucguccuccuccucuccggcgcccucgcccucacccagaccugggccaugccccuccccccccaccccggccaccccggcuacaucaacuucuccuacgagguccucaccccccucaagugguaccagaacaugauccgccaccccucccuccuccccgaccucccccucgaggccuggcccgccaccgacaagaccaagcgcgaggaggucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1599 - RNA, 751 nt, Artificial Sequence
  mRNA product Design1 comprising derived and/or modified sequence from Sus scrofa__P45561-2__SsAMELX-001-2 (opt2)
gggagaaagcuuaccaugggcaccuggauccucuucgccugccuccucggcgccgccuucuccaugccccuccccccccaccccggccaccccggcuacaucaacuucuccuacauccgccaccccuacaccuccuacggcuacgagcccaugggcggcuggcuccaccaccagaucauccccgucgucucccagcagaccccccagucccacgcccuccagccccaccaccacauccccaugguccccgcccagcagcccggcaucccccagcagcccaugaugccccuccccggccagcacuccaugacccccacccagcaccaccagcccaaccucccccuccccgcccagcagcccuuccagccccagcccguccagccccagccccaccagccccuccagccccagucccccaugcaccccauccagccccuccucccccagcccccccucccccccauguucuccaugcagucccuccuccccgaccucccccucgaggccuggcccgccaccgacaagaccaagcgcgaggaggucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1600 - RNA, 787 nt, Artificial Sequence
  mRNA product Design1 comprising derived and/or modified sequence from Sus scrofa__NP_998965.1__SsAMELX-001-3 (opt2)
gggagaaagcuuaccaugggcaccuggaucuucuucgccugccuccucggcgccucccucgccaugccccuccccccccaccccggccaccccggcuacaucaacuucuccuacgagguccucaccccccucaagugguaccagaacaugauccgccaccccuacaccuccuacggcuacgagcccaugggcggcuggcuccaccaccagaucauccccgucgucucccagcagaccccccagucccacgcccuccagccccaccaccacauccccaugguccccgcccagcagcccggcaucccccagcagcccaugaugccccuccccggccagcacuccaugacccccacccagcaccaccagcccaaccucccccuccccgcccagcagcccuuccagccccagcccguccagccccagccccaccagccccuccagccccagucccccaugcaccccauccagccccuccucccccagcccccccucccccccauguucuccaugcagucccuccuccccgaccucccccucgaggccuggcccgccaccgacaagaccaagcgcgaggaggucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1601 - RNA, 436 nt, Artificial Sequence
  mRNA product Design1 comprising derived and/or modified sequence from Sus scrofa__K7GPB2__SsAMELX-002 (opt2)
gggagaaagcuuaccaugggcaccuggauccucuucgccugccuccucggcgccgccuucuccaugccccuccccccccaccccggccaccccggcuacaucaacuucuccuacgagguccucaccccccucaagugguaccagaacaugauccgccaccccucccuccuccccgaccucccccucgaggccuggcccgccaccgacaagaccaagcgcgaggaggucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1602 - RNA, 829 nt, Artificial Sequence
  mRNA product Design1 comprising derived and/or modified sequence from Sus scrofa__K7GLD0__SsAMELX-003 (opt2)
gggagaaagcuuaccaugggcaccuggauccucuucgccugccuccucggcgccgccuucuccaugccccuccccccccaccccggccaccccggcuacaucaacuucuccuacgaggaccucuaccucgaggccauccgcaucgaccgcaccgccuucguccucaccccccucaagugguaccagaacaugauccgccaccccuacaccuccuacggcuacgagcccaugggcggcuggcuccaccaccagaucauccccgucgucucccagcagaccccccagucccacgcccuccagccccaccaccacauccccaugguccccgcccagcagcccggcaucccccagcagcccaugaugccccuccccggccagcacuccaugacccccacccagcaccaccagcccaaccucccccuccccgcccagcagcccuuccagccccagcccguccagccccagccccaccagccccuccagccccagucccccaugcaccccauccagccccuccucccccagcccccccucccccccauguucuccaugcagucccuccuccccgaccucccccucgaggccuggcccgccaccgacaagaccaagcgcgaggaggucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1603 - RNA, 715 nt, Artificial Sequence
  mRNA product Design1 comprising derived and/or modified sequence from Sus scrofa__K7GPE9__SsAMELX-004 (opt2)
gggagaaagcuuaccaugggcaccuggauccucuucgccugccuccucggcgccgccuucuccaugccccuccccccccaccccggccaccccggcuacaucaacuucuccuacgagguccucaccccccucaagugguaccagaacaugauccgccaccccaccccccagucccacgcccuccagccccaccaccacauccccaugguccccgcccagcagcccggcaucccccagcagcccaugaugccccuccccggccagcacuccaugacccccacccagcaccaccagcccaaccucccccuccccgcccagcagcccuuccagccccagcccguccagccccagccccaccagccccuccagccccagucccccaugcaccccauccagccccuccucccccagcccccccucccccccauguucuccaugcagucccuccuccccgaccucccccucgaggccuggcccgccaccgacaagaccaagcgcgaggaggucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1604 - RNA, 739 nt, Artificial Sequence
  mRNA product Design1 comprising derived and/or modified sequence from Sus scrofa__J9JIM4__SsAMELX-201 (opt2)
gggagaaagcuuaccaugccccuccccccccaccccggccaccccggcuacaucaacuucuccuacgagguccucaccccccucaagugguaccagaacaugauccgccaccccuacaccuccuacggcuacgagcccaugggcggcuggcuccaccaccagaucauccccgucgucucccagcagaccccccagucccacgcccuccagccccaccaccacauccccaugguccccgcccagcagcccggcaucccccagcagcccaugaugccccuccccggccagcacuccaugacccccacccagcaccaccagcccaaccucccccuccccgcccagcagcccuuccagccccagcccguccagccccagccccaccagccccuccagccccagucccccaugcaccccauccagccccuccucccccagcccccccucccccccauguucuccaugcagucccuccuccccgaccucccccucgaggccuggcccgccaccgacaagaccaagcgcgaggaggucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1605 - RNA, 3178 nt, Artificial Sequence
  mRNA product Design1 comprising derived and/or modified sequence from Homo sapiens__NP_006120.1__HsBMP1 (opt2)
gggagaaagcuuaccaugcccggcgucgcccgccucccccuccuccucggccuccuccuccucccccgccccggccgcccccucgaccucgccgacuacaccuacgaccucgccgaggaggacgacuccgagccccucaacuacaaggaccccugcaaggccgccgccuuccucggcgacaucgcccucgacgaggaggaccuccgcgccuuccagguccagcaggccgucgaccuccgccgccacaccgcccgcaaguccuccaucaaggccgccguccccggcaacaccuccacccccuccugccaguccaccaacggccagccccagcgcggcgccugcggccgcuggcgcggccgcucccgcucccgccgcgccgccaccucccgccccgagcgcgucuggcccgacggcgucauccccuucgucaucggcggcaacuucaccggcucccagcgcgccgucuuccgccaggccaugcgccacugggagaagcacaccugcgucaccuuccucgagcgcaccgacgaggacuccuacaucgucuucaccuaccgccccugcggcugcugcuccuacgucggccgccgcggcggcggcccccaggccaucuccaucggcaagaacugcgacaaguucggcaucgucguccacgagcucggccacgucgucggcuucuggcacgagcacacccgccccgaccgcgaccgccacgucuccaucguccgcgagaacauccagcccggccaggaguacaacuuccucaagauggagccccaggaggucgagucccucggcgagaccuacgacuucgacuccaucaugcacuacgcccgcaacaccuucucccgcggcaucuuccucgacaccaucguccccaaguacgaggucaacggcgucaagccccccaucggccagcgcacccgccucuccaagggcgacaucgcccaggcccgcaagcucuacaagugccccgccugcggcgagacccuccaggacuccaccggcaacuucuccucccccgaguaccccaacggcuacuccgcccacaugcacugcgucuggcgcaucuccgucacccccggcgagaagaucauccucaacuucaccucccucgaccucuaccgcucccgccucugcugguacgacuacgucgagguccgcgacggcuucuggcgcaaggccccccuccgcggccgcuucugcggcuccaagcuccccgagcccaucgucuccaccgacucccgccucugggucgaguuccgcuccuccuccaacugggucggcaagggcuucuucgccgucuacgaggccaucugcggcggcgacgucaagaaggacuacggccacauccagucccccaacuaccccgacgacuaccgccccuccaaggucugcaucuggcgcauccaggucuccgagggcuuccacgucggccucaccuuccaguccuucgagaucgagcgccacgacuccugcgccuacgacuaccucgagguccgcgacggccacuccgaguccuccacccucaucggccgcuacugcggcuacgagaagcccgacgacaucaaguccaccuccucccgccucuggcucaaguucgucuccgacggcuccaucaacaaggccggcuucgccgucaacuucuucaaggaggucgacgagugcucccgccccaaccgcggcggcugcgagcagcgcugccucaacacccucggcuccuacaagugcuccugcgaccccggcuacgagcucgcccccgacaagcgccgcugcgaggccgccugcggcggcuuccucaccaagcucaacggcuccaucaccucccccggcuggcccaaggaguacccccccaacaagaacugcaucuggcagcucgucgcccccacccaguaccgcaucucccuccaguucgacuucuucgagaccgagggcaacgacgucugcaaguacgacuucgucgagguccgcuccggccucaccgccgacuccaagcuccacggcaaguucugcggcuccgagaagcccgaggucaucaccucccaguacaacaacaugcgcgucgaguucaaguccgacaacaccgucuccaagaagggcuucaaggcccacuucuucuccgacaaggacgagugcuccaaggacaacggcggcugccagcaggacugcgucaacaccuucggcuccuacgagugccagugccgcuccggcuucguccuccacgacaacaagcacgacugcaaggaggccggcugcgaccacaaggucaccuccaccuccggcaccaucaccucccccaacuggcccgacaaguaccccuccaagaaggagugcaccugggccaucuccuccacccccggccaccgcgucaagcucaccuucauggagauggacaucgagucccagcccgagugcgccuacgaccaccucgaggucuucgacggccgcgacgccaaggcccccguccucggccgcuucugcggcuccaagaagcccgagcccguccucgccaccggcucccgcauguuccuccgcuucuacuccgacaacuccguccagcgcaagggcuuccaggccucccacgccaccgagugcggcggccagguccgcgccgacgucaagaccaaggaccucuacucccacgcccaguucggcgacaacaacuaccccggcggcgucgacugcgagugggucaucgucgccgaggagggcuacggcgucgagcucgucuuccagaccuucgaggucgaggaggagaccgacugcggcuacgacuacauggagcucuucgacggcuacgacuccaccgccccccgccucggccgcuacugcggcuccggcccccccgaggaggucuacuccgccggcgacuccguccucgucaaguuccacuccgacgacaccaucaccaagaagggcuuccaccuccgcuacaccuccaccaaguuccaggacacccuccacucccgcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1606 - RNA, 1408 nt, Artificial Sequence
  mRNA product Design1 comprising derived and/or modified sequence from Homo sapiens__NP_001191.1__HsBMP2 (opt2)
gggagaaagcuuaccauggucgccggcacccgcugccuccucgcccuccuccucccccagguccuccucggcggcgccgccggccucguccccgagcucggccgccgcaaguucgccgccgccuccuccggccgccccuccucccagcccuccgacgagguccucuccgaguucgagcuccgccuccucuccauguucggccucaagcagcgccccacccccucccgcgacgccgucgucccccccuacaugcucgaccucuaccgccgccacuccggccagcccggcucccccgcccccgaccaccgccucgagcgcgccgccucccgcgccaacaccguccgcuccuuccaccacgaggagucccucgaggagcuccccgagaccuccggcaagaccacccgccgcuucuucuucaaccucuccuccauccccaccgaggaguucaucaccuccgccgagcuccaggucuuccgcgagcagaugcaggacgcccucggcaacaacuccuccuuccaccaccgcaucaacaucuacgagaucaucaagcccgccaccgccaacuccaaguuccccgucacccgccuccucgacacccgccucgucaaccagaacgccucccgcugggaguccuucgacgucacccccgccgucaugcgcuggaccgcccagggccacgccaaccacggcuucgucgucgaggucgcccaccucgaggagaagcagggcgucuccaagcgccacguccgcaucucccgcucccuccaccaggacgagcacuccuggucccagauccgcccccuccucgucaccuucggccacgacggcaagggccacccccuccacaagcgcgagaagcgccaggccaagcacaagcagcgcaagcgccucaaguccuccugcaagcgccacccccucuacgucgacuucuccgacgucggcuggaacgacuggaucgucgccccccccggcuaccacgccuucuacugccacggcgagugccccuucccccucgccgaccaccucaacuccaccaaccacgccaucguccagacccucgucaacuccgucaacuccaagauccccaaggccugcugcguccccaccgagcucuccgccaucuccaugcucuaccucgacgagaacgagaaggucguccucaagaacuaccaggacauggucgucgagggcugcggcugccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1607 - RNA, 1444 nt, Artificial Sequence
  mRNA product Design1 comprising derived and/or modified sequence from Homo sapiens__NP_001193.2__HsBMP4 (opt2)
gggagaaagcuuaccaugauccccggcaaccgcaugcucauggucguccuccucugccagguccuccucggcggcgccucccacgccucccucauccccgagaccggcaagaagaaggucgccgagauccagggccacgccggcggccgccgcuccggccagucccacgagcuccuccgcgacuucgaggccacccuccuccagauguucggccuccgccgccgcccccagcccuccaaguccgccgucauccccgacuacaugcgcgaccucuaccgccuccaguccggcgaggaggaggaggagcagauccacuccaccggccucgaguaccccgagcgccccgccucccgcgccaacaccguccgcuccuuccaccacgaggagcaccucgagaacauccccggcaccuccgagaacuccgccuuccgcuuccucuucaaccucuccuccauccccgagaacgaggucaucuccuccgccgagcuccgccucuuccgcgagcaggucgaccagggccccgacugggagcgcggcuuccaccgcaucaacaucuacgaggucaugaagccccccgccgaggucguccccggccaccucaucacccgccuccucgacacccgccucguccaccacaacgucacccgcugggagaccuucgacgucucccccgccguccuccgcuggacccgcgagaagcagcccaacuacggccucgccaucgaggucacccaccuccaccagacccgcacccaccagggccagcacguccgcaucucccgcucccucccccagggcuccggcaacugggcccagcuccgcccccuccucgucaccuucggccacgacggccgcggccacgcccucacccgccgccgccgcgccaagcgcucccccaagcaccacucccagcgcgcccgcaagaagaacaagaacugccgccgccacucccucuacgucgacuucuccgacgucggcuggaacgacuggaucgucgccccccccggcuaccaggccuucuacugccacggcgacugccccuucccccucgccgaccaccucaacuccaccaaccacgccaucguccagacccucgucaacuccgucaacuccuccauccccaaggccugcugcguccccaccgagcucuccgccaucuccaugcucuaccucgacgaguacgacaaggucguccucaagaacuaccaggagauggucgucgagggcugcggcugccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1608 - RNA, 1759 nt, Artificial Sequence
  mRNA product Design1 comprising derived and/or modified sequence from Homo sapiens__NP_001709.1__HsBMP6 (opt2)
gggagaaagcuuaccaugcccggccucggccgccgcgcccaguggcucugcuggugguggggccuccucugcuccugcugcggcccccccccccuccgccccccccuccccgccgccgccgccgccgccgccggcggccagcuccucggcgacggcggcucccccggccgcaccgagcagcccccccccuccccccaguccuccuccggcuuccucuaccgccgccucaagacccaggagaagcgcgagaugcagaaggagauccucuccguccucggccucccccaccgcccccgcccccuccacggccuccagcagccccagccccccgcccuccgccagcaggaggagcagcagcagcagcagcagcucccccgcggcgagcccccccccggccgccucaaguccgccccccucuucaugcucgaccucuacaacgcccucuccgccgacaacgacgaggacggcgccuccgagggcgagcgccagcaguccuggccccacgaggccgccuccuccucccagcgccgccagcccccccccggcgccgcccacccccucaaccgcaagucccuccucgcccccggcuccggcuccggcggcgccuccccccucaccuccgcccaggacuccgccuuccucaacgacgccgacauggucauguccuucgucaaccucgucgaguacgacaaggaguucuccccccgccagcgccaccacaaggaguucaaguucaaccucucccagauccccgagggcgaggucgucaccgccgccgaguuccgcaucuacaaggacugcgucaugggcuccuucaagaaccagaccuuccucaucuccaucuaccagguccuccaggagcaccagcaccgcgacuccgaccucuuccuccucgacacccgcgucgucugggccuccgaggagggcuggcucgaguucgacaucaccgccaccuccaaccucugggucgucaccccccagcacaacaugggccuccagcucuccgucgucacccgcgacggcguccacguccacccccgcgccgccggccucgucggccgcgacggccccuacgacaagcagcccuucauggucgccuucuucaaggucuccgagguccacguccgcaccacccgcuccgccuccucccgccgccgccagcagucccgcaaccgcuccacccagucccaggacgucgcccgcgucuccuccgccuccgacuacaacuccuccgagcucaagaccgccugccgcaagcacgagcucuacgucuccuuccaggaccucggcuggcaggacuggaucaucgcccccaagggcuacgccgccaacuacugcgacggcgagugcuccuucccccucaacgcccacaugaacgccaccaaccacgccaucguccagacccucguccaccucaugaaccccgaguacguccccaagcccugcugcgcccccaccaagcucaacgccaucuccguccucuacuucgacgacaacuccaacgucauccucaagaaguaccgcaacauggucguccgcgccugcggcugccacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1609 - RNA, 1513 nt, Artificial Sequence
  mRNA product Design1 comprising derived and/or modified sequence from Homo sapiens__NP_001710.1__HsBMP7 (opt2)
gggagaaagcuuaccaugcacguccgcucccuccgcgccgccgccccccacuccuucgucgcccucugggccccccucuuccuccuccgcuccgcccucgccgacuucucccucgacaacgagguccacuccuccuucauccaccgccgccuccgcucccaggagcgccgcgagaugcagcgcgagauccucuccauccucggccucccccaccgcccccgcccccaccuccagggcaagcacaacuccgcccccauguucaugcucgaccucuacaacgccauggccgucgaggagggcggcggccccggcggccagggcuucuccuaccccuacaaggccgucuucuccacccagggccccccccucgccucccuccaggacucccacuuccucaccgacgccgacauggucauguccuucgucaaccucgucgagcacgacaaggaguucuuccacccccgcuaccaccaccgcgaguuccgcuucgaccucuccaagauccccgagggcgaggccgucaccgccgccgaguuccgcaucuacaaggacuacauccgcgagcgcuucgacaacgagaccuuccgcaucuccgucuaccagguccuccaggagcaccucggccgcgaguccgaccucuuccuccucgacucccgcacccucugggccuccgaggagggcuggcucgucuucgacaucaccgccaccuccaaccacugggucgucaacccccgccacaaccucggccuccagcucuccgucgagacccucgacggccaguccaucaaccccaagcucgccggccucaucggccgccacggcccccagaacaagcagcccuucauggucgccuucuucaaggccaccgagguccacuuccgcuccauccgcuccaccggcuccaagcagcgcucccagaaccgcuccaagacccccaagaaccaggaggcccuccgcauggccaacgucgccgagaacuccuccuccgaccagcgccaggccugcaagaagcacgagcucuacgucuccuuccgcgaccucggcuggcaggacuggaucaucgcccccgagggcuacgccgccuacuacugcgagggcgagugcgccuucccccucaacuccuacaugaacgccaccaaccacgccaucguccagacccucguccacuucaucaaccccgagaccguccccaagcccugcugcgcccccacccagcucaacgccaucuccguccucuacuucgacgacuccuccaacgucauccucaagaaguaccgcaacauggucguccgcgccugcggcugccacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1610 - RNA, 517 nt, Artificial Sequence
  mRNA product Design1 comprising derived and/or modified sequence from Homo sapiens__NP_006264.2__HsCCL7 (opt2)
gggagaaagcuuaccaugaaggccuccgccgcccuccucugccuccuccucaccgccgccgccuucuccccccagggccucgcccagcccgucggcaucaacaccuccaccaccugcugcuaccgcuucaucaacaagaagauccccaagcagcgccucgaguccuaccgccgcaccaccuccucccacugcccccgcgaggccgucaucuucaagaccaagcucgacaaggagaucugcgccgaccccacccagaaguggguccaggacuucaugaagcaccucgacaagaagacccagacccccaagcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1611 - RNA, 3841 nt, Artificial Sequence
  mRNA product Design1 comprising derived and/or modified sequence from Homo sapiens__NP_001954.2__HsEGF (opt2)
gggagaaagcuuaccaugcuccucacccucaucauccuccuccccgucgucuccaaguucuccuucgucucccucuccgccccccagcacugguccugccccgagggcacccucgccggcaacggcaacuccaccugcgucggccccgcccccuuccucaucuucucccacggcaacuccaucuuccgcaucgacaccgagggcaccaacuacgagcagcucgucgucgacgccggcgucuccgucaucauggacuuccacuacaacgagaagcgcaucuacugggucgaccucgagcgccagcuccuccagcgcgucuuccucaacggcucccgccaggagcgcgucugcaacaucgagaagaacgucuccggcauggccaucaacuggaucaacgaggaggucaucugguccaaccagcaggagggcaucaucaccgucaccgacaugaagggcaacaacucccacauccuccucuccgcccucaaguaccccgccaacgucgccgucgaccccgucgagcgcuucaucuucugguccuccgaggucgccggcucccucuaccgcgccgaccucgacggcgucggcgucaaggcccuccucgagaccuccgagaagaucaccgccgucucccucgacguccucgacaagcgccucuucuggauccaguacaaccgcgagggcuccaacucccucaucugcuccugcgacuacgacggcggcuccguccacaucuccaagcaccccacccagcacaaccucuucgccaugucccucuucggcgaccgcaucuucuacuccaccuggaagaugaagaccaucuggaucgccaacaagcacaccggcaaggacaugguccgcaucaaccuccacuccuccuucgucccccucggcgagcucaaggucguccacccccucgcccagcccaaggccgaggacgacaccugggagcccgagcagaagcucugcaagcuccgcaagggcaacugcuccuccaccgucugcggccaggaccuccagucccaccucugcaugugcgccgagggcuacgcccucucccgcgaccgcaaguacugcgaggacgucaacgagugcgccuucuggaaccacggcugcacccucggcugcaagaacacccccggcuccuacuacugcaccugccccgucggcuucguccuccuccccgacggcaagcgcugccaccagcucgucuccugcccccgcaacgucuccgagugcucccacgacugcguccucaccuccgagggcccccucugcuucugccccgagggcuccguccucgagcgcgacggcaagaccugcuccggcugcuccucccccgacaacggcggcugcucccagcucugcgucccccucucccccgucuccugggagugcgacugcuuccccggcuacgaccuccagcucgacgagaaguccugcgccgccuccggcccccagcccuuccuccucuucgccaacucccaggacauccgccacaugcacuucgacggcaccgacuacggcacccuccucucccagcagaugggcauggucuacgcccucgaccacgaccccgucgagaacaagaucuacuucgcccacaccgcccucaaguggaucgagcgcgccaacauggacggcucccagcgcgagcgccucaucgaggagggcgucgacguccccgagggccucgccgucgacuggaucggccgccgcuucuacuggaccgaccgcggcaagucccucaucggccgcuccgaccucaacggcaagcgcuccaagaucaucaccaaggagaacaucucccagccccgcggcaucgccguccaccccauggccaagcgccucuucuggaccgacaccggcaucaacccccgcaucgaguccuccucccuccagggccucggccgccucgucaucgccuccuccgaccucaucuggcccuccggcaucaccaucgacuuccucaccgacaagcucuacuggugcgacgccaagcaguccgucaucgagauggccaaccucgacggcuccaagcgccgccgccucacccagaacgacgucggccaccccuucgccgucgccgucuucgaggacuacgucugguucuccgacugggccaugcccuccgucaugcgcgucaacaagcgcaccggcaaggaccgcguccgccuccagggcuccaugcucaagcccuccucccucgucgucguccacccccucgccaagcccggcgccgaccccugccucuaccagaacggcggcugcgagcacaucugcaagaagcgccucggcaccgccuggugcuccugccgcgagggcuucaugaaggccuccgacggcaagaccugccucgcccucgacggccaccagcuccucgccggcggcgaggucgaccucaagaaccaggucaccccccucgacauccucuccaagacccgcgucuccgaggacaacaucaccgagucccagcacaugcucgucgccgagaucauggucuccgaccaggacgacugcgcccccgucggcugcuccauguacgcccgcugcaucuccgagggcgaggacgccaccugccagugccucaagggcuucgccggcgacggcaagcucugcuccgacaucgacgagugcgagaugggcguccccgucugcccccccgccuccuccaagugcaucaacaccgagggcggcuacgucugccgcugcuccgagggcuaccagggcgacggcauccacugccucgacaucgacgagugccagcucggcgagcacuccugcggcgagaacgccuccugcaccaacaccgagggcggcuacaccugcaugugcgccggccgccucuccgagcccggccucaucugccccgacuccaccccccccccccaccuccgcgaggacgaccaccacuacuccguccgcaacuccgacuccgagugcccccucucccacgacggcuacugccuccacgacggcgucugcauguacaucgaggcccucgacaaguacgccugcaacugcgucgucggcuacaucggcgagcgcugccaguaccgcgaccucaaguggugggagcuccgccacgccggccacggccagcagcagaaggucaucgucgucgccgucugcgucgucguccucgucaugcuccuccuccucucccucuggggcgcccacuacuaccgcacccagaagcuccucuccaagaaccccaagaaccccuacgaggaguccucccgcgacguccgcucccgccgccccgccgacaccgaggacggcauguccuccugcccccagcccugguucgucgucaucaaggagcaccaggaccucaagaacggcggccagcccgucgccggcgaggacggccaggccgccgacggcuccaugcagcccaccuccuggcgccaggagccccagcucugcggcaugggcaccgagcagggcugcuggauccccgucuccuccgacaagggcuccugcccccaggucauggagcgcuccuuccacaugcccuccuacggcacccagacccucgagggcggcgucgagaagccccacucccuccucuccgccaacccccucuggcagcagcgcgcccucgaccccccccaccagauggagcucacccagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1612 - RNA, 727 nt, Artificial Sequence
  mRNA product Design1 comprising derived and/or modified sequence from Homo sapiens__NP_001423.1__HsEREG (opt2)
gggagaaagcuuaccaugaccgccggccgccgcauggagaugcucugcgccggccgcguccccgcccuccuccucugccucggcuuccaccuccuccaggccguccucuccaccaccgucauccccuccugcauccccggcgaguccuccgacaacugcaccgcccucguccagaccgaggacaacccccgcgucgcccaggucuccaucaccaagugcuccuccgacaugaacggcuacugccuccacggccagugcaucuaccucgucgacaugucccagaacuacugccgcugcgaggucggcuacaccggcguccgcugcgagcacuucuuccucaccguccaccagccccucuccaaggaguacgucgcccucaccgucauccucaucauccucuuccucaucaccgucgucggcuccaccuacuacuucugccgcugguaccgcaaccgcaaguccaaggagcccaagaaggaguacgagcgcgucaccuccggcgaccccgagcucccccaggucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1613 - RNA, 685 nt, Artificial Sequence
  mRNA product Design1 comprising derived and/or modified sequence from Homo sapiens__NP_000791.1__HsFGF1 (opt2)
gggagaaagcuuaccauggccgagggcgagaucaccaccuucaccgcccucaccgagaaguucaaccucccccccggcaacuacaagaagcccaagcuccucuacugcuccaacggcggccacuuccuccgcauccuccccgacggcaccgucgacggcacccgcgaccgcuccgaccagcacauccagcuccagcucuccgccgaguccgucggcgaggucuacaucaaguccaccgagaccggccaguaccucgccauggacaccgacggccuccucuacggcucccagacccccaacgaggagugccucuuccucgagcgccucgaggagaaccacuacaacaccuacaucuccaagaagcacgccgagaagaacugguucgucggccucaagaagaacggcuccugcaagcgcggcccccgcacccacuacggccagaaggccauccucuuccucccccuccccgucuccuccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1614 - RNA, 1084 nt, Artificial Sequence
  mRNA product Design1 comprising derived and/or modified sequence from Homo sapiens__NP_001997.5__HsFGF2 (opt2)
gggagaaagcuuaccauggucggcgucggcggcggcgacgucgaggacgucaccccccgccccggcggcugccagaucuccggccgcggcgcccgcggcugcaacggcauccccggcgccgccgccugggaggccgcccucccccgccgccgcccccgccgccaccccuccgucaacccccgcucccgcgccgccggcuccccccgcacccgcggccgccgcaccgaggagcgccccuccggcucccgccucggcgaccgcggccgcggccgcgcccuccccggcggccgccucggcggccgcggccgcggccgcgcccccgagcgcgucggcggccgcggccgcggccgcggcaccgccgccccccgcgccgcccccgccgcccgcggcucccgccccggccccgccggcaccauggccgccggcuccaucaccacccuccccgcccuccccgaggacggcggcuccggcgccuucccccccggccacuucaaggaccccaagcgccucuacugcaagaacggcggcuucuuccuccgcauccaccccgacggccgcgucgacggcguccgcgagaaguccgacccccacaucaagcuccagcuccaggccgaggagcgcggcgucgucuccaucaagggcgucugcgccaaccgcuaccucgccaugaaggaggacggccgccuccucgccuccaagugcgucaccgacgagugcuucuucuucgagcgccucgaguccaacaacuacaacaccuaccgcucccgcaaguacaccuccugguacgucgcccucaagcgcaccggccaguacaagcucggcuccaagaccggccccggccagaaggccauccucuuccuccccauguccgccaaguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1615 - RNA, 802 nt, Artificial Sequence
  mRNA product Design1 comprising derived and/or modified sequence from Homo sapiens__NP_002000.1__HsFGF7 (opt2)
gggagaaagcuuaccaugcacaaguggauccucaccuggauccuccccacccuccucuaccgcuccugcuuccacaucaucugccucgucggcaccaucucccucgccugcaacgacaugacccccgagcagauggccaccaacgucaacugcuccucccccgagcgccacacccgcuccuacgacuacauggagggcggcgacauccgcguccgccgccucuucugccgcacccagugguaccuccgcaucgacaagcgcggcaaggucaagggcacccaggagaugaagaacaacuacaacaucauggagauccgcaccgucgccgucggcaucgucgccaucaagggcgucgaguccgaguucuaccucgccaugaacaaggagggcaagcucuacgccaagaaggagugcaacgaggacugcaacuucaaggagcucauccucgagaaccacuacaacaccuacgccuccgccaaguggacccacaacggcggcgagauguucgucgcccucaaccagaagggcauccccguccgcggcaagaagaccaagaaggagcagaagaccgcccacuuccuccccauggccaucaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1616 - RNA, 844 nt, Artificial Sequence
  mRNA product Design1 comprising derived and/or modified sequence from Homo sapiens__NP_001936.1__HsHBEGF (opt2)
gggagaaagcuuaccaugaagcuccuccccuccgucguccucaagcucuuccucgccgccguccucuccgcccucgucaccggcgagucccucgagcgccuccgccgcggccucgccgccggcaccuccaaccccgacccccccaccgucuccaccgaccagcuccucccccucggcggcggccgcgaccgcaagguccgcgaccuccaggaggccgaccucgaccuccuccgcgucacccucuccuccaagccccaggcccucgccacccccaacaaggaggagcacggcaagcgcaagaagaagggcaagggccucggcaagaagcgcgaccccugccuccgcaaguacaaggacuucugcauccacggcgagugcaaguacgucaaggagcuccgcgcccccuccugcaucugccaccccggcuaccacggcgagcgcugccacggccucucccuccccgucgagaaccgccucuacaccuacgaccacaccaccauccucgccgucgucgccgucguccucuccuccgucugccuccucgucaucgucggccuccucauguuccgcuaccaccgccgcggcggcuacgacgucgagaacgaggagaaggucaagcucggcaugaccaacucccacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1617 - RNA, 2404 nt, Artificial Sequence
  mRNA product Design1 comprising derived and/or modified sequence from Homo sapiens__NP_000592.3__HsHGF (opt2)
gggagaaagcuuaccaugugggucaccaagcuccuccccgcccuccuccuccagcacguccuccuccaccuccuccuccuccccaucgccauccccuacgccgagggccagcgcaagcgccgcaacaccauccacgaguucaagaaguccgccaagaccacccucaucaagaucgaccccgcccucaagaucaagaccaagaaggucaacaccgccgaccagugcgccaaccgcugcacccgcaacaagggccuccccuucaccugcaaggccuucgucuucgacaaggcccgcaagcagugccucugguuccccuucaacuccauguccuccggcgucaagaaggaguucggccacgaguucgaccucuacgagaacaaggacuacauccgcaacugcaucaucggcaagggccgcuccuacaagggcaccgucuccaucaccaaguccggcaucaagugccagcccugguccuccaugaucccccacgagcacuccuuccuccccuccuccuaccgcggcaaggaccuccaggagaacuacugccgcaacccccgcggcgaggagggcggccccuggugcuucaccuccaaccccgagguccgcuacgaggucugcgacaucccccagugcuccgaggucgagugcaugaccugcaacggcgaguccuaccgcggccucauggaccacaccgaguccggcaagaucugccagcgcugggaccaccagaccccccaccgccacaaguuccuccccgagcgcuaccccgacaagggcuucgacgacaacuacugccgcaaccccgacggccagccccgccccuggugcuacacccucgacccccacacccgcugggaguacugcgccaucaagaccugcgccgacaacaccaugaacgacaccgacgucccccucgagaccaccgagugcauccagggccagggcgagggcuaccgcggcaccgucaacaccaucuggaacggcauccccugccagcgcugggacucccaguacccccacgagcacgacaugacccccgagaacuucaagugcaaggaccuccgcgagaacuacugccgcaaccccgacggcuccgagucccccuggugcuucaccaccgaccccaacauccgcgucggcuacugcucccagauccccaacugcgacaugucccacggccaggacugcuaccgcggcaacggcaagaacuacaugggcaaccucucccagacccgcuccggccucaccugcuccaugugggacaagaacauggaggaccuccaccgccacaucuucugggagcccgacgccuccaagcucaacgagaacuacugccgcaaccccgacgacgacgcccacggccccuggugcuacaccggcaacccccucauccccugggacuacugccccaucucccgcugcgagggcgacaccacccccaccaucgucaaccucgaccaccccgucaucuccugcgccaagaccaagcagcuccgcgucgucaacggcauccccacccgcaccaacaucggcuggauggucucccuccgcuaccgcaacaagcacaucugcggcggcucccucaucaaggaguccuggguccucaccgcccgccagugcuuccccucccgcgaccucaaggacuacgaggccuggcucggcauccacgacguccacggccgcggcgacgagaagugcaagcagguccucaacgucucccagcucgucuacggccccgagggcuccgaccucguccucaugaagcucgcccgccccgccguccucgacgacuucgucuccaccaucgaccuccccaacuacggcugcaccauccccgagaagaccuccugcuccgucuacggcuggggcuacaccggccucaucaacuacgacggccuccuccgcgucgcccaccucuacaucaugggcaacgagaagugcucccagcaccaccgcggcaaggucacccucaacgaguccgagaucugcgccggcgccgagaagaucggcuccggccccugcgagggcgacuacggcggcccccucgucugcgagcagcacaagaugcgcaugguccucggcgucaucguccccggccgcggcugcgccauccccaaccgccccggcaucuucguccgcgucgccuacuacgccaaguggauccacaagaucauccucaccuacaaggucccccaguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1618 - RNA, 2143 nt, Artificial Sequence
  mRNA product Design1 comprising derived and/or modified sequence from Homo sapiens__NP_005336.3 __HsHSPA1A (opt2)
gggagaaagcuuaccauggccaaggccgccgccaucggcaucgaccucggcaccaccuacuccugcgucggcgucuuccagcacggcaaggucgagaucaucgccaacgaccagggcaaccgcaccacccccuccuacgucgccuucaccgacaccgagcgccucaucggcgacgccgccaagaaccaggucgcccucaacccccagaacaccgucuucgacgccaagcgccucaucggccgcaaguucggcgaccccgucguccaguccgacaugaagcacuggcccuuccaggucaucaacgacggcgacaagcccaagguccaggucuccuacaagggcgagaccaaggccuucuaccccgaggagaucuccuccaugguccucaccaagaugaaggagaucgccgaggccuaccucggcuaccccgucaccaacgccgucaucaccguccccgccuacuucaacgacucccagcgccaggccaccaaggacgccggcgucaucgccggccucaacguccuccgcaucaucaacgagcccaccgccgccgccaucgccuacggccucgaccgcaccggcaagggcgagcgcaacguccucaucuucgaccucggcggcggcaccuucgacgucuccauccucaccaucgacgacggcaucuucgaggucaaggccaccgccggcgacacccaccucggcggcgaggacuucgacaaccgccucgucaaccacuucgucgaggaguucaagcgcaagcacaagaaggacaucucccagaacaagcgcgccguccgccgccuccgcaccgccugcgagcgcgccaagcgcacccucuccuccuccacccaggccucccucgagaucgacucccucuucgagggcaucgacuucuacaccuccaucacccgcgcccgcuucgaggagcucugcuccgaccucuuccgcuccacccucgagcccgucgagaaggcccuccgcgacgccaagcucgacaaggcccagauccacgaccucguccucgucggcggcuccacccgcauccccaagguccagaagcuccuccaggacuucuucaacggccgcgaccucaacaaguccaucaaccccgacgaggccgucgccuacggcgccgccguccaggccgccauccucaugggcgacaaguccgagaacguccaggaccuccuccuccucgacgucgccccccucucccucggccucgagaccgccggcggcgucaugaccgcccucaucaagcgcaacuccaccauccccaccaagcagacccagaucuucaccaccuacuccgacaaccagcccggcguccucauccaggucuacgagggcgagcgcgccaugaccaaggacaacaaccuccucggccgcuucgagcucuccggcaucccccccgccccccgcggcgucccccagaucgaggucaccuucgacaucgacgccaacggcauccucaacgucaccgccaccgacaaguccaccggcaaggccaacaagaucaccaucaccaacgacaagggccgccucuccaaggaggagaucgagcgcaugguccaggaggccgagaaguacaaggccgaggacgagguccagcgcgagcgcgucuccgccaagaacgcccucgaguccuacgccuucaacaugaaguccgccgucgaggacgagggccucaagggcaagaucuccgaggccgacaagaagaagguccucgacaagugccaggaggucaucuccuggcucgacgccaacacccucgccgagaaggacgaguucgagcacaagcgcaaggagcucgagcaggucugcaaccccaucaucuccggccucuaccagggcgccggcggccccggccccggcggcuucggcgcccagggccccaagggcggcuccggcuccggccccaccaucgaggaggucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1619 - RNA, 2143 nt, Artificial Sequence; identical to SEQ ID NO: 1618
  mRNA product Design1 comprising derived and/or modified sequence from Homo sapiens__NP_005337.2 __HsHSPA1B (opt2)

SEQ ID NO: 1620 - RNA, 2143 nt, Artificial Sequence
  mRNA product Design1 comprising derived and/or modified sequence from Homo sapiens__NP_005518.3 __HsHSPA1L (opt2)
gggagaaagcuuaccauggccaccgccaagggcaucgccaucggcaucgaccucggcaccaccuacuccugcgucggcgucuuccagcacggcaaggucgagaucaucgccaacgaccagggcaaccgcaccacccccuccuacgucgccuucaccgacaccgagcgccucaucggcgacgccgccaagaaccaggucgccaugaacccccagaacaccgucuucgacgccaagcgccucaucggccgcaaguucaacgaccccgucguccaggccgacaugaagcucuggcccuuccaggucaucaacgagggcggcaagcccaagguccucgucuccuacaagggcgagaacaaggccuucuaccccgaggagaucuccuccaugguccucaccaagcucaaggagaccgccgaggccuuccucggccaccccgucaccaacgccgucaucaccguccccgccuacuucaacgacucccagcgccaggccaccaaggacgccggcgucaucgccggccucaacguccuccgcaucaucaacgagcccaccgccgccgccaucgccuacggccucgacaagggcggccagggcgagcgccacguccucaucuucgaccucggcggcggcaccuucgacgucuccauccucaccaucgacgacggcaucuucgaggucaaggccaccgccggcgacacccaccucggcggcgaggacuucgacaaccgccucgucucccacuucgucgaggaguucaagcgcaagcacaagaaggacaucucccagaacaagcgcgccguccgccgccuccgcaccgccugcgagcgcgccaagcgcacccucuccuccuccacccaggccaaccucgagaucgacucccucuacgagggcaucgacuucuacaccuccaucacccgcgcccgcuucgaggagcucugcgccgaccucuuccgcggcacccucgagcccgucgagaaggcccuccgcgacgccaagauggacaaggccaagauccacgacaucguccucgucggcggcuccacccgcauccccaagguccagcgccuccuccaggacuacuucaacggccgcgaccucaacaaguccaucaaccccgacgaggccgucgccuacggcgccgccguccaggccgccauccucaugggcgacaaguccgagaagguccaggaccuccuccuccucgacgucgccccccucucccucggccucgagaccgccggcggcgucaugaccgcccucaucaagcgcaacuccaccauccccaccaagcagacccagaucuucaccaccuacuccgacaaccagcccggcguccucauccaggucuacgagggcgagcgcgccaugaccaaggacaacaaccuccucggccgcuucgaccucaccggcaucccccccgccccccgcggcgucccccagaucgaggucaccuucgacaucgacgccaacggcauccucaacgucaccgccaccgacaaguccaccggcaaggucaacaagaucaccaucaccaacgacaagggccgccucuccaaggaggagaucgagcgcaugguccucgacgccgagaaguacaaggccgaggacgagguccagcgcgagaagaucgccgccaagaacgcccucgaguccuacgccuucaacaugaaguccgucgucuccgacgagggccucaagggcaagaucuccgaguccgacaagaacaagauccucgacaagugcaacgagcuccucuccuggcucgaggucaaccagcucgccgagaaggacgaguucgaccacaagcgcaaggagcucgagcagaugugcaaccccaucaucaccaagcucuaccagggcggcugcaccggccccgccugcggcaccggcuacguccccggccgccccgccaccggccccaccaucgaggaggucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1621 - RNA, 2137 nt, Artificial Sequence
  mRNA product Design1 comprising derived and/or modified sequence from Homo sapiens__NP_068814.2 __HsHSPA2 (opt2)
gggagaaagcuuaccauguccgcccgcggccccgccaucggcaucgaccucggcaccaccuacuccugcgucggcgucuuccagcacggcaaggucgagaucaucgccaacgaccagggcaaccgcaccacccccuccuacgucgccuucaccgacaccgagcgccucaucggcgacgccgccaagaaccaggucgccaugaaccccaccaacaccaucuucgacgccaagcgccucaucggccgcaaguucgaggacgccaccguccaguccgacaugaagcacuggcccuuccgcgucgucuccgagggcggcaagcccaagguccaggucgaguacaagggcgagaccaagaccuucuuccccgaggagaucuccuccaugguccucaccaagaugaaggagaucgccgaggccuaccucggcggcaagguccacuccgccgucaucaccguccccgccuacuucaacgacucccagcgccaggccaccaaggacgccggcaccaucaccggccucaacguccuccgcaucaucaacgagcccaccgccgccgccaucgccuacggccucgacaagaagggcugcgccggcggcgagaagaacguccucaucuucgaccucggcggcggcaccuucgacgucuccauccucaccaucgaggacggcaucuucgaggucaaguccaccgccggcgacacccaccucggcggcgaggacuucgacaaccgcauggucucccaccucgccgaggaguucaagcgcaagcacaagaaggacaucggccccaacaagcgcgccguccgccgccuccgcaccgccugcgagcgcgccaagcgcacccucuccuccuccacccaggccuccaucgagaucgacucccucuacgagggcgucgacuucuacaccuccaucacccgcgcccgcuucgaggagcucaacgccgaccucuuccgcggcacccucgagcccgucgagaaggcccuccgcgacgccaagcucgacaagggccagauccaggagaucguccucgucggcggcuccacccgcauccccaagauccagaagcuccuccaggacuucuucaacggcaaggagcucaacaaguccaucaaccccgacgaggccgucgccuacggcgccgccguccaggccgccauccucaucggcgacaaguccgagaacguccaggaccuccuccuccucgacgucaccccccucucccucggcaucgagaccgccggcggcgucaugaccccccucaucaagcgcaacaccaccauccccaccaagcagacccagaccuucaccaccuacuccgacaaccaguccuccguccucguccaggucuacgagggcgagcgcgccaugaccaaggacaacaaccuccucggcaaguucgaccucaccggcaucccccccgccccccgcggcgucccccagaucgaggucaccuucgacaucgacgccaacggcauccucaacgucaccgccgccgacaaguccaccggcaaggagaacaagaucaccaucaccaacgacaagggccgccucuccaaggacgacaucgaccgcaugguccaggaggccgagcgcuacaaguccgaggacgaggccaaccgcgaccgcgucgccgccaagaacgcccucgaguccuacaccuacaacaucaagcagaccgucgaggacgagaagcuccgcggcaagaucuccgagcaggacaagaacaagauccucgacaagugccaggaggucaucaacuggcucgaccgcaaccagauggccgagaaggacgaguacgagcacaagcagaaggagcucgagcgcgucugcaaccccaucaucuccaagcucuaccagggcggccccggcggcggcuccggcggcggcggcuccggcgccuccggcggccccaccaucgaggaggucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1622 - RNA, 2740 nt, Artificial Sequence
  mRNA product Design1 comprising derived and/or modified sequence from Homo sapiens__NP_002145.3 __HsHSPA4 (opt2)
gggagaaagcuuaccauguccgucgucggcaucgaccucggcuuccaguccugcuacgucgccgucgcccgcgccggcggcaucgagaccaucgccaacgaguacuccgaccgcugcacccccgccugcaucuccuucggccccaagaaccgcuccaucggcgccgccgccaagucccaggucaucuccaacgccaagaacaccguccagggcuucaagcgcuuccacggccgcgccuucuccgaccccuucgucgaggccgagaaguccaaccucgccuacgacaucguccagcuccccaccggccucaccggcaucaaggucaccuacauggaggaggagcgcaacuucaccaccgagcaggucaccgccaugcuccucuccaagcucaaggagaccgccgaguccguccucaagaagcccgucgucgacugcgucgucuccguccccugcuucuacaccgacgccgagcgccgcuccgucauggacgccacccagaucgccggccucaacugccuccgccucaugaacgagaccaccgccgucgcccucgccuacggcaucuacaagcaggaccuccccgcccucgaggagaagccccgcaacgucgucuucgucgacaugggccacuccgccuaccaggucuccgucugcgccuucaaccgcggcaagcucaagguccucgccaccgccuucgacaccacccucggcggccgcaaguucgacgagguccucgucaaccacuucugcgaggaguucggcaagaaguacaagcucgacaucaaguccaagauccgcgcccuccuccgccucucccaggagugcgagaagcucaagaagcucauguccgccaacgccuccgaccucccccucuccaucgagugcuucaugaacgacgucgacgucuccggcaccaugaaccgcggcaaguuccucgagaugugcaacgaccuccucgcccgcgucgagcccccccuccgcuccguccucgagcagaccaagcucaagaaggaggacaucuacgccgucgagaucgucggcggcgccacccgcauccccgccgucaaggagaagaucuccaaguucuucggcaaggagcucuccaccacccucaacgccgacgaggccgucacccgcggcugcgcccuccagugcgccauccucucccccgccuucaagguccgcgaguucuccaucaccgacgucguccccuaccccaucucccuccgcuggaacucccccgccgaggagggcuccuccgacugcgaggucuucuccaagaaccacgccgcccccuucuccaagguccucaccuucuaccgcaaggagcccuucacccucgaggccuacuacuccuccccccaggaccuccccuaccccgaccccgccaucgcccaguucuccguccagaaggucaccccccaguccgacggcuccuccuccaaggucaaggucaagguccgcgucaacguccacggcaucuucuccgucuccuccgccucccucgucgagguccacaaguccgaggagaacgaggagcccauggagaccgaccagaacgccaaggaggaggagaagaugcaggucgaccaggaggagccccacgucgaggagcagcagcagcagacccccgccgagaacaaggccgaguccgaggagauggagaccucccaggccggcuccaaggacaagaagauggaccagcccccccaggccaagaaggccaaggucaagaccuccaccgucgaccuccccaucgagaaccagcuccucuggcagaucgaccgcgagaugcucaaccucuacaucgagaacgagggcaagaugaucaugcaggacaagcucgagaaggagcgcaacgacgccaagaacgccgucgaggaguacgucuacgagaugcgcgacaagcucuccggcgaguacgagaaguucgucuccgaggacgaccgcaacuccuucacccucaagcucgaggacaccgagaacuggcucuacgaggacggcgaggaccagcccaagcaggucuacgucgacaagcucgccgagcucaagaaccucggccagcccaucaagauccgcuuccaggaguccgaggagcgccccaagcucuucgaggagcucggcaagcagauccagcaguacaugaagaucaucuccuccuucaagaacaaggaggaccaguacgaccaccucgacgccgccgacaugaccaaggucgagaaguccaccaacgaggccauggaguggaugaacaacaagcucaaccuccagaacaagcagucccucaccauggaccccgucgucaaguccaaggagaucgaggccaagaucaaggagcucaccuccaccugcucccccaucaucuccaagcccaagcccaaggucgagccccccaaggaggagcagaagaacgccgagcagaacggccccgucgacggccagggcgacaaccccggcccccaggccgccgagcagggcaccgacaccgccguccccuccgacuccgacaagaagcuccccgagauggacaucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1623 - RNA, 2737 nt, Artificial Sequence
  mRNA product Design1 comprising derived and/or modified sequence from Homo sapiens__NP_055093.2 __HsHSPA4L (opt2)
gggagaaagcuuaccauguccgucgucggcaucgaccucggcuuccucaacugcuacaucgccgucgcccgcuccggcggcaucgagaccaucgccaacgaguacuccgaccgcugcacccccgccugcaucucccucggcucccgcacccgcgccaucggcaacgccgccaagucccagaucgucaccaacguccgcaacaccauccacggcuucaagaagcuccacggccgcuccuucgacgaccccaucguccagaccgagcgcauccgccuccccuacgagcuccagaagaugcccaacggcuccgccggcgucaagguccgcuaccucgaggaggagcgccccuucgccaucgagcaggucaccggcaugcuccucgccaagcucaaggagaccuccgagaacgcccucaagaagcccgucgccgacugcgucaucuccauccccuccuucuucaccgacgccgagcgccgcuccgucauggccgccgcccaggucgccggccucaacugccuccgccucaugaacgagaccaccgccgucgcccucgccuacggcaucuacaagcaggaccuccccccccucgacgagaagccccgcaacgucgucuucaucgacaugggccacuccgccuaccagguccucgucugcgccuucaacaagggcaagcucaagguccucgccaccaccuucgaccccuaccucggcggccgcaacuucgacgaggcccucgucgacuacuucugcgacgaguucaagaccaaguacaagaucaacgucaaggagaacucccgcgcccuccuccgccucuaccaggagugcgagaagcucaagaagcucauguccgccaacgccuccgaccucccccucaacaucgagugcuucaugaacgaccucgacgucuccuccaagaugaaccgcgcccaguucgagcagcucugcgccucccuccucgcccgcgucgagcccccccucaaggccgucauggagcaggccaaccuccagcgcgaggacaucuccuccaucgagaucgucggcggcgccacccgcauccccgccgucaaggagcagaucaccaaguucuuccucaaggacaucuccaccacccucaacgccgacgaggccgucgcccgcggcugcgcccuccagugcgccauccucucccccgccuucaagguccgcgaguucuccaucaccgaccucguccccuacuccaucacccuccgcuggaagaccuccuucgaggacggcuccggcgagugcgaggucuucugcaagaaccaccccgcccccuucuccaaggucaucaccuuccacaagaaggagcccuucgagcucgaggccuucuacaccaaccuccacgagguccccuaccccgacgcccgcaucggcuccuucaccauccagaacgucuucccccaguccgacggcgacuccuccaaggucaaggucaagguccgcgucaacauccacggcaucuucuccgucgccuccgccuccgucaucgagaagcagaaccucgagggcgaccacuccgacgcccccauggagaccgagaccuccuucaagaacgagaacaaggacaacauggacaagaugcaggucgaccaggaggagggccaccagaagugccacgccgagcacacccccgaggaggagaucgaccacaccggcgccaagaccaaguccgccgucuccgacaagcaggaccgccucaaccagacccucaagaagggcaaggucaaguccaucgaccuccccauccaguccucccucugccgccagcucggccaggaccuccucaacuccuacaucgagaacgagggcaagaugaucaugcaggacaagcucgagaaggagcgcaacgacgccaagaacgccgucgaggaguacgucuacgacuuccgcgaccgccucggcaccgucuacgagaaguucaucacccccgaggaccucuccaagcucuccgccguccucgaggacaccgagaacuggcucuacgaggacggcgaggaccagcccaagcaggucuacgucgacaagcuccaggagcucaagaaguacggccagcccauccagaugaaguacauggagcacgaggagcgccccaaggcccucaacgaccucggcaagaagauccagcucgucaugaaggucaucgaggccuaccgcaacaaggacgagcgcuacgaccaccucgaccccaccgagauggagaaggucgagaagugcaucuccgacgccauguccuggcucaacuccaagaugaacgcccagaacaagcucucccucacccaggaccccgucgucaaggucuccgagaucgucgccaaguccaaggagcucgacaacuucugcaaccccaucaucuacaagcccaagcccaaggccgagguccccgaggacaagcccaaggccaacuccgagcacaacggccccauggacggccaguccggcaccgagaccaaguccgacuccaccaaggacuccucccagcacaccaaguccuccggcgagauggaggucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1624 - RNA, 2182 nt, Artificial Sequence
  mRNA product Design1 comprising derived and/or modified sequence from Homo sapiens__NP_005338.1__HsHSPA5 (opt2)
gggagaaagcuuaccaugaagcucucccucgucgccgccaugcuccuccuccucuccgccgcccgcgccgaggaggaggacaagaaggaggacgucggcaccgucgucggcaucgaccucggcaccaccuacuccugcgucggcgucuucaagaacggccgcgucgagaucaucgccaacgaccagggcaaccgcaucacccccuccuacgucgccuucacccccgagggcgagcgccucaucggcgacgccgccaagaaccagcucaccuccaaccccgagaacaccgucuucgacgccaagcgccucaucggccgcaccuggaacgaccccuccguccagcaggacaucaaguuccuccccuucaaggucgucgagaagaagaccaagcccuacauccaggucgacaucggcggcggccagaccaagaccuucgcccccgaggagaucuccgccaugguccucaccaagaugaaggagaccgccgaggccuaccucggcaagaaggucacccacgccgucgucaccguccccgccuacuucaacgacgcccagcgccaggccaccaaggacgccggcaccaucgccggccucaacgucaugcgcaucaucaacgagcccaccgccgccgccaucgccuacggccucgacaagcgcgagggcgagaagaacauccucgucuucgaccucggcggcggcaccuucgacgucucccuccucaccaucgacaacggcgucuucgaggucgucgccaccaacggcgacacccaccucggcggcgaggacuucgaccagcgcgucauggagcacuucaucaagcucuacaagaagaagaccggcaaggacguccgcaaggacaaccgcgccguccagaagcuccgccgcgaggucgagaaggccaagcgcgcccucuccucccagcaccaggcccgcaucgagaucgaguccuucuacgagggcgaggacuucuccgagacccucacccgcgccaaguucgaggagcucaacauggaccucuuccgcuccaccaugaagcccguccagaagguccucgaggacuccgaccucaagaaguccgacaucgacgagaucguccucgucggcggcuccacccgcauccccaagauccagcagcucgucaaggaguucuucaacggcaaggagcccucccgcggcaucaaccccgacgaggccgucgccuacggcgccgccguccaggccggcguccucuccggcgaccaggacaccggcgaccucguccuccucgacgucugcccccucacccucggcaucgagaccgucggcggcgucaugaccaagcucaucccccgcaacaccgucguccccaccaagaagucccagaucuucuccaccgccuccgacaaccagcccaccgucaccaucaaggucuacgagggcgagcgcccccucaccaaggacaaccaccuccucggcaccuucgaccucaccggcaucccccccgccccccgcggcgucccccagaucgaggucaccuucgagaucgacgucaacggcauccuccgcgucaccgccgaggacaagggcaccggcaacaagaacaagaucaccaucaccaacgaccagaaccgccucacccccgaggagaucgagcgcauggucaacgacgccgagaaguucgccgaggaggacaagaagcucaaggagcgcaucgacacccgcaacgagcucgaguccuacgccuacucccucaagaaccagaucggcgacaaggagaagcucggcggcaagcucuccuccgaggacaaggagaccauggagaaggccgucgaggagaagaucgaguggcucgagucccaccaggacgccgacaucgaggacuucaaggccaagaagaaggagcucgaggagaucguccagcccaucaucuccaagcucuacggcuccgccggccccccccccaccggcgaggaggacaccgccgagaaggacgagcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1625 - RNA, 2149 nt, Artificial Sequence
  mRNA product Design1 comprising derived and/or modified sequence from Homo sapiens__NP_002146.2__HsHSPA6 (opt2)
gggagaaagcuuaccaugcaggccccccgcgagcucgccgucggcaucgaccucggcaccaccuacuccugcgucggcgucuuccagcagggccgcgucgagauccucgccaacgaccagggcaaccgcaccacccccuccuacgucgccuucaccgacaccgagcgccucgucggcgacgccgccaagucccaggccgcccucaacccccacaacaccgucuucgacgccaagcgccucaucggccgcaaguucgccgacaccaccguccaguccgacaugaagcacuggcccuuccgcgucgucuccgagggcggcaagcccaagguccgcgucugcuaccgcggcgaggacaagaccuucuaccccgaggagaucuccuccaugguccucuccaagaugaaggagaccgccgaggccuaccucggccagcccgucaagcacgccgucaucaccguccccgccuacuucaacgacucccagcgccaggccaccaaggacgccggcgccaucgccggccucaacguccuccgcaucaucaacgagcccaccgccgccgccaucgccuacggccucgaccgccgcggcgccggcgagcgcaacguccucaucuucgaccucggcggcggcaccuucgacgucuccguccucuccaucgacgccggcgucuucgaggucaaggccaccgccggcgacacccaccucggcggcgaggacuucgacaaccgccucgucaaccacuucauggaggaguuccgccgcaagcacggcaaggaccucuccggcaacaagcgcgcccuccgccgccuccgcaccgccugcgagcgcgccaagcgcacccucuccuccuccacccaggccacccucgagaucgacucccucuucgagggcgucgacuucuacaccuccaucacccgcgcccgcuucgaggagcucugcuccgaccucuuccgcuccacccucgagcccgucgagaaggcccuccgcgacgccaagcucgacaaggcccagauccacgacgucguccucgucggcggcuccacccgcauccccaagguccagaagcuccuccaggacuucuucaacggcaaggagcucaacaaguccaucaaccccgacgaggccgucgccuacggcgccgccguccaggccgccguccucaugggcgacaagugcgagaagguccaggaccuccuccuccucgacgucgccccccucucccucggccucgagaccgccggcggcgucaugaccacccucauccagcgcaacgccaccauccccaccaagcagacccagaccuucaccaccuacuccgacaaccagcccggcgucuucauccaggucuacgagggcgagcgcgccaugaccaaggacaacaaccuccucggccgcuucgagcucuccggcaucccccccgccccccgcggcgucccccagaucgaggucaccuucgacaucgacgccaacggcauccucuccgucaccgccaccgaccgcuccaccggcaaggccaacaagaucaccaucaccaacgacaagggccgccucuccaaggaggaggucgagcgcaugguccacgaggccgagcaguacaaggccgaggacgaggcccagcgcgaccgcgucgccgccaagaacucccucgaggcccacgucuuccacgucaagggcucccuccaggaggagucccuccgcgacaagauccccgaggaggaccgccgcaagaugcaggacaagugccgcgagguccucgccuggcucgagcacaaccagcucgccgagaaggaggaguacgagcaccagaagcgcgagcucgagcagaucugccgccccaucuucucccgccucuacggcggccccggcguccccggcggcuccuccugcggcacccaggcccgccagggcgaccccuccaccggccccaucaucgaggaggucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1626 - RNA, 1321 nt, Artificial Sequence
  mRNA product Design1 comprising derived and/or modified sequence from Homo sapiens__P48741__HsHSPA7 (opt2)
gggagaaagcuuaccaugcaggccccccgcgagcucgccgucggcaucgaccucggcaccaccuacuccugcgucggcgucuuccagcagggccgcgucgagauccucgccaacgaccagggcaaccgcaccacccccuccuacgucgccuucaccgacaccgagcgccucgucggcgacgccgccaagucccaggccgcccucaacccccacaacaccgucuucgacgccaagcgccucaucggccgcaaguucgccgacaccaccguccaguccgacaugaagcacuggcccuuccaggucgucuccgagggcggcaagcccaagguccgcgucugcuaccgcggcgaggacaagaccuucuaccccgaggagaucuccuccaugguccucuccaagaugaaggagaccgccgaggccuaccucggccagcccgucaagcacgccgucaucaccguccccaccuacuucuccaacucccagcgccaggccaccaaggacgccggcgccaucgccggccucaagguccuccccaucaucaacgaggccaccgccgccgccaucgccuacggccucgaccgccgcggcgccggcaagcgcaacguccucaucuucgaccucggcggcggcaccuucgacgucuccguccucuccaucgacgccggcgucuucgaggucaaggccaccgccggcgacacccaccucggcggcgaggacuucgacaaccgccucgucaaccacuucauggaggaguuccgccgcaagcacggcaaggaccucuccggcaacaagcgcgcccuccgccgccuccgcaccgccugcgagcgcgccaagcgcacccccuccuccuccacccaggccacccucgagaucgacucccucuucgagggcgucgacuucuacaaguccaucacccgcgcccgcuucgaggagcucugcuccgaccucuuccgcuccacccucgagcccgucgagaaggcccuccgcgacgccaagcucgacaaggcccagauccacgacuucguccucggcggcggccuccacucccacccccagggcgccgaggucgccgccggccuccuccagcgccagggcgccgagcaggagcaccagcccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1627 - RNA, 2158 nt, Artificial Sequence
  mRNA product Design1 comprising derived and/or modified sequence from Homo sapiens__NP_006588.1 __HsHSPA8 (opt2)
gggagaaagcuuaccauguccaagggccccgccgucggcaucgaccucggcaccaccuacuccugcgucggcgucuuccagcacggcaaggucgagaucaucgccaacgaccagggcaaccgcaccacccccuccuacgucgccuucaccgacaccgagcgccucaucggcgacgccgccaagaaccaggucgccaugaaccccaccaacaccgucuucgacgccaagcgccucaucggccgccgcuucgacgacgccgucguccaguccgacaugaagcacuggcccuucauggucgucaacgacgccggccgccccaagguccaggucgaguacaagggcgagaccaaguccuucuaccccgaggaggucuccuccaugguccucaccaagaugaaggagaucgccgaggccuaccucggcaagaccgucaccaacgccgucgucaccguccccgccuacuucaacgacucccagcgccaggccaccaaggacgccggcaccaucgccggccucaacguccuccgcaucaucaacgagcccaccgccgccgccaucgccuacggccucgacaagaaggucggcgccgagcgcaacguccucaucuucgaccucggcggcggcaccuucgacgucuccauccucaccaucgaggacggcaucuucgaggucaaguccaccgccggcgacacccaccucggcggcgaggacuucgacaaccgcauggucaaccacuucaucgccgaguucaagcgcaagcacaagaaggacaucuccgagaacaagcgcgccguccgccgccuccgcaccgccugcgagcgcgccaagcgcacccucuccuccuccacccaggccuccaucgagaucgacucccucuacgagggcaucgacuucuacaccuccaucacccgcgcccgcuucgaggagcucaacgccgaccucuuccgcggcacccucgaccccgucgagaaggcccuccgcgacgccaagcucgacaagucccagauccacgacaucguccucgucggcggcuccacccgcauccccaagauccagaagcuccuccaggacuucuucaacggcaaggagcucaacaaguccaucaaccccgacgaggccgucgccuacggcgccgccguccaggccgccauccucuccggcgacaaguccgagaacguccaggaccuccuccuccucgacgucaccccccucucccucggcaucgagaccgccggcggcgucaugaccguccucaucaagcgcaacaccaccauccccaccaagcagacccagaccuucaccaccuacuccgacaaccagcccggcguccucauccaggucuacgagggcgagcgcgccaugaccaaggacaacaaccuccucggcaaguucgagcucaccggcaucccccccgccccccgcggcgucccccagaucgaggucaccuucgacaucgacgccaacggcauccucaacgucuccgccgucgacaaguccaccggcaaggagaacaagaucaccaucaccaacgacaagggccgccucuccaaggaggacaucgagcgcaugguccaggaggccgagaaguacaaggccgaggacgagaagcagcgcgacaaggucuccuccaagaacucccucgaguccuacgccuucaacaugaaggccaccgucgaggacgagaagcuccagggcaagaucaacgacgaggacaagcagaagauccucgacaagugcaacgagaucaucaacuggcucgacaagaaccagaccgccgagaaggaggaguucgagcaccagcagaaggagcucgagaaggucugcaaccccaucaucaccaagcucuaccaguccgccggcggcaugcccggcggcaugcccggcggcuuccccggcggcggcgccccccccuccggcggcgccuccuccggccccaccaucgaggaggucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1628 - RNA, 2257 nt, Artificial Sequence
  mRNA product Design1 comprising derived and/or modified sequence from Homo sapiens__NP_004125.3 __HsHSPA9 (opt2)
gggagaaagcuuaccaugaucuccgccucccgcgccgccgccgcccgccucgucggcgccgccgccucccgcggccccaccgccgcccgccaccaggacuccuggaacggccucucccacgaggccuuccgccucgucucccgccgcgacuacgccuccgaggccaucaagggcgccgucgucggcaucgaccucggcaccaccaacuccugcgucgccgucauggagggcaagcaggccaagguccucgagaacgccgagggcgcccgcaccacccccuccgucgucgccuucaccgccgacggcgagcgccucgucggcaugcccgccaagcgccaggccgucaccaaccccaacaacaccuucuacgccaccaagcgccucaucggccgccgcuacgacgaccccgagguccagaaggacaucaagaacguccccuucaagaucguccgcgccuccaacggcgacgccugggucgaggcccacggcaagcucuacucccccucccagaucggcgccuucguccucaugaagaugaaggagaccgccgagaacuaccucggccacaccgccaagaacgccgucaucaccguccccgccuacuucaacgacucccagcgccaggccaccaaggacgccggccagaucuccggccucaacguccuccgcgucaucaacgagcccaccgccgccgcccucgccuacggccucgacaaguccgaggacaaggucaucgccgucuacgaccucggcggcggcaccuucgacaucuccauccucgagauccagaagggcgucuucgaggucaaguccaccaacggcgacaccuuccucggcggcgaggacuucgaccaggcccuccuccgccacaucgucaaggaguucaagcgcgagaccggcgucgaccucaccaaggacaacauggcccuccagcgcguccgcgaggccgccgagaaggccaagugcgagcucuccuccuccguccagaccgacaucaaccuccccuaccucaccauggacuccuccggccccaagcaccucaacaugaagcucacccgcgcccaguucgagggcaucgucaccgaccucauccgccgcaccaucgcccccugccagaaggccaugcaggacgccgaggucuccaaguccgacaucggcgaggucauccucgucggcggcaugacccgcaugcccaagguccagcagaccguccaggaccucuucggccgcgcccccuccaaggccgucaaccccgacgaggccgucgccaucggcgccgccauccagggcggcguccucgccggcgacgucaccgacguccuccuccucgacgucaccccccucucccucggcaucgagacccucggcggcgucuucaccaagcucaucaaccgcaacaccaccauccccaccaagaagucccaggucuucuccaccgccgccgacggccagacccaggucgagaucaaggucugccagggcgagcgcgagauggccggcgacaacaagcuccucggccaguucacccucaucggcaucccccccgccccccgcggcgucccccagaucgaggucaccuucgacaucgacgccaacggcaucguccacgucuccgccaaggacaagggcaccggccgcgagcagcagaucgucauccaguccuccggcggccucuccaaggacgacaucgagaacauggucaagaacgccgagaaguacgccgaggaggaccgccgcaagaaggagcgcgucgaggccgucaacauggccgagggcaucauccacgacaccgagaccaagauggaggaguucaaggaccagcuccccgccgacgagugcaacaagcucaaggaggagaucuccaagaugcgcgagcuccucgcccgcaaggacuccgagaccggcgagaacauccgccaggccgccuccucccuccagcaggccucccucaagcucuucgagauggccuacaagaagauggccuccgagcgcgagggcuccggcuccuccggcaccggcgagcagaaggaggaccagaaggaggagaagcagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1629 - RNA, 2245 nt, Artificial Sequence
  mRNA product Design1 comprising derived and/or modified sequence from Homo sapiens__NP_079291.2__HsHSPA12A (opt2)
gggagaaagcuuaccauggccgacaaggaggccggcggcuccgacggcccccgcgagaccgcccccaccuccgccuacuccucccccgcccgcucccucggcgacaccggcaucaccccccucucccccucccacaucgucaacgacaccgacuccaacgucuccgagcagcaguccuuccucgucgucgucgccgucgacuucggcaccaccuccuccggcuacgccuacuccuucaccaaggagcccgagugcauccacgucaugcgccgcugggagggcggcgaccccggcgucuccaaccagaagacccccaccaccauccuccucacccccgagcgcaaguuccacuccuucggcuacgccgcccgcgacuucuaccacgaccucgaccccaacgaggccaagcaguggcucuaccucgagaaguucaagaugaagcuccacaccaccggcgaccucaccauggacaccgaccucaccgccgccaacggcaagaaggucaaggcccucgagaucuucgccuacgcccuccaguacuucaaggagcaggcccucaaggagcucuccgaccaggccggcuccgaguucgagaacuccgacguccgcugggucaucaccguccccgccaucuggaagcagcccgccaagcaguucaugcgccaggccgccuaccaggccggccucgccucccccgagaacuccgagcagcucaucaucgcccucgagcccgaggccgccuccaucuacugccgcaagcuccgccuccaccagaugaucgagcucuccuccaaggccgccgucaacggcuacuccggcuccgacaccgucggcgccggcuucacccaggccaaggagcacauccgccgcaaccgccagucccgcaccuuccucgucgagaacgucaucggcgagaucugguccgagcucgaggagggcgacaaguacgucgucgucgacuccggcggcggcaccgucgaccucaccguccaccagauccgccuccccgagggccaccucaaggagcucuacaaggccaccggcggccccuacggcucccucggcgucgacuacgaguucgagaagcuccucuacaagaucuucggcgaggacuucaucgagcaguucaagaucaagcgccccgccgccugggucgaccucaugaucgccuucgagucccgcaagcgcgccgccgcccccgaccgcaccaacccccucaacaucacccuccccuucuccuucaucgacuacuacaagaaguuccgcggccacuccgucgagcacgcccuccgcaaguccaacgucgacuucgucaagugguccucccagggcaugcuccgcaugucccccgacgccaugaacgcccucuucaagcccaccaucgacuccaucaucgagcaccuccgcgaccucuuccagaagcccgaggucuccaccgucaaguuccucuuccucgucggcggcuucgccgaggccccccuccuccagcaggccguccaggccgccuucggcgaccagugccgcaucaucaucccccaggacgucggccucaccauccucaagggcgccguccucuucggccucgaccccgccgucaucaagguccgccgcuccccccucaccuacggcgucggcguccucaaccgcuacgucgagggcaagcacccccccgagaagcuccucgucaaggacggcacccgcuggugcaccgacgucuucgacaaguucaucuccgccgaccaguccgucgcccucggcgagcucgucaagcgcuccuacacccccgccaagcccucccagcucgucaucgucaucaacaucuacuccuccgagcacgacaacgucuccuucaucaccgaccccggcgucaagaagugcggcacccuccgccucgaccucaccggcaccuccggcaccgccguccccgcccgccgcgagauccagacccucaugcaguucggcgacaccgagaucaaggccaccgccaucgacaucgccaccuccaaguccgucaaggucggcaucgacuuccucaacuacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1630 - RNA, 2278 nt, Artificial Sequence
  mRNA product Design1 comprising derived and/or modified sequence from Homo sapiens__NP_443202.3 __HsHSPA12B (opt2)
gggagaaagcuuaccaugcucgccguccccgagaugggccuccagggccucuacaucggcuccucccccgagcgcucccccguccccuccccccccggcuccccccgcacccaggaguccugcggcaucgccccccucacccccucccagucccccaagcccgagguccgcgccccccagcaggccuccuucuccgucgucgucgccaucgacuucggcaccaccuccuccggcuacgccuucuccuucgccuccgaccccgaggccauccacaugaugcgcaagugggagggcggcgaccccggcgucgcccaccagaagacccccaccugccuccuccucacccccgagggcgccuuccacuccuucggcuacaccgcccgcgacuacuaccacgaccucgaccccgaggaggcccgcgacuggcucuacuucgagaaguucaagaugaagauccacuccgccaccgaccucacccucaagacccagcucgaggccgucaacggcaagaccaugcccgcccucgaggucuucgcccacgcccuccgcuucuuccgcgagcacgcccuccaggagcuccgcgagcagucccccucccuccccgagaaggacaccguccgcuggguccucaccguccccgccaucuggaagcagcccgccaagcaguucaugcgcgaggccgccuaccucgccggccucgucucccgcgagaacgccgagcagcuccucaucgcccucgagcccgaggccgccuccgucuacugccgcaagcuccgccuccaccagcuccucgaccucuccggccgcgcccccggcggcggccgccucggcgagcgccgcuccaucgacuccuccuuccgccaggcccgcgagcagcuccgccgcucccgccacucccgcaccuuccucgucgaguccggcgucggcgagcucugggccgagaugcaggccggcgaccgcuacgucgucgccgacugcggcggcggcaccgucgaccucaccguccaccagcucgagcagccccacggcacccucaaggagcucuacaaggccuccggcggccccuacggcgccgucggcgucgaccucgccuucgagcagcuccucugccgcaucuucggcgaggacuucaucgccaccuucaagcgccagcgccccgccgccugggucgaccucaccaucgccuucgaggcccgcaagcgcaccgccggcccccaccgcgccggcgcccucaacaucucccuccccuucuccuucaucgacuucuaccgcaagcagcgcggccacaacgucgagaccgcccuccgccgcuccuccgucaacuucgucaagugguccucccagggcaugcuccgcauguccugcgaggccaugaacgagcucuuccagcccaccgucuccggcaucauccagcacaucgaggcccuccucgcccgccccgagguccagggcgucaagcuccucuuccucgucggcggcuucgccgaguccgccguccuccagcacgccguccaggccgcccucggcgcccgcggccuccgcgucgucgucccccacgacgucggccucaccauccucaagggcgccguccucuucggccaggcccccggcgucguccgcguccgccgcuccccccucaccuacggcgucggcguccucaaccgcuucguccccggccgccacccccccgagaagcuccucguccgcgacggccgccgcuggugcaccgacgucuucgagcgcuucgucgccgccgagcaguccgucgcccucggcgaggagguccgccgcuccuacugccccgcccgccccggccagcgccgcguccucaucaaccucuacugcugcgccgccgaggacgcccgcuucaucaccgaccccggcguccgcaagugcggcgcccucucccucgagcucgagcccgccgacugcggccaggacaccgccggcgccccccccggccgccgcgagauccgcgccgccaugcaguucggcgacaccgagaucaaggucaccgccgucgacgucuccaccaaccgcuccguccgcgccuccaucgacuuccucuccaacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1631 - RNA, 1633 nt, Artificial Sequence
  mRNA product Design1 comprising derived and/or modified sequence from Homo sapiens__NP_008879.3__HsHSPA13 (opt2)
gggagaaagcuuaccauggcccgcgagaugaccauccucggcuccgccguccucacccuccuccucgccggcuaccucgcccagcaguaccucccccuccccacccccaaggucaucggcaucgaccucggcaccaccuacugcuccgucggcgucuucuuccccggcaccggcaaggucaaggucauccccgacgagaacggccacaucuccauccccuccauggucuccuucaccgacaacgacgucuacgucggcuacgaguccgucgagcucgccgacuccaacccccagaacaccaucuacgacgccaagcgcuucaucggcaagaucuucaccgccgaggagcucgaggccgagaucggccgcuaccccuucaagguccucaacaagaacggcauggucgaguucuccgucaccuccaacgagaccaucaccgucucccccgaguacgucggcucccgccuccuccucaagcucaaggagauggccgaggccuaccucggcaugcccgucgccaacgccgucaucuccguccccgccgaguucgaccucaagcagcgcaacuccaccaucgaggccgccaaccucgccggccucaagauccuccgcgucaucaacgagcccaccgccgccgccauggccuacggccuccacaaggccgacgucuuccacguccucgucaucgaccucggcggcggcacccucgacgucucccuccucaacaagcagggcggcauguuccucacccgcgccauguccggcaacaacaagcucggcggccaggacuucaaccagcgccuccuccaguaccucuacaagcagaucuaccagaccuacggcuucguccccucccgcaaggaggagauccaccgccuccgccaggccgucgagauggucaagcucaaccucacccuccaccaguccgcccagcucuccguccuccucaccgucgaggagcaggaccgcaaggagccccacuccuccgacaccgagcuccccaaggacaagcucuccuccgccgacgaccaccgcgucaacuccggcuucggccgcggccucuccgacaagaaguccggcgagucccagguccucuucgagaccgagaucucccgcaagcucuucgacacccucaacgaggaccucuuccagaagauccucguccccauccagcagguccucaaggagggccaccucgagaagaccgagaucgacgaggucguccucgucggcggcuccacccgcaucccccgcauccgccaggucauccaggaguucuucggcaaggaccccaacaccuccgucgaccccgaccucgccgucgucaccggcgucgccauccaggccggcaucgacggcggcuccuggccccuccaggucuccgcccucgagauccccaacaagcaccuccagaagaccaacuucaacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1632 - RNA, 1747 nt, Artificial Sequence
  mRNA product Design1 comprising derived and/or modified sequence from Homo sapiens__NP_057383.2__HsHSPA14 (opt2)
gggagaaagcuuaccauggccgccaucggcguccaccucggcugcaccuccgccugcgucgccgucuacaaggacggccgcgccggcgucgucgccaacgacgccggcgaccgcgucacccccgccgucgucgccuacuccgagaacgaggagaucgucggccucgccgccaagcagucccgcauccgcaacaucuccaacaccgucaugaaggucaagcagauccucggccgcuccuccuccgacccccaggcccagaaguacaucgccgaguccaagugccucgucaucgagaagaacggcaagcuccgcuacgagaucgacaccggcgaggagaccaaguucgucaaccccgaggacgucgcccgccucaucuucuccaagaugaaggagaccgcccacuccguccucggcuccgacgccaacgacgucgucaucaccguccccuucgacuucggcgagaagcagaagaacgcccucggcgaggccgcccgcgccgccggcuucaacguccuccgccucauccacgagcccuccgccgcccuccucgccuacggcaucggccaggacucccccaccggcaaguccaacauccucgucuucaagcucggcggcaccucccucucccucuccgucauggaggucaacuccggcaucuaccgcguccucuccaccaacaccgacgacaacaucggcggcgcccacuucaccgagacccucgcccaguaccucgccuccgaguuccagcgcuccuucaagcacgacguccgcggcaacgcccgcgccaugaugaagcucaccaacuccgccgaggucgccaagcacucccucuccacccucggcuccgccaacugcuuccucgacucccucuacgagggccaggacuucgacugcaacgucucccgcgcccgcuucgagcuccucugcuccccccucuucaacaagugcaucgaggccauccgcggccuccucgaccagaacggcuucaccgccgacgacaucaacaaggucguccucugcggcggcuccucccgcauccccaagcuccagcagcucaucaaggaccucuuccccgccgucgagcuccucaacuccaucccccccgacgaggucauccccaucggcgccgccaucgaggccggcauccucaucggcaaggagaaccuccucgucgaggacucccucaugaucgagugcuccgcccgcgacauccucgucaagggcgucgacgaguccggcgccucccgcuucaccguccucuuccccuccggcaccccccuccccgcccgccgccagcacacccuccaggcccccggcuccaucuccuccgucugccucgagcucuacgaguccgacggcaagaacuccgccaaggaggagaccaaguucgcccaggucguccuccaggaccucgacaagaaggagaacggccuccgcgacauccucgccguccucaccaugaagcgcgacggcucccuccacgucaccugcaccgaccaggagaccggcaagugcgaggccaucuccaucgagaucgccuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1633 - RNA, 2794 nt, Artificial Sequence
  mRNA product Design1 comprising derived and/or modified sequence from Homo sapiens__NP_006635.2 __HsHSPH1 (opt2)
gggagaaagcuuaccauguccgucgucggccucgacgucggcucccaguccugcuacaucgccgucgcccgcgccggcggcaucgagaccaucgccaacgaguucuccgaccgcugcacccccuccgucaucuccuucggcuccaagaaccgcaccaucggcgucgccgccaagaaccagcagaucacccacgccaacaacaccgucuccaacuucaagcgcuuccacggccgcgccuucaacgaccccuucauccagaaggagaaggagaaccucuccuacgaccucgucccccucaagaacggcggcgucggcaucaaggucauguacaugggcgaggagcaccucuucuccgucgagcagaucaccgccaugcuccucaccaagcucaaggagaccgccgagaacucccucaagaagcccgucaccgacugcgucaucuccguccccuccuucuucaccgacgccgagcgccgcuccguccucgacgccgcccagaucgucggccucaacugccuccgccucaugaacgacaugaccgccgucgcccucaacuacggcaucuacaagcaggaccuccccucccucgacgagaagccccgcaucgucgucuucgucgacaugggccacuccgccuuccaggucuccgccugcgccuucaacaagggcaagcucaagguccucggcaccgccuucgaccccuuccucggcggcaagaacuucgacgagaagcucgucgagcacuucugcgccgaguucaagaccaaguacaagcucgacgccaaguccaagauccgcgcccuccuccgccucuaccaggagugcgagaagcucaagaagcucauguccuccaacuccaccgaccucccccucaacaucgagugcuucaugaacgacaaggacgucuccggcaagaugaaccgcucccaguucgaggagcucugcgccgagcuccuccagaagaucgaggucccccucuacucccuccucgagcagacccaccucaaggucgaggacgucuccgccgucgagaucgucggcggcgccacccgcauccccgccgucaaggagcgcaucgccaaguucuucggcaaggacaucuccaccacccucaacgccgacgaggccgucgcccgcggcugcgcccuccagugcgccauccucucccccgccuucaagguccgcgaguucuccgucaccgacgccguccccuuccccaucucccucaucuggaaccacgacuccgaggacaccgagggcguccacgaggucuucucccgcaaccacgccgcccccuucuccaagguccucaccuuccuccgccgcggccccuucgagcucgaggccuucuacuccgacccccagggcguccccuaccccgaggccaagaucggccgcuucgucguccagaacgucuccgcccagaaggacggcgagaagucccgcgucaaggucaagguccgcgucaacacccacggcaucuucaccaucuccaccgccuccauggucgagaagguccccaccgaggagaacgagauguccuccgaggccgacauggagugccucaaccagcgcccccccgagaaccccgacaccgacaagaacguccagcaggacaacuccgaggccggcacccagccccagguccagaccgacgcccagcagaccucccaguccccccccucccccgagcucaccuccgaggagaacaagauccccgacgccgacaaggccaacgagaagaaggucgaccagccccccgaggccaagaagcccaagaucaaggucgucaacgucgagcuccccaucgaggccaaccucgucuggcagcucggcaaggaccuccucaacauguacaucgagaccgagggcaagaugaucaugcaggacaagcucgagaaggagcgcaacgacgccaagaacgccgucgaggaguacgucuacgaguuccgcgacaagcucugcggccccuacgagaaguucaucugcgagcaggaccaccagaacuuccuccgccuccucaccgagaccgaggacuggcucuacgaggagggcgaggaccaggccaagcaggccuacgucgacaagcucgaggagcucaugaagaucggcacccccgucaagguccgcuuccaggaggccgaggagcgccccaagauguucgaggagcucggccagcgccuccagcacuacgccaagaucgccgccgacuuccgcaacaaggacgagaaguacaaccacaucgacgaguccgagaugaagaaggucgagaaguccgucaacgaggucauggaguggaugaacaacgucaugaacgcccaggccaagaagucccucgaccaggaccccgucguccgcgcccaggagaucaagaccaagaucaaggagcucaacaacaccugcgagcccgucgucacccagcccaagcccaagaucgagucccccaagcucgagcgcacccccaacggccccaacaucgacaagaaggaggaggaccucgaggacaagaacaacuucggcgccgagcccccccaccagaacggcgagugcuaccccaacgagaagaacuccgucaacauggaccucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1634 - RNA, 3217 nt, Artificial Sequence
  mRNA product Design1 comprising derived and/or modified sequence from Homo sapiens__NP_006380.1 __HsHYOU1 (opt2)
gggagaaagcuuaccauggccgacaagguccgccgccagcgcccccgccgccgcgucugcugggcccucgucgccguccuccucgccgaccuccucgcccucuccgacacccucgccgucauguccgucgaccucggcuccgaguccaugaaggucgccaucgucaagcccggcguccccauggagaucguccucaacaaggagucccgccgcaagacccccgucaucgucacccucaaggagaacgagcgcuucuucggcgacuccgccgccuccauggccaucaagaaccccaaggccacccuccgcuacuuccagcaccuccucggcaagcaggccgacaacccccacgucgcccucuaccaggcccgcuuccccgagcacgagcucaccuucgacccccagcgccagaccguccacuuccagaucuccucccagcuccaguucucccccgaggagguccucggcaugguccucaacuacucccgcucccucgccgaggacuucgccgagcagcccaucaaggacgccgucaucaccguccccgucuucuucaaccaggccgagcgccgcgccguccuccaggccgcccgcauggccggccucaagguccuccagcucaucaacgacaacaccgccaccgcccucuccuacggcgucuuccgccgcaaggacaucaacaccaccgcccagaacaucauguucuacgacaugggcuccggcuccaccgucugcaccaucgucaccuaccagauggucaagaccaaggaggccggcaugcagccccagcuccagauccgcggcgucggcuucgaccgcacccucggcggccucgagauggagcuccgccuccgcgagcgccucgccggccucuucaacgagcagcgcaagggccagcgcgccaaggacguccgcgagaacccccgcgccauggccaagcuccuccgcgaggccaaccgccucaagaccguccucuccgccaacgccgaccacauggcccagaucgagggccucauggacgacgucgacuucaaggccaaggucacccgcgucgaguucgaggagcucugcgccgaccucuucgagcgcguccccggccccguccagcaggcccuccaguccgccgagaugucccucgacgagaucgagcaggucauccucgucggcggcgccacccgcgucccccgcguccaggagguccuccucaaggccgucggcaaggaggagcucggcaagaacaucaacgccgacgaggccgccgccaugggcgccgucuaccaggccgccgcccucuccaaggccuucaaggucaagcccuucgucguccgcgacgccgucgucuaccccauccucgucgaguucacccgcgaggucgaggaggagcccggcauccacucccucaagcacaacaagcgcguccucuucucccgcaugggccccuacccccagcgcaaggucaucaccuucaaccgcuacucccacgacuucaacuuccacaucaacuacggcgaccucggcuuccucggccccgaggaccuccgcgucuucggcucccagaaccucaccaccgucaagcucaagggcgucggcgacuccuucaagaaguaccccgacuacgaguccaagggcaucaaggcccacuucaaccucgacgaguccggcguccucucccucgaccgcgucgaguccgucuucgagacccucgucgaggacuccgccgaggaggaguccacccucaccaagcucggcaacaccaucuccucccucuucggcggcggcaccacccccgacgccaaggagaacggcaccgacaccguccaggaggaggaggagucccccgccgagggcuccaaggacgagcccggcgagcaggucgagcucaaggaggaggccgaggcccccgucgaggacggcucccagccccccccccccgagcccaagggcgacgccacccccgagggcgagaaggccaccgagaaggagaacggcgacaaguccgaggcccagaagcccuccgagaaggccgaggccggccccgagggcgucgcccccgcccccgagggcgagaagaagcagaagcccgcccgcaagcgccgcauggucgaggagaucggcgucgagcucgucguccucgaccuccccgaccuccccgaggacaagcucgcccaguccguccagaagcuccaggaccucacccuccgcgaccucgagaagcaggagcgcgagaaggccgccaacucccucgaggccuucaucuucgagacccaggacaagcucuaccagcccgaguaccaggaggucuccaccgaggagcagcgcgaggagaucuccggcaagcucuccgccgccuccaccuggcucgaggacgagggcgucggcgccaccaccgucaugcucaaggagaagcucgccgagcuccgcaagcucugccagggccucuucuuccgcgucgaggagcgcaagaaguggcccgagcgccucuccgcccucgacaaccuccucaaccacuccuccauguuccucaagggcgcccgccucauccccgagauggaccagaucuucaccgaggucgagaugaccacccucgagaaggucaucaacgagaccugggccuggaagaacgccacccucgccgagcaggccaagcuccccgccaccgagaagcccguccuccucuccaaggacaucgaggccaagaugauggcccucgaccgcgagguccaguaccuccucaacaaggccaaguucaccaagccccgcccccgccccaaggacaagaacggcacccgcgccgagcccccccucaacgccuccgccuccgaccagggcgagaaggucaucccccccgccggccagaccgaggacgccgagcccaucuccgagcccgagaaggucgagaccggcuccgagcccggcgacaccgagccccucgagcucggcggccccggcgccgagcccgagcagaaggagcaguccaccggccagaagcgcccccucaagaacgacgagcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1635 - RNA, 2416 nt, Artificial Sequence
  mRNA product Design1 comprising derived and/or modified sequence from Homo sapiens__NP_005339.3 __HsHSP90AA1 (opt2)
gggagaaagcuuaccaugcccgaggagacccagacccaggaccagcccauggaggaggaggaggucgagaccuucgccuuccaggccgagaucgcccagcucaugucccucaucaucaacaccuucuacuccaacaaggagaucuuccuccgcgagcucaucuccaacuccuccgacgcccucgacaagauccgcuacgagucccucaccgaccccuccaagcucgacuccggcaaggagcuccacaucaaccucauccccaacaagcaggaccgcacccucaccaucgucgacaccggcaucggcaugaccaaggccgaccucaucaacaaccucggcaccaucgccaaguccggcaccaaggccuucauggaggcccuccaggccggcgccgacaucuccaugaucggccaguucggcgucggcuucuacuccgccuaccucgucgccgagaaggucaccgucaucaccaagcacaacgacgacgagcaguacgccugggaguccuccgccggcggcuccuucaccguccgcaccgacaccggcgagcccaugggccgcggcaccaaggucauccuccaccucaaggaggaccagaccgaguaccucgaggagcgccgcaucaaggagaucgucaagaagcacucccaguucaucggcuaccccaucacccucuucgucgagaaggagcgcgacaaggaggucuccgacgacgaggccgaggagaaggaggacaaggaggaggagaaggagaaggaggagaaggaguccgaggacaagcccgagaucgaggacgucggcuccgacgaggaggaggagaagaaggacggcgacaagaagaagaagaagaagaucaaggagaaguacaucgaccaggaggagcucaacaagaccaagcccaucuggacccgcaaccccgacgacaucaccaacgaggaguacggcgaguucuacaagucccucaccaacgacugggaggaccaccucgccgucaagcacuucuccgucgagggccagcucgaguuccgcgcccuccucuucgucccccgccgcgcccccuucgaccucuucgagaaccgcaagaagaagaacaacaucaagcucuacguccgccgcgucuucaucauggacaacugcgaggagcucauccccgaguaccucaacuucauccgcggcgucgucgacuccgaggaccucccccucaacaucucccgcgagaugcuccagcaguccaagauccucaaggucauccgcaagaaccucgucaagaagugccucgagcucuucaccgagcucgccgaggacaaggagaacuacaagaaguucuacgagcaguucuccaagaacaucaagcucggcauccacgaggacucccagaaccgcaagaagcucuccgagcuccuccgcuacuacaccuccgccuccggcgacgagauggucucccucaaggacuacugcacccgcaugaaggagaaccagaagcacaucuacuacaucaccggcgagaccaaggaccaggucgccaacuccgccuucgucgagcgccuccgcaagcacggccucgaggucaucuacaugaucgagcccaucgacgaguacugcguccagcagcucaaggaguucgagggcaagacccucgucuccgucaccaaggagggccucgagcuccccgaggacgaggaggagaagaagaagcaggaggagaagaagaccaaguucgagaaccucugcaagaucaugaaggacauccucgagaagaaggucgagaaggucgucgucuccaaccgccucgucaccucccccugcugcaucgucaccuccaccuacggcuggaccgccaacauggagcgcaucaugaaggcccaggcccuccgcgacaacuccaccaugggcuacauggccgccaagaagcaccucgagaucaaccccgaccacuccaucaucgagacccuccgccagaaggccgaggccgacaagaacgacaaguccgucaaggaccucgucauccuccucuacgagaccgcccuccucuccuccggcuucucccucgaggacccccagacccacgccaaccgcaucuaccgcaugaucaagcucggccucggcaucgacgaggacgaccccaccgccgacgacaccuccgccgccgucaccgaggagaugcccccccucgagggcgacgacgacaccucccgcauggaggaggucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1636 - RNA, 556 nt, Artificial Sequence
  mRNA product Design1 comprising derived and/or modified sequence from Homo sapiens__NG_005218__HsHSP90AA3P (opt2)
gggagaaagcuuaccauggacuccuccaagcucgacuccggcaagggccuccacaucaaccucguccccaacaagcagaaccagacccucaccaucgucgacacccgcaucggcaugaccaagaccgaccucaucaacaaccucggcaccgucaccaaguccggcaccaaggccuucauggaggcccuccaggccgacgccgacaucuccaugaucggccacuucggcgucggcuucuacuccgccuaccucgucgccaagaaggucaccgucaucuccaagcacaacaacgacgagcaguacaccugggaguccuccgccggcggcuccuucaccguccgcaccgacgagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1637 - RNA, 2392 nt, Artificial Sequence
  mRNA product Design1 comprising derived and/or modified sequence from Homo sapiens__NP_031381.2__HsHSP90AB1 (opt2)
gggagaaagcuuaccaugcccgaggagguccaccacggcgaggaggaggucgagaccuucgccuuccaggccgagaucgcccagcucaugucccucaucaucaacaccuucuacuccaacaaggagaucuuccuccgcgagcucaucuccaacgccuccgacgcccucgacaagauccgcuacgagucccucaccgaccccuccaagcucgacuccggcaaggagcucaagaucgacaucauccccaacccccaggagcgcacccucacccucgucgacaccggcaucggcaugaccaaggccgaccucaucaacaaccucggcaccaucgccaaguccggcaccaaggccuucauggaggcccuccaggccggcgccgacaucuccaugaucggccaguucggcgucggcuucuacuccgccuaccucgucgccgagaaggucgucgucaucaccaagcacaacgacgacgagcaguacgccugggaguccuccgccggcggcuccuucaccguccgcgccgaccacggcgagcccaucggccgcggcaccaaggucauccuccaccucaaggaggaccagaccgaguaccucgaggagcgccgcgucaaggaggucgucaagaagcacucccaguucaucggcuaccccaucacccucuaccucgagaaggagcgcgagaaggagaucuccgacgacgaggccgaggaggagaagggcgagaaggaggaggaggacaaggacgacgaggagaagcccaagaucgaggacgucggcuccgacgaggaggacgacuccggcaaggacaagaagaagaagaccaagaagaucaaggagaaguacaucgaccaggaggagcucaacaagaccaagcccaucuggacccgcaaccccgacgacaucacccaggaggaguacggcgaguucuacaagucccucaccaacgacugggaggaccaccucgccgucaagcacuucuccgucgagggccagcucgaguuccgcgcccuccucuucaucccccgccgcgcccccuucgaccucuucgagaacaagaagaagaagaacaacaucaagcucuacguccgccgcgucuucaucauggacuccugcgacgagcucauccccgaguaccucaacuucauccgcggcgucgucgacuccgaggaccucccccucaacaucucccgcgagaugcuccagcaguccaagauccucaaggucauccgcaagaacaucgucaagaagugccucgagcucuucuccgagcucgccgaggacaaggagaacuacaagaaguucuacgaggccuucuccaagaaccucaagcucggcauccacgaggacuccaccaaccgccgccgccucuccgagcuccuccgcuaccacaccucccaguccggcgacgagaugaccucccucuccgaguacgucucccgcaugaaggagacccagaaguccaucuacuacaucaccggcgaguccaaggagcaggucgccaacuccgccuucgucgagcgcguccgcaagcgcggcuucgaggucgucuacaugaccgagcccaucgacgaguacugcguccagcagcucaaggaguucgacggcaagucccucgucuccgucaccaaggagggccucgagcuccccgaggacgaggaggagaagaagaagauggaggaguccaaggccaaguucgagaaccucugcaagcucaugaaggagauccucgacaagaaggucgagaaggucaccaucuccaaccgccucgucuccucccccugcugcaucgucaccuccaccuacggcuggaccgccaacauggagcgcaucaugaaggcccaggcccuccgcgacaacuccaccaugggcuacaugauggccaagaagcaccucgagaucaaccccgaccaccccaucgucgagacccuccgccagaaggccgaggccgacaagaacgacaaggccgucaaggaccucgucguccuccucuucgagaccgcccuccucuccuccggcuucucccucgaggacccccagacccacuccaaccgcaucuaccgcaugaucaagcucggccucggcaucgacgaggacgaggucgccgccgaggagcccaacgccgccguccccgacgagauccccccccucgagggcgacgaggacgccucccgcauggaggaggucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1638 - RNA, 2629 nt, Artificial Sequence
  mRNA product Design1 comprising derived and/or modified sequence from Homo sapiens__NP_003290.1__HsHSP90B1 (opt2)
gggagaaagcuuaccaugcgcgcccucuggguccucggccucugcugcguccuccucaccuucggcuccguccgcgccgacgacgaggucgacgucgacggcaccgucgaggaggaccucggcaagucccgcgagggcucccgcaccgacgacgaggucguccagcgcgaggaggaggccauccagcucgacggccucaacgccucccagauccgcgagcuccgcgagaaguccgagaaguucgccuuccaggccgaggucaaccgcaugaugaagcucaucaucaacucccucuacaagaacaaggagaucuuccuccgcgagcucaucuccaacgccuccgacgcccucgacaagauccgccucaucucccucaccgacgagaacgcccucuccggcaacgaggagcucaccgucaagaucaagugcgacaaggagaagaaccuccuccacgucaccgacaccggcgucggcaugacccgcgaggagcucgucaagaaccucggcaccaucgccaaguccggcaccuccgaguuccucaacaagaugaccgaggcccaggaggacggccaguccaccuccgagcucaucggccaguucggcgucggcuucuacuccgccuuccucgucgccgacaaggucaucgucaccuccaagcacaacaacgacacccagcacaucugggaguccgacuccaacgaguucuccgucaucgccgacccccgcggcaacacccucggccgcggcaccaccaucacccucguccucaaggaggaggccuccgacuaccucgagcucgacaccaucaagaaccucgucaagaaguacucccaguucaucaacuuccccaucuacgucugguccuccaagaccgagaccgucgaggagcccauggaggaggaggaggccgccaaggaggagaaggaggaguccgacgacgaggccgccgucgaggaggaggaggaggagaagaagcccaagaccaagaaggucgagaagaccgucugggacugggagcucaugaacgacaucaagcccaucuggcagcgccccuccaaggaggucgaggaggacgaguacaaggccuucuacaaguccuucuccaaggaguccgacgaccccauggccuacauccacuucaccgccgagggcgaggucaccuucaaguccauccucuucguccccaccuccgccccccgcggccucuucgacgaguacggcuccaagaaguccgacuacaucaagcucuacguccgccgcgucuucaucaccgacgacuuccacgacaugaugcccaaguaccucaacuucgucaagggcgucgucgacuccgacgaccucccccucaacgucucccgcgagacccuccagcagcacaagcuccucaaggucauccgcaagaagcucguccgcaagacccucgacaugaucaagaagaucgccgacgacaaguacaacgacaccuucuggaaggaguucggcaccaacaucaagcucggcgucaucgaggaccacuccaaccgcacccgccucgccaagcuccuccgcuuccaguccucccaccaccccaccgacaucaccucccucgaccaguacgucgagcgcaugaaggagaagcaggacaagaucuacuucauggccggcuccucccgcaaggaggccgaguccucccccuucgucgagcgccuccucaagaagggcuacgaggucaucuaccucaccgagcccgucgacgaguacugcauccaggcccuccccgaguucgacggcaagcgcuuccagaacgucgccaaggagggcgucaaguucgacgaguccgagaagaccaaggagucccgcgaggccgucgagaaggaguucgagccccuccucaacuggaugaaggacaaggcccucaaggacaagaucgagaaggccgucgucucccagcgccucaccgagucccccugcgcccucgucgccucccaguacggcugguccggcaacauggagcgcaucaugaaggcccaggccuaccagaccggcaaggacaucuccaccaacuacuacgccucccagaagaagaccuucgagaucaacccccgccacccccucauccgcgacaugcuccgccgcaucaaggaggacgaggacgacaagaccguccucgaccucgccgucguccucuucgagaccgccacccuccgcuccggcuaccuccuccccgacaccaaggccuacggcgaccgcaucgagcgcaugcuccgccucucccucaacaucgaccccgacgccaaggucgaggaggagcccgaggaggagcccgaggagaccgccgaggacaccaccgaggacaccgagcaggacgaggacgaggagauggacgucggcaccgacgaggaggaggagaccgccaaggaguccaccgccgagaaggacgagcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1639 - RNA, 2332 nt, Artificial Sequence
  mRNA product Design1 comprising derived and/or modified sequence from Homo sapiens__NP_057376.2__HsTRAP1 (opt2)
gggagaaagcuuaccauggcccgcgagcuccgcgcccuccuccucuggggccgccgccuccgcccccuccuccgcgcccccgcccucgccgccguccccggcggcaagcccauccucugcccccgccgcaccaccgcccagcucggcccccgccgcaaccccgccuggucccuccaggccggccgccucuucuccacccagaccgccgaggacaaggaggagccccuccacuccaucaucuccuccaccgaguccguccagggcuccaccuccaagcacgaguuccaggccgagaccaagaagcuccucgacaucgucgcccgcucccucuacuccgagaaggaggucuucauccgcgagcucaucuccaacgccuccgacgcccucgagaagcuccgccacaagcucgucuccgacggccaggcccuccccgagauggagauccaccuccagaccaacgccgagaagggcaccaucaccauccaggacaccggcaucggcaugacccaggaggagcucgucuccaaccucggcaccaucgcccgcuccggcuccaaggccuuccucgacgcccuccagaaccaggccgaggccuccuccaagaucaucggccaguucggcgucggcuucuacuccgccuucauggucgccgaccgcgucgaggucuacucccgcuccgccgcccccggcucccucggcuaccaguggcucuccgacggcuccggcgucuucgagaucgccgaggccuccggcguccgcaccggcaccaagaucaucauccaccucaaguccgacugcaaggaguucuccuccgaggcccgcguccgcgacgucgucaccaaguacuccaacuucgucuccuucccccucuaccucaacggccgccgcaugaacacccuccaggccaucuggaugauggaccccaaggacguccgcgaguggcagcacgaggaguucuaccgcuacgucgcccaggcccacgacaagccccgcuacacccuccacuacaagaccgacgccccccucaacauccgcuccaucuucuacguccccgacaugaagcccuccauguucgacgucucccgcgagcucggcuccuccgucgcccucuacucccgcaagguccucauccagaccaaggccaccgacauccuccccaaguggcuccgcuucauccgcggcgucgucgacuccgaggacaucccccucaaccucucccgcgagcuccuccaggaguccgcccucauccgcaagcuccgcgacguccuccagcagcgccucaucaaguucuucaucgaccaguccaagaaggacgccgagaaguacgccaaguucuucgaggacuacggccucuucaugcgcgagggcaucgucaccgccaccgagcaggaggucaaggaggacaucgccaagcuccuccgcuacgaguccuccgcccuccccuccggccagcucaccucccucuccgaguacgccucccgcaugcgcgccggcacccgcaacaucuacuaccucugcgcccccaaccgccaccucgccgagcacucccccuacuacgaggccaugaagaagaaggacaccgagguccucuucugcuucgagcaguucgacgagcucacccuccuccaccuccgcgaguucgacaagaagaagcucaucuccgucgagaccgacaucgucgucgaccacuacaaggaggagaaguucgaggaccgcucccccgccgccgagugccucuccgagaaggagaccgaggagcucauggccuggaugcgcaacguccucggcucccgcgucaccaacgucaaggucacccuccgccucgacacccaccccgccauggucaccguccucgagaugggcgccgcccgccacuuccuccgcaugcagcagcucgccaagacccaggaggagcgcgcccagcuccuccagcccacccucgagaucaacccccgccacgcccucaucaagaagcucaaccagcuccgcgccuccgagcccggccucgcccagcuccucgucgaccagaucuacgagaacgccaugaucgccgccggccucgucgacgacccccgcgccauggucggccgccucaacgagcuccucgucaaggcccucgagcgccacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1640 - RNA, 679 nt, Artificial Sequence
  mRNA product Design1 comprising derived and/or modified sequence from Homo sapiens__NP_000609.1__HsIGF1 (opt2)
gggagaaagcuuaccaugggcaagaucuccucccuccccacccagcucuucaagugcugcuucugcgacuuccucaaggucaagaugcacaccauguccuccucccaccucuucuaccucgcccucugccuccucaccuucaccuccuccgccaccgccggccccgagacccucugcggcgccgagcucgucgacgcccuccaguucgucugcggcgaccgcggcuucuacuucaacaagcccaccggcuacggcuccuccucccgccgcgccccccagaccggcaucgucgacgagugcugcuuccgcuccugcgaccuccgccgccucgagauguacugcgccccccucaagcccgccaaguccgcccgcuccguccgcgcccagcgccacaccgacaugcccaagacccagaaggagguccaccucaagaacgccucccgcggcuccgccggcaacaagaacuaccgcaugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1641 - RNA, 760 nt, Artificial Sequence
  mRNA product Design1 comprising derived and/or modified sequence from Homo sapiens__NP_000603.1__HsIGF2 (opt2)
gggagaaagcuuaccaugggcauccccaugggcaaguccaugcucguccuccucaccuuccucgccuucgccuccugcugcaucgccgccuaccgccccuccgagacccucugcggcggcgagcucgucgacacccuccaguucgucugcggcgaccgcggcuucuacuucucccgccccgccucccgcgucucccgccgcucccgcggcaucgucgaggagugcugcuuccgcuccugcgaccucgcccuccucgagaccuacugcgccacccccgccaaguccgagcgcgacgucuccaccccccccaccguccuccccgacaacuucccccgcuaccccgucggcaaguucuuccaguacgacaccuggaagcaguccacccagcgccuccgccgcggccuccccgcccuccuccgcgcccgccgcggccacguccucgccaaggagcucgaggccuuccgcgaggccaagcgccaccgcccccucaucgcccuccccacccaggaccccgcccacggcggcgccccccccgagauggccuccaaccgcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1642 - RNA, 856 nt, Artificial Sequence
  mRNA product Design1 comprising derived and/or modified sequence from Homo sapiens__NP_000591.1__HsIL6 (opt2)
gggagaaagcuuaccaugaacuccuucuccaccuccgccuucggccccgucgccuucucccucggccuccuccucguccuccccgccgccuuccccgcccccgucccccccggcgaggacuccaaggacgucgccgccccccaccgccagccccucaccuccuccgagcgcaucgacaagcagauccgcuacauccucgacggcaucuccgcccuccgcaaggagaccugcaacaaguccaacaugugcgaguccuccaaggaggcccucgccgagaacaaccucaaccuccccaagauggccgagaaggacggcugcuuccaguccggcuucaacgaggagaccugccucgucaagaucaucaccggccuccucgaguucgaggucuaccucgaguaccuccagaaccgcuucgaguccuccgaggagcaggcccgcgccguccagauguccaccaagguccucauccaguuccuccagaagaaggccaagaaccucgacgccaucaccacccccgaccccaccaccaacgccucccuccucaccaagcuccaggcccagaaccaguggcuccaggacaugaccacccaccucauccuccgcuccuucaaggaguuccuccaguccucccuccgcgcccuccgccagaugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1643 - RNA, 1498 nt, Artificial Sequence
  mRNA product Design1 comprising derived and/or modified sequence from Homo sapiens__NP_002183.1__HsINHBA (opt2)
gggagaaagcuuaccaugccccuccucuggcuccgcggcuuccuccucgccuccugcuggaucaucguccgcuccucccccacccccggcuccgagggccacuccgccgcccccgacugccccuccugcgcccucgccgcccuccccaaggacguccccaacucccagcccgagauggucgaggccgucaagaagcacauccucaacaugcuccaccucaagaagcgccccgacgucacccagcccguccccaaggccgcccuccucaacgccauccgcaagcuccacgucggcaaggucggcgagaacggcuacgucgagaucgaggacgacaucggccgccgcgccgagaugaacgagcucauggagcagaccuccgagaucaucaccuucgccgaguccggcaccgcccgcaagacccuccacuucgagaucuccaaggagggcuccgaccucuccgucgucgagcgcgccgaggucuggcucuuccucaagguccccaaggccaaccgcacccgcaccaaggucaccauccgccucuuccagcagcagaagcacccccagggcucccucgacaccggcgaggaggccgaggaggucggccucaagggcgagcgcuccgagcuccuccucuccgagaaggucgucgacgcccgcaaguccaccuggcacgucuuccccgucuccuccuccauccagcgccuccucgaccagggcaaguccucccucgacguccgcaucgccugcgagcagugccaggaguccggcgccucccucguccuccucggcaagaagaagaagaaggaggaggagggcgagggcaagaagaagggcggcggcgagggcggcgccggcgccgacgaggagaaggagcagucccaccgccccuuccucaugcuccaggcccgccaguccgaggaccacccccaccgccgccgccgccgcggccucgagugcgacggcaaggucaacaucugcugcaagaagcaguucuucgucuccuucaaggacaucggcuggaacgacuggaucaucgcccccuccggcuaccacgccaacuacugcgagggcgagugccccucccacaucgccggcaccuccggcuccucccucuccuuccacuccaccgucaucaaccacuaccgcaugcgcggccacucccccuucgccaaccucaaguccugcugcguccccaccaagcuccgccccauguccaugcucuacuacgacgacggccagaacaucaucaagaaggacauccagaacaugaucgucgaggagugcggcugcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1644 - RNA, 1441 nt, Artificial Sequence
  mRNA product Design1 comprising derived and/or modified sequence from Homo sapiens__NP_002184.2__HsINHBB (opt2)
gggagaaagcuuaccauggacggccuccccggccgcgcccucggcgccgccugccuccuccuccucgccgccggcuggcucggccccgaggccuggggcucccccacccccccccccacccccgccgcccccccccccccccccccccccggcucccccggcggcucccaggacaccugcaccuccugcggcggcuuccgccgccccgaggagcucggccgcgucgacggcgacuuccucgaggccgucaagcgccacauccucucccgccuccagaugcgcggccgccccaacaucacccacgccguccccaaggccgccauggucaccgcccuccgcaagcuccacgccggcaagguccgcgaggacggccgcgucgagaucccccaccucgacggccacgccucccccggcgccgacggccaggagcgcgucuccgagaucaucuccuucgccgagaccgacggccucgccuccucccgcguccgccucuacuucuucaucuccaacgagggcaaccagaaccucuucgucguccaggccucccucuggcucuaccucaagcuccuccccuacguccucgagaagggcucccgccgcaagguccgcgucaaggucuacuuccaggagcagggccacggcgaccgcuggaacauggucgagaagcgcgucgaccucaagcgcuccggcuggcacaccuucccccucaccgaggccauccaggcccucuucgagcgcggcgagcgccgccucaaccucgacguccagugcgacuccugccaggagcucgccgucguccccgucuucgucgaccccggcgaggagucccaccgccccuucgucgucguccaggcccgccucggcgacucccgccaccgcauccgcaagcgcggccucgagugcgacggccgcaccaaccucugcugccgccagcaguucuucaucgacuuccgccucaucggcuggaacgacuggaucaucgcccccaccggcuacuacggcaacuacugcgagggcuccugccccgccuaccucgccggcguccccggcuccgccuccuccuuccacaccgccgucgucaaccaguaccgcaugcgcggccucaaccccggcaccgucaacuccugcugcauccccaccaagcucuccaccauguccaugcucuacuucgacgacgaguacaacaucgucaagcgcgacguccccaacaugaucgucgaggagugcggcugcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1645 - RNA, 3676 nt, Artificial Sequence
  mRNA product Design1 comprising derived and/or modified sequence from Homo sapiens__NP_000623.2__HsITGAM (opt2)
gggagaaagcuuaccauggcccuccgcguccuccuccucaccgcccucacccucugccacggcuucaaccucgacaccgagaacgccaugaccuuccaggagaacgcccgcggcuucggccaguccgucguccagcuccagggcucccgcgucgucgucggcgccccccaggagaucgucgccgccaaccagcgcggcucccucuaccagugcgacuacuccaccggcuccugcgagcccauccgccuccagguccccgucgaggccgucaacaugucccucggccucucccucgccgccaccaccucccccccccagcuccucgccugcggccccaccguccaccagaccugcuccgagaacaccuacgucaagggccucugcuuccucuucggcuccaaccuccgccagcagccccagaaguuccccgaggcccuccgcggcugcccccaggaggacuccgacaucgccuuccucaucgacggcuccggcuccaucaucccccacgacuuccgccgcaugaaggaguucgucuccaccgucauggagcagcucaagaaguccaagacccucuucucccucaugcaguacuccgaggaguuccgcauccacuucaccuucaaggaguuccagaacaaccccaacccccgcucccucgucaagcccaucacccagcuccucggccgcacccacaccgccaccggcauccgcaaggucguccgcgagcucuucaacaucaccaacggcgcccgcaagaacgccuucaagauccucgucgucaucaccgacggcgagaaguucggcgacccccucggcuacgaggacgucauccccgaggccgaccgcgagggcgucauccgcuacgucaucggcgucggcgacgccuuccgcuccgagaagucccgccaggagcucaacaccaucgccuccaagcccccccgcgaccacgucuuccaggucaacaacuucgaggcccucaagaccauccagaaccagcuccgcgagaagaucuucgccaucgagggcacccagaccggcuccuccuccuccuucgagcacgagaugucccaggagggcuucuccgccgccaucaccuccaacggcccccuccucuccaccgucggcuccuacgacugggccggcggcgucuuccucuacaccuccaaggagaaguccaccuucaucaacaugacccgcgucgacuccgacaugaacgacgccuaccucggcuacgccgccgccaucauccuccgcaaccgcguccagucccucguccucggcgccccccgcuaccagcacaucggccucgucgccauguuccgccagaacaccggcaugugggaguccaacgccaacgucaagggcacccagaucggcgccuacuucggcgccucccucugcuccgucgacgucgacuccaacggcuccaccgaccucguccucaucggcgccccccacuacuacgagcagacccgcggcggccaggucuccgucugcccccucccccgcggccgcgcccgcuggcagugcgacgccguccucuacggcgagcagggccagcccuggggccgcuucggcgccgcccucaccguccucggcgacgucaacggcgacaagcucaccgacgucgccaucggcgcccccggcgaggaggacaaccgcggcgccgucuaccucuuccacggcaccuccggcuccggcaucucccccucccacucccagcgcaucgccggcuccaagcucuccccccgccuccaguacuucggccagucccucuccggcggccaggaccucaccauggacggccucgucgaccucaccgucggcgcccagggccacguccuccuccuccgcucccagcccguccuccgcgucaaggccaucauggaguucaacccccgcgaggucgcccgcaacgucuucgagugcaacgaccaggucgucaagggcaaggaggccggcgagguccgcgucugccuccacguccagaaguccacccgcgaccgccuccgcgagggccagauccaguccgucgucaccuacgaccucgcccucgacuccggccgcccccacucccgcgccgucuucaacgagaccaagaacuccacccgccgccagacccagguccucggccucacccagaccugcgagacccucaagcuccagcuccccaacugcaucgaggaccccgucucccccaucguccuccgccucaacuucucccucgucggcaccccccucuccgccuucggcaaccuccgccccguccucgccgaggacgcccagcgccucuucaccgcccucuuccccuucgagaagaacugcggcaacgacaacaucugccaggacgaccucuccaucaccuucuccuucaugucccucgacugccucgucgucggcggcccccgcgaguucaacgucaccgucaccguccgcaacgacggcgaggacuccuaccgcacccaggucaccuucuucuucccccucgaccucuccuaccgcaaggucuccacccuccagaaccagcgcucccagcgcuccuggcgccucgccugcgaguccgccuccuccaccgaggucuccggcgcccucaaguccaccuccugcuccaucaaccaccccaucuuccccgagaacuccgaggucaccuucaacaucaccuucgacgucgacuccaaggccucccucggcaacaagcuccuccucaaggccaacgucaccuccgagaacaacaugccccgcaccaacaagaccgaguuccagcucgagcuccccgucaaguacgccgucuacauggucgucaccucccacggcgucuccaccaaguaccucaacuucaccgccuccgagaacaccucccgcgucaugcagcaccaguaccaggucuccaaccucggccagcgcucccuccccaucucccucgucuuccucguccccguccgccucaaccagaccgucaucugggaccgcccccaggucaccuucuccgagaaccucuccuccaccugccacaccaaggagcgccuccccucccacuccgacuuccucgccgagcuccgcaaggcccccgucgucaacugcuccaucgccgucugccagcgcauccagugcgacauccccuucuucggcauccaggaggaguucaacgccacccucaagggcaaccucuccuucgacugguacaucaagaccucccacaaccaccuccucaucgucuccaccgccgagauccucuucaacgacuccgucuucacccuccuccccggccagggcgccuucguccgcucccagaccgagaccaaggucgagcccuucgagguccccaacccccucccccucaucgucggcuccuccgucggcggccuccuccuccucgcccucaucaccgccgcccucuacaagcucggcuucuucaagcgccaguacaaggacaugauguccgagggcggcccccccggcgccgagccccagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1646 - RNA, 1621 nt, Artificial Sequence
  mRNA product Design1 comprising derived and/or modified sequence from Homo sapiens__NP_002415.1__HsMMP8 (opt2)
gggagaaagcuuaccauguucucccucaagacccuccccuuccuccuccuccuccacguccagaucuccaaggccuuccccgucuccuccaaggagaagaacaccaagaccguccaggacuaccucgagaaguucuaccagcuccccuccaaccaguaccaguccacccgcaagaacggcaccaacgucaucgucgagaagcucaaggagaugcagcgcuucuucggccucaacgucaccggcaagcccaacgaggagacccucgacaugaugaagaagccccgcugcggcguccccgacuccggcggcuucaugcucacccccggcaaccccaagugggagcgcaccaaccucaccuaccgcauccgcaacuacaccccccagcucuccgaggccgaggucgagcgcgccaucaaggacgccuucgagcucugguccgucgccuccccccucaucuucacccgcaucucccagggcgaggccgacaucaacaucgccuucuaccagcgcgaccacggcgacaacucccccuucgacggccccaacggcauccucgcccacgccuuccagcccggccagggcaucggcggcgacgcccacuucgacgccgaggagaccuggaccaacaccuccgccaacuacaaccucuuccucgucgccgcccacgaguucggccacucccucggccucgcccacuccuccgaccccggcgcccucauguaccccaacuacgccuuccgcgagaccuccaacuacucccucccccaggacgacaucgacggcauccaggccaucuacggccucuccuccaaccccauccagcccaccggccccuccacccccaagcccugcgaccccucccucaccuucgacgccaucaccacccuccgcggcgagauccucuucuucaaggaccgcuacuucuggcgccgccacccccagcuccagcgcgucgagaugaacuucaucucccucuucuggcccucccuccccaccggcauccaggccgccuacgaggacuucgaccgcgaccucaucuuccucuucaagggcaaccaguacugggcccucuccggcuacgacauccuccagggcuaccccaaggacaucuccaacuacggcuuccccuccuccguccaggccaucgacgccgccgucuucuaccgcuccaagaccuacuucuucgucaacgaccaguucuggcgcuacgacaaccagcgccaguucauggagcccggcuaccccaaguccaucuccggcgccuuccccggcaucgaguccaaggucgacgccgucuuccagcaggagcacuucuuccacgucuucuccggcccccgcuacuacgccuucgaccucaucgcccagcgcgucacccgcgucgcccgcggcaacaaguggcucaacugccgcuacggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1647 - RNA, 2341 nt, Artificial Sequence
  mRNA product Design1 comprising derived and/or modified sequence from Homo sapiens__NP_004985.2__HsMMP9 (opt2)
gggagaaagcuuaccaugucccucuggcagccccucguccucguccuccucguccucggcugcugcuucgccgccccccgccagcgccaguccacccucguccucuuccccggcgaccuccgcaccaaccucaccgaccgccagcucgccgaggaguaccucuaccgcuacggcuacacccgcgucgccgagaugcgcggcgaguccaagucccucggccccgcccuccuccuccuccagaagcagcucucccuccccgagaccggcgagcucgacuccgccacccucaaggccaugcgcaccccccgcugcggcguccccgaccucggccgcuuccagaccuucgagggcgaccucaaguggcaccaccacaacaucaccuacuggauccagaacuacuccgaggaccucccccgcgccgucaucgacgacgccuucgcccgcgccuucgcccucugguccgccgucaccccccucaccuucacccgcgucuacucccgcgacgccgacaucgucauccaguucggcgucgccgagcacggcgacggcuaccccuucgacggcaaggacggccuccucgcccacgccuucccccccggccccggcauccagggcgacgcccacuucgacgacgacgagcucuggucccucggcaagggcgucgucguccccacccgcuucggcaacgccgacggcgccgccugccacuuccccuucaucuucgagggccgcuccuacuccgccugcaccaccgacggccgcuccgacggccuccccuggugcuccaccaccgccaacuacgacaccgacgaccgcuucggcuucugccccuccgagcgccucuacacccaggacggcaacgccgacggcaagcccugccaguuccccuucaucuuccagggccaguccuacuccgccugcaccaccgacggccgcuccgacggcuaccgcuggugcgccaccaccgccaacuacgaccgcgacaagcucuucggcuucugccccacccgcgccgacuccaccgucaugggcggcaacuccgccggcgagcucugcgucuuccccuucaccuuccucggcaaggaguacuccaccugcaccuccgagggccgcggcgacggccgccucuggugcgccaccaccuccaacuucgacuccgacaagaaguggggcuucugccccgaccagggcuacucccucuuccucgucgccgcccacgaguucggccacgcccucggccucgaccacuccuccguccccgaggcccucauguaccccauguaccgcuucaccgagggccccccccuccacaaggacgacgucaacggcauccgccaccucuacggcccccgccccgagcccgagccccgcccccccaccaccaccaccccccagcccaccgccccccccaccgucugccccaccggcccccccaccguccaccccuccgagcgccccaccgccggccccaccggcccccccuccgccggccccaccggcccccccaccgccggccccuccaccgccaccaccgucccccucucccccgucgacgacgccugcaacgucaacaucuucgacgccaucgccgagaucggcaaccagcucuaccucuucaaggacggcaaguacuggcgcuucuccgagggccgcggcucccgcccccagggccccuuccucaucgccgacaaguggcccgcccucccccgcaagcucgacuccgucuucgaggagcgccucuccaagaagcucuucuucuucuccggccgccaggucugggucuacaccggcgccuccguccucggcccccgccgccucgacaagcucggccucggcgccgacgucgcccaggucaccggcgcccuccgcuccggccgcggcaagaugcuccucuucuccggccgccgccucuggcgcuucgacgucaaggcccagauggucgacccccgcuccgccuccgaggucgaccgcauguuccccggcgucccccucgacacccacgacgucuuccaguaccgcgagaaggccuacuucugccaggaccgcuucuacuggcgcgucuccucccgcuccgagcucaaccaggucgaccaggucggcuacgucaccuacgacauccuccagugccccgaggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1648 - RNA, 1633 nt, Artificial Sequence
  mRNA product Design1 comprising derived and/or modified sequence from Homo sapiens__NP_002418.1__HsMMP13 (opt2)
gggagaaagcuuaccaugcaccccggcguccucgccgccuuccucuuccucuccuggacccacugccgcgcccucccccuccccuccggcggcgacgaggacgaccucuccgaggaggaccuccaguucgccgagcgcuaccuccgcuccuacuaccaccccaccaaccucgccggcauccucaaggagaacgccgccuccuccaugaccgagcgccuccgcgagaugcaguccuucuucggccucgaggucaccggcaagcucgacgacaacacccucgacgucaugaagaagccccgcugcggcguccccgacgucggcgaguacaacgucuucccccgcacccucaagugguccaagaugaaccucaccuaccgcaucgucaacuacacccccgacaugacccacuccgaggucgagaaggccuucaagaaggccuucaaggucugguccgacgucaccccccucaacuucacccgccuccacgacggcaucgccgacaucaugaucuccuucggcaucaaggagcacggcgacuucuaccccuucgacggccccuccggccuccucgcccacgccuucccccccggccccaacuacggcggcgacgcccacuucgacgacgacgagaccuggaccuccuccuccaagggcuacaaccucuuccucgucgccgcccacgaguucggccacucccucggccucgaccacuccaaggaccccggcgcccucauguuccccaucuacaccuacaccggcaagucccacuucaugcuccccgacgacgacguccagggcauccagucccucuacggccccggcgacgaggaccccaaccccaagcaccccaagacccccgacaagugcgaccccucccucucccucgacgccaucaccucccuccgcggcgagaccaugaucuucaaggaccgcuucuucuggcgccuccacccccagcaggucgacgccgagcucuuccucaccaaguccuucuggcccgagcuccccaaccgcaucgacgccgccuacgagcaccccucccacgaccucaucuucaucuuccgcggccgcaaguucugggcccucaacggcuacgacauccucgagggcuaccccaagaagaucuccgagcucggccuccccaaggaggucaagaagaucuccgccgccguccacuucgaggacaccggcaagacccuccucuucuccggcaaccaggucuggcgcuacgacgacaccaaccacaucauggacaaggacuacccccgccucaucgaggaggacuuccccggcaucggcgacaaggucgacgccgucuacgagaagaacggcuacaucuacuucuucaacggccccauccaguucgaguacuccaucugguccaaccgcaucguccgcgucaugcccgccaacuccauccucuggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1649 - RNA, 1285 nt, Artificial Sequence
  mRNA product Design1 comprising derived and/or modified sequence from Homo sapiens__NP_001286.1__HsCCR1 (opt2)
gggagaaagcuuaccauggagacccccaacaccaccgaggacuacgacaccaccaccgaguucgacuacggcgacgccacccccugccagaaggucaacgagcgcgccuucggcgcccagcuccuccccccccucuacucccucgucuucgucaucggccucgucggcaacauccucgucguccucguccucguccaguacaagcgccucaagaacaugaccuccaucuaccuccucaaccucgccaucuccgaccuccucuuccucuucacccuccccuucuggaucgacuacaagcucaaggacgacugggucuucggcgacgccaugugcaagauccucuccggcuucuacuacaccggccucuacuccgagaucuucuucaucauccuccucaccaucgaccgcuaccucgccaucguccacgccgucuucgcccuccgcgcccgcaccgucaccuucggcgucaucaccuccaucaucaucugggcccucgccauccucgccuccaugcccggccucuacuucuccaagacccagugggaguucacccaccacaccugcucccuccacuucccccacgagucccuccgcgaguggaagcucuuccaggcccucaagcucaaccucuucggccucguccucccccuccucgucaugaucaucugcuacaccggcaucaucaagauccuccuccgccgccccaacgagaagaaguccaaggccguccgccucaucuucgucaucaugaucaucuucuuccucuucuggacccccuacaaccucaccauccucaucuccgucuuccaggacuuccucuucacccacgagugcgagcagucccgccaccucgaccucgccguccaggucaccgaggucaucgccuacacccacugcugcgucaaccccgucaucuacgccuucgucggcgagcgcuuccgcaaguaccuccgccagcucuuccaccgccgcgucgccguccaccucgucaaguggcuccccuuccucuccgucgaccgccucgagcgcgucuccuccaccucccccuccaccggcgagcacgagcucuccgccggcuucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1650 - RNA, 853 nt, Artificial Sequence
  mRNA product Design1 comprising derived and/or modified sequence from Homo sapiens__NP_002598.4__HsPDGFA (opt2)
gggagaaagcuuaccaugcgcacccucgccugccuccuccuccucggcugcggcuaccucgcccacguccucgccgaggaggccgagaucccccgcgaggucaucgagcgccucgcccgcucccagauccacuccauccgcgaccuccagcgccuccucgagaucgacuccgucggcuccgaggacucccucgacaccucccuccgcgcccacggcguccacgccaccaagcacguccccgagaagcgcccccuccccauccgccgcaagcgcuccaucgaggaggccguccccgccgucugcaagacccgcaccgucaucuacgagaucccccgcucccaggucgaccccaccuccgccaacuuccucaucuggccccccugcgucgaggucaagcgcugcaccggcugcugcaacaccuccuccgucaagugccagcccucccgcguccaccaccgcuccgucaaggucgccaaggucgaguacguccgcaagaagcccaagcucaaggagguccagguccgccucgaggagcaccucgagugcgccugcgccaccaccucccucaaccccgacuaccgcgaggaggacaccggccgcccccgcgaguccggcaagaagcgcaagcgcaagcgccucaagcccaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1651 - RNA, 943 nt, Artificial Sequence
  mRNA product Design1 comprising derived and/or modified sequence from Homo sapiens__NP_002599.1__HsPDGFB (opt2)
gggagaaagcuuaccaugaaccgcugcugggcccucuuccucucccucugcugcuaccuccgccucgucuccgccgagggcgaccccauccccgaggagcucuacgagaugcucuccgaccacuccauccgcuccuucgacgaccuccagcgccuccuccacggcgaccccggcgaggaggacggcgccgagcucgaccucaacaugacccgcucccacuccggcggcgagcucgagucccucgcccgcggccgccgcucccucggcucccucaccaucgccgagcccgccaugaucgccgagugcaagacccgcaccgaggucuucgagaucucccgccgccucaucgaccgcaccaacgccaacuuccucgucuggccccccugcgucgagguccagcgcugcuccggcugcugcaacaaccgcaacguccagugccgccccacccagguccagcuccgccccguccagguccgcaagaucgagaucguccgcaagaagcccaucuucaagaaggccaccgucacccucgaggaccaccucgccugcaagugcgagaccgucgccgccgcccgccccgucacccgcucccccggcggcucccaggagcagcgcgccaagaccccccagacccgcgucaccauccgcaccguccgcguccgccgcccccccaagggcaagcaccgcaaguucaagcacacccacgacaagaccgcccucaaggagacccucggcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1652 - RNA, 1255 nt, Artificial Sequence
  mRNA product Design1 comprising derived and/or modified sequence from Homo sapiens__NP_057289.1__HsPDGFC (opt2)
gggagaaagcuuaccaugucccucuucggccuccuccuccucaccuccgcccucgccggccagcgccagggcacccaggccgaguccaaccucuccuccaaguuccaguucuccuccaacaaggagcagaacggcguccaggacccccagcacgagcgcaucaucaccgucuccaccaacggcuccauccacuccccccgcuucccccacaccuacccccgcaacaccguccucgucuggcgccucgucgccgucgaggagaacgucuggauccagcucaccuucgacgagcgcuucggccucgaggaccccgaggacgacaucugcaaguacgacuucgucgaggucgaggagcccuccgacggcaccauccucggccgcuggugcggcuccggcaccguccccggcaagcagaucuccaagggcaaccagauccgcauccgcuucgucuccgacgaguacuuccccuccgagcccggcuucugcauccacuacaacaucgucaugccccaguucaccgaggccgucucccccuccguccucccccccuccgcccucccccucgaccuccucaacaacgccaucaccgccuucuccacccucgaggaccucauccgcuaccucgagcccgagcgcuggcagcucgaccucgaggaccucuaccgccccaccuggcagcuccucggcaaggccuucgucuucggccgcaagucccgcgucgucgaccucaaccuccucaccgaggagguccgccucuacuccugcaccccccgcaacuucuccgucuccauccgcgaggagcucaagcgcaccgacaccaucuucuggcccggcugccuccucgucaagcgcugcggcggcaacugcgccugcugccuccacaacugcaacgagugccagugcguccccuccaaggucaccaagaaguaccacgagguccuccagcuccgccccaagaccggcguccgcggccuccacaagucccucaccgacgucgcccucgagcaccacgaggagugcgacugcgucugccgcggcuccaccggcggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1653 - RNA, 1312 nt, Artificial Sequence
  mRNA product Design1 comprising derived and/or modified sequence from Homo sapiens__NP_149126.1__HsPDGFD (opt2)
gggagaaagcuuaccaugcaccgccucaucuucgucuacacccucaucugcgccaacuucugcuccugccgcgacaccuccgccaccccccaguccgccuccaucaaggcccuccgcaacgccaaccuccgccgcgacgaccucuaccgccgcgacgagaccauccaggucaagggcaacggcuacguccaguccccccgcuuccccaacuccuacccccgcaaccuccuccucaccuggcgccuccacucccaggagaacacccgcauccagcucgucuucgacaaccaguucggccucgaggaggccgagaacgacaucugccgcuacgacuucgucgaggucgaggacaucuccgagaccuccaccaucauccgcggccgcuggugcggccacaaggagguccccccccgcaucaagucccgcaccaaccagaucaagaucaccuucaaguccgacgacuacuucgucgccaagcccggcuucaagaucuacuacucccuccucgaggacuuccagcccgccgccgccuccgagaccaacugggaguccgucaccuccuccaucuccggcgucuccuacaacucccccuccgucaccgaccccacccucaucgccgacgcccucgacaagaagaucgccgaguucgacaccgucgaggaccuccucaaguacuucaaccccgaguccuggcaggaggaccucgagaacauguaccucgacaccccccgcuaccgcggccgcuccuaccacgaccgcaaguccaaggucgaccucgaccgccucaacgacgacgccaagcgcuacuccugcaccccccgcaacuacuccgucaacauccgcgaggagcucaagcucgccaacgucgucuucuucccccgcugccuccucguccagcgcugcggcggcaacugcggcugcggcaccgucaacuggcgcuccugcaccugcaacuccggcaagaccgucaagaaguaccacgagguccuccaguucgagcccggccacaucaagcgccgcggccgcgccaagaccauggcccucgucgacauccagcucgaccaccacgagcgcugcgacugcaucugcuccucccgccccccccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1654 - RNA, 895 nt, Artificial Sequence
  mRNA product Design1 comprising derived and/or modified sequence from Homo sapiens__NP_003946.3__HsSOCS3 (opt2)
gggagaaagcuuaccauggucacccacuccaaguuccccgccgccggcaugucccgcccccucgacaccucccuccgccucaagaccuucuccuccaaguccgaguaccagcucgucgucaacgccguccgcaagcuccaggaguccggcuucuacugguccgccgucaccggcggcgaggccaaccuccuccucuccgccgagcccgccggcaccuuccucauccgcgacuccuccgaccagcgccacuucuucacccucuccgucaagacccaguccggcaccaagaaccuccgcauccagugcgagggcggcuccuucucccuccaguccgacccccgcuccacccagcccgucccccgcuucgacugcguccucaagcucguccaccacuacaugcccccccccggcgcccccuccuuccccuccccccccaccgagcccuccuccgagguccccgagcagcccuccgcccagccccuccccggcucccccccccgccgcgccuacuacaucuacuccggcggcgagaagaucccccucguccucucccgcccccucuccuccaacgucgccacccuccagcaccucugccgcaagaccgucaacggccaccucgacuccuacgagaaggucacccagcuccccggccccauccgcgaguuccucgaccaguacgacgccccccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1655 - RNA, 700 nt, Artificial Sequence
  mRNA product Design1 comprising derived and/or modified sequence from Homo sapiens__NP_003227.1__HsTGFA (opt2)
gggagaaagcuuaccaugguccccuccgccggccagcucgcccucuucgcccucggcaucguccucgccgccugccaggcccucgagaacuccaccuccccccucuccgccgacccccccgucgccgccgccgucgucucccacuucaacgacugccccgacucccacacccaguucugcuuccacggcaccugccgcuuccucguccaggaggacaagcccgccugcgucugccacuccggcuacgucggcgcccgcugcgagcacgccgaccuccucgccgucgucgccgccucccagaagaagcaggccaucaccgcccucgucgucgucuccaucgucgcccucgccguccucaucaucaccugcguccucauccacugcugccagguccgcaagcacugcgaguggugccgcgcccucaucugccgccacgagaagcccuccgcccuccucaagggccgcaccgccugcugccacuccgagaccgucgucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1656 - RNA, 1390 nt, Artificial Sequence
  mRNA product Design1 comprising derived and/or modified sequence from Homo sapiens__NP_000651.3__HsTGFB1 (opt2)
gggagaaagcuuaccaugccccccuccggccuccgccuccucccccuccuccucccccuccucuggcuccucguccucacccccggccgccccgccgccggccucuccaccugcaagaccaucgacauggagcucgucaagcgcaagcgcaucgaggccauccgcggccagauccucuccaagcuccgccucgccuccccccccucccagggcgaggucccccccggcccccuccccgaggccguccucgcccucuacaacuccacccgcgaccgcgucgccggcgaguccgccgagcccgagcccgagcccgaggccgacuacuacgccaaggaggucacccgcguccucauggucgagacccacaacgagaucuacgacaaguucaagcaguccacccacuccaucuacauguucuucaacaccuccgagcuccgcgaggccguccccgagcccguccuccucucccgcgccgagcuccgccuccuccgccucaagcucaaggucgagcagcacgucgagcucuaccagaaguacuccaacaacuccuggcgcuaccucuccaaccgccuccucgcccccuccgacucccccgaguggcucuccuucgacgucaccggcgucguccgccaguggcucucccgcggcggcgagaucgagggcuuccgccucuccgcccacugcuccugcgacucccgcgacaacacccuccaggucgacaucaacggcuucaccaccggccgccgcggcgaccucgccaccauccacggcaugaaccgccccuuccuccuccucauggccaccccccucgagcgcgcccagcaccuccaguccucccgccaccgccgcgcccucgacaccaacuacugcuucuccuccaccgagaagaacugcugcguccgccagcucuacaucgacuuccgcaaggaccucggcuggaaguggauccacgagcccaagggcuaccacgccaacuucugccucggccccugccccuacaucuggucccucgacacccaguacuccaagguccucgcccucuacaaccagcacaaccccggcgccuccgccgcccccugcugcgucccccaggcccucgagccccuccccaucgucuacuacgucggccgcaagcccaaggucgagcagcucuccaacaugaucguccgcuccugcaagugcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1657 - RNA, 1462 nt, Artificial Sequence
  mRNA product Design1 comprising derived and/or modified sequence from Homo sapiens__NP_003229.1__HsTGFB2 (opt2)
gggagaaagcuuaccaugcacuacugcguccucuccgccuuccucauccuccaccucgucaccgucgcccucucccucuccaccugcuccacccucgacauggaccaguucaugcgcaagcgcaucgaggccauccgcggccagauccucuccaagcucaagcucaccuccccccccgaggacuaccccgagcccgaggaggucccccccgaggucaucuccaucuacaacuccacccgcgaccuccuccaggagaaggccucccgccgcgccgccgccugcgagcgcgagcgcuccgacgaggaguacuacgccaaggaggucuacaagaucgacaugccccccuucuuccccuccgagaacgccaucccccccaccuucuaccgccccuacuuccgcaucguccgcuucgacgucuccgccauggagaagaacgccuccaaccucgucaaggccgaguuccgcgucuuccgccuccagaaccccaaggcccgcguccccgagcagcgcaucgagcucuaccagauccucaaguccaaggaccucaccucccccacccagcgcuacaucgacuccaaggucgucaagacccgcgccgagggcgaguggcucuccuucgacgucaccgacgccguccacgaguggcuccaccacaaggaccgcaaccucggcuucaagaucucccuccacugccccugcugcaccuucguccccuccaacaacuacaucauccccaacaaguccgaggagcucgaggcccgcuucgccggcaucgacggcaccuccaccuacaccuccggcgaccagaagaccaucaaguccacccgcaagaagaacuccggcaagaccccccaccuccuccucaugcuccuccccuccuaccgccucgagucccagcagaccaaccgccgcaagaagcgcgcccucgacgccgccuacugcuuccgcaacguccaggacaacugcugccuccgcccccucuacaucgacuucaagcgcgaccucggcuggaaguggauccacgagcccaagggcuacaacgccaacuucugcgccggcgccugccccuaccucugguccuccgacacccagcacucccgcguccucucccucuacaacaccaucaaccccgaggccuccgccucccccugcugcgucucccaggaccucgagccccucaccauccucuacuacaucggcaagacccccaagaucgagcagcucuccaacaugaucgucaaguccugcaagugcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1658 - RNA, 1456 nt, Artificial Sequence
  mRNA product Design1 comprising derived and/or modified sequence from Homo sapiens__NP_003230.1__HsTGFB3 (opt2)
gggagaaagcuuaccaugaagaugcaccuccagcgcgcccucgucguccucgcccuccucaacuucgccaccgucucccucucccucuccaccugcaccacccucgacuucggccacaucaagaagaagcgcgucgaggccauccgcggccagauccucuccaagcuccgccucaccuccccccccgagcccaccgucaugacccacguccccuaccagguccucgcccucuacaacuccacccgcgagcuccucgaggagaugcacggcgagcgcgaggagggcugcacccaggagaacaccgaguccgaguacuacgccaaggagauccacaaguucgacaugauccagggccucgccgagcacaacgagcucgccgucugccccaagggcaucaccuccaaggucuuccgcuucaacgucuccuccgucgagaagaaccgcaccaaccucuuccgcgccgaguuccgcguccuccgcguccccaaccccuccuccaagcgcaacgagcagcgcaucgagcucuuccagauccuccgccccgacgagcacaucgccaagcagcgcuacaucggcggcaagaaccuccccacccgcggcaccgccgaguggcucuccuucgacgucaccgacaccguccgcgaguggcuccuccgccgcgaguccaaccucggccucgagaucuccauccacugccccugccacaccuuccagcccaacggcgacauccucgagaacauccacgaggucauggagaucaaguucaagggcgucgacaacgaggacgaccacggccgcggcgaccucggccgccucaagaagcagaaggaccaccacaacccccaccucauccucaugaugauccccccccaccgccucgacaaccccggccagggcggccagcgcaagaagcgcgcccucgacaccaacuacugcuuccgcaaccucgaggagaacugcugcguccgcccccucuacaucgacuuccgccaggaccucggcuggaaguggguccacgagcccaagggcuacuacgccaacuucugcuccggccccugccccuaccuccgcuccgccgacaccacccacuccaccguccucggccucuacaacacccucaaccccgaggccuccgccucccccugcugcgucccccaggaccucgagccccucaccauccucuacuacgucggccgcacccccaaggucgagcagcucuccaacauggucgucaaguccugcaagugcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1659 - RNA, 1603 nt, Artificial Sequence
  mRNA product Design1 comprising derived and/or modified sequence from Homo sapiens__NP_001057.1__HsTNFRSF1B (opt2)
gggagaaagcuuaccauggcccccgucgccgucugggccgcccucgccgucggccucgagcucugggccgccgcccacgcccuccccgcccaggucgccuucacccccuacgcccccgagcccggcuccaccugccgccuccgcgaguacuacgaccagaccgcccagaugugcugcuccaagugcucccccggccagcacgccaaggucuucugcaccaagaccuccgacaccgucugcgacuccugcgaggacuccaccuacacccagcucuggaacuggguccccgagugccucuccugcggcucccgcugcuccuccgaccaggucgagacccaggccugcacccgcgagcagaaccgcaucugcaccugccgccccggcugguacugcgcccucuccaagcaggagggcugccgccucugcgccccccuccgcaagugccgccccggcuucggcgucgcccgccccggcaccgagaccuccgacgucgucugcaagcccugcgcccccggcaccuucuccaacaccaccuccuccaccgacaucugccgcccccaccagaucugcaacgucgucgccauccccggcaacgccuccauggacgccgucugcaccuccaccucccccacccgcuccauggcccccggcgccguccaccucccccagcccgucuccacccgcucccagcacacccagcccacccccgagcccuccaccgcccccuccaccuccuuccuccuccccaugggccccuccccccccgccgagggcuccaccggcgacuucgcccuccccgucggccucaucgucggcgucaccgcccucggccuccucaucaucggcgucgucaacugcgucaucaugacccaggucaagaagaagccccucugccuccagcgcgaggccaaggucccccaccuccccgccgacaaggcccgcggcacccagggccccgagcagcagcaccuccucaucaccgcccccuccuccuccuccuccucccucgaguccuccgccuccgcccucgaccgccgcgcccccacccgcaaccagccccaggcccccggcgucgaggccuccggcgccggcgaggcccgcgccuccaccggcuccuccgacuccucccccggcggccacggcacccaggucaacgucaccugcaucgucaacgucugcuccuccuccgaccacuccucccagugcuccucccaggccuccuccaccaugggcgacaccgacuccucccccuccgagucccccaaggacgagcagguccccuucuccaaggaggagugcgccuuccgcucccagcucgagacccccgagacccuccucggcuccaccgaggagaagccccucccccucggcguccccgacgccggcaugaagcccuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1660 - RNA, 730 nt, Artificial Sequence
  mRNA product Design1 comprising derived and/or modified sequence from Homo sapiens__NP_002623.2__HsPGF (opt2)
gggagaaagcuuaccaugcccgucaugcgccucuuccccugcuuccuccagcuccucgccggccucgcccuccccgccguccccccccagcagugggcccucuccgccggcaacggcuccuccgaggucgaggucguccccuuccaggaggucuggggccgcuccuacugccgcgcccucgagcgccucgucgacgucgucuccgaguaccccuccgaggucgagcacauguucucccccuccugcgucucccuccuccgcugcaccggcugcugcggcgacgagaaccuccacugcguccccgucgagaccgccaacgucaccaugcagcuccucaagauccgcuccggcgaccgccccuccuacgucgagcucaccuucucccagcacguccgcugcgagugccgcccccuccgcgagaagaugaagcccgagcgccgccgccccaagggccgcggcaagcgccgccgcgagaagcagcgccccaccgacugccaccucugcggcgacgccgucccccgccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1661 - RNA, 1456 nt, Artificial Sequence
  mRNA product Design1 comprising derived and/or modified sequence from Homo sapiens__NP_001020537.2__HsVEGFA (opt2)
gggagaaagcuuaccaugaccgaccgccagaccgacaccgcccccucccccuccuaccaccuccuccccggccgccgccgcaccgucgacgccgccgccucccgcggccagggccccgagcccgcccccggcggcggcgucgagggcgucggcgcccgcggcgucgcccucaagcucuucguccagcuccucggcugcucccgcuucggcggcgccgucguccgcgccggcgaggccgagcccuccggcgccgcccgcuccgccuccuccggccgcgaggagccccagcccgaggagggcgaggaggaggaggagaaggaggaggagcgcggcccccaguggcgccucggcgcccgcaagcccggcuccuggaccggcgaggccgccgucugcgccgacuccgcccccgccgcccgcgccccccaggcccucgcccgcgccuccggccgcggcggccgcgucgcccgccgcggcgccgaggaguccggccccccccacucccccucccgccgcggcuccgccucccgcgccggccccggccgcgccuccgagaccaugaacuuccuccucuccuggguccacuggucccucgcccuccuccucuaccuccaccacgccaaguggucccaggccgcccccauggccgagggcggcggccagaaccaccacgaggucgucaaguucauggacgucuaccagcgcuccuacugccaccccaucgagacccucgucgacaucuuccaggaguaccccgacgagaucgaguacaucuucaagcccuccugcgucccccucaugcgcugcggcggcugcugcaacgacgagggccucgagugcguccccaccgaggaguccaacaucaccaugcagaucaugcgcaucaagccccaccagggccagcacaucggcgagauguccuuccuccagcacaacaagugcgagugccgccccaagaaggaccgcgcccgccaggagaagaaguccguccgcggcaagggcaagggccagaagcgcaagcgcaagaagucccgcuacaaguccugguccgucuacgucggcgcccgcugcugccucaugcccuggucccuccccggcccccaccccugcggccccugcuccgagcgccgcaagcaccucuucguccaggacccccagaccugcaagugcuccugcaagaacaccgacucccgcugcaaggcccgccagcucgagcucaacgagcgcaccugccgcugcgacaagccccgccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1662 - RNA, 916 nt, Artificial Sequence
  mRNA product Design1 comprising derived and/or modified sequence from Homo sapiens__NP_001165094.1__HsVEGFA (opt2)
gggagaaagcuuaccaugaacuuccuccucuccuggguccacuggucccucgcccuccuccucuaccuccaccacgccaaguggucccaggccgcccccauggccgagggcggcggccagaaccaccacgaggucgucaaguucauggacgucuaccagcgcuccuacugccaccccaucgagacccucgucgacaucuuccaggaguaccccgacgagaucgaguacaucuucaagcccuccugcgucccccucaugcgcugcggcggcugcugcaacgacgagggccucgagugcguccccaccgaggaguccaacaucaccaugcagaucaugcgcaucaagccccaccagggccagcacaucggcgagauguccuuccuccagcacaacaagugcgagugccgccccaagaaggaccgcgcccgccaggagaagaaguccguccgcggcaagggcaagggccagaagcgcaagcgcaagaagucccgcuacaaguccugguccgucuacgucggcgcccgcugcugccucaugcccuggucccuccccggcccccaccccugcggccccugcuccgagcgccgcaagcaccucuucguccaggacccccagaccugcaagugcuccugcaagaacaccgacucccgcugcaaggcccgccagcucgagcucaacgagcgcaccugccgcugcgacaagccccgccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1663 - RNA, 841 nt, Artificial Sequence
  mRNA product Design1 comprising derived and/or modified sequence from Homo sapiens__NP_003368.1__HsVEGFB (opt2)
gggagaaagcuuaccauguccccccuccuccgccgccuccuccucgccgcccuccuccagcucgcccccgcccaggcccccgucucccagcccgacgcccccggccaccagcgcaaggucgucuccuggaucgacgucuacacccgcgccaccugccagccccgcgaggucgucgucccccucaccgucgagcucaugggcaccgucgccaagcagcucguccccuccugcgucaccguccagcgcugcggcggcugcugccccgacgacggccucgagugcguccccaccggccagcaccagguccgcaugcagauccucaugauccgcuaccccuccucccagcucggcgagaugucccucgaggagcacucccagugcgagugccgccccaagaagaaggacuccgccgucaagcccgaccgcgccgccaccccccaccaccgcccccagccccgcuccguccccggcugggacuccgcccccggcgcccccucccccgccgacaucacccaccccacccccgcccccggccccuccgcccacgccgcccccuccaccaccuccgcccucacccccggccccgccgccgccgccgccgacgccgccgccuccuccgucgccaagggcggcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1664 - RNA, 1477 nt, Artificial Sequence
  mRNA product Design1 comprising derived and/or modified sequence from Homo sapiens__NP_005420.1__HsVEGFC (opt2)
gggagaaagcuuaccaugcaccuccucggcuucuucuccgucgccugcucccuccucgccgccgcccuccuccccggcccccgcgaggcccccgccgccgccgccgccuucgaguccggccucgaccucuccgacgccgagcccgacgccggcgaggccaccgccuacgccuccaaggaccucgaggagcagcuccgcuccgucuccuccgucgacgagcucaugaccguccucuaccccgaguacuggaagauguacaagugccagcuccgcaagggcggcuggcagcacaaccgcgagcaggccaaccucaacucccgcaccgaggagaccaucaaguucgccgccgcccacuacaacaccgagauccucaaguccaucgacaacgaguggcgcaagacccagugcaugccccgcgaggucugcaucgacgucggcaaggaguucggcgucgccaccaacaccuucuucaagccccccugcgucuccgucuaccgcugcggcggcugcugcaacuccgagggccuccagugcaugaacaccuccaccuccuaccucuccaagacccucuucgagaucaccgucccccucucccagggccccaagcccgucaccaucuccuucgccaaccacaccuccugccgcugcauguccaagcucgacgucuaccgccagguccacuccaucauccgccgcucccuccccgccacccucccccagugccaggccgccaacaagaccugccccaccaacuacauguggaacaaccacaucugccgcugccucgcccaggaggacuucauguucuccuccgacgccggcgacgacuccaccgacggcuuccacgacaucugcggccccaacaaggagcucgacgaggagaccugccagugcgucugccgcgccggccuccgccccgccuccugcggcccccacaaggagcucgaccgcaacuccugccagugcgucugcaagaacaagcucuuccccucccagugcggcgccaaccgcgaguucgacgagaacaccugccagugcgucugcaagcgcaccugcccccgcaaccagccccucaaccccggcaagugcgccugcgagugcaccgaguccccccagaagugccuccucaagggcaagaaguuccaccaccagaccugcuccugcuaccgccgccccugcaccaaccgccagaaggccugcgagcccggcuucuccuacuccgaggaggucugccgcugcguccccuccuacuggaagcgcccccagauguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1665 - RNA, 1282 nt, Artificial Sequence
  mRNA product Design1 comprising derived and/or modified sequence from Homo sapiens__NP_004460.1__HsVEGFD (opt2)
gggagaaagcuuaccauguaccgcgagugggucgucgucaacgucuucaugaugcucuacguccagcucguccagggcuccuccaacgagcacggccccgucaagcgcuccucccaguccacccucgagcgcuccgagcagcagauccgcgccgccuccucccucgaggagcuccuccgcaucacccacuccgaggacuggaagcucuggcgcugccgccuccgccucaaguccuucaccuccauggacucccgcuccgccucccaccgcuccacccgcuucgccgccaccuucuacgacaucgagacccucaaggucaucgacgaggaguggcagcgcacccagugcuccccccgcgagaccugcgucgaggucgccuccgagcucggcaaguccaccaacaccuucuucaagccccccugcgucaacgucuuccgcugcggcggcugcugcaacgaggagucccucaucugcaugaacaccuccaccuccuacaucuccaagcagcucuucgagaucuccgucccccucaccuccguccccgagcucguccccgucaaggucgccaaccacaccggcugcaagugccuccccaccgccccccgccaccccuacuccaucauccgccgcuccauccagauccccgaggaggaccgcugcucccacuccaagaagcucugccccaucgacaugcucugggacuccaacaagugcaagugcguccuccaggaggagaacccccucgccggcaccgaggaccacucccaccuccaggagcccgcccucugcggcccccacaugauguucgacgaggaccgcugcgagugcgucugcaagacccccugccccaaggaccucauccagcaccccaagaacugcuccugcuucgagugcaaggagucccucgagaccugcugccagaagcacaagcucuuccaccccgacaccugcuccugcgaggaccgcugccccuuccacacccgccccugcgccuccggcaagaccgccugcgccaagcacugccgcuuccccaaggagaagcgcgccgcccagggcccccacucccgcaagaaccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1666 - RNA, 847 nt, Artificial Sequence
  mRNA product Design1 comprising derived and/or modified sequence from Homo sapiens__NP_061986.1__HsFGF21 (opt3)
gggagaaagcuuaccauggacagcgaugagaccggcuucgaacacuccgggcugugggugucuguccucgccggacuucuguugggugcuugccaggcacaucccaucccugacucaaguccauuacugcaauuuggcgggcagguuagacagagguaccuauauacagaugacgcccagcaaacugaggcgcaccucgaaauucgggaggauggaacggugggcggugcugccgaccagagcccggaaucccugcuucagcugaaggcauugaaacccgggguaauacagauccucggagugaagaccucucgcuuccugugucaacgaccugauggcgcccuguacggcucgcuccauuuugacccagaggcuugcucauuccgugaguuacugcuugaagauggguauaacgucuaccagagcgaggcacacggauugccccugcaucuaccugguaauaaaaguccacacagagaccccgccccuaggggcccagcucgguuucucccgcugcccgggcuuccuccagcccugcccgaaccuccaggaauuuuggcgccccagccgccugaugugggcuccucugacccccucagcaugguugguccaucccaggggcgcucaccuaguuaugcaagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1667 - RNA, 1627 nt, Artificial Sequence
  mRNA product Design1 comprising derived and/or modified sequence from Homo sapiens__NP_002412.1__HsMMP1 (opt3)
gggagaaagcuuaccaugcacagcuuucccccucugcuccuucuguuguucuggggcguggucucccauucuuucccagccaccuuagagacacaggaacaagacguugaucuggugcagaaguaccuagagaaauauuacaaccucaagaaugacgggagacagguagagaaaaggcggaacucaggaccgguggucgaaaagcugaaacagaugcaagaauuuuucggucuuaaggugacuggcaagcccgaugcugagacgcugaaaguuaugaagcagccucgcugcggggugccagacgucgcacaguuuguguugaccgagggaaauccccgaugggaacagacacaccucacuuaucguaucgagaacuacaccccugaucugccaagagccgacguagaucaugcgauugaaaaggcuuuccaacuguggaguaauguuacaccccucaccuuuacuaaagugagcgagggccaggccgacauaaugaucuccuucgucaggggugaucaccgggacaacucuccuuuugaugggccaggaggcaauuuagcacaugccuuccagccgggccccgggauuggaggugacgcucacuuugaugaggacgaacgcuggacaaacaauuucagagaguauaaccugcacaggguggcagcccaugaacuuggccacucguuggggcugucacauagcaccgacaucggagcucuaauguacccuaguuauacguuuuccggcgaugugcagcucgcccaagacgauauugacgguauccaggcgauauacgggcggucucagaauccaguccaacccaucggaccucagacuccaaaagcaugugauagcaagcugaccuucgacgccauuacaacuauccgcggcgagguuauguucuuuaaggaucgauucuacaugagaaccaaccccuuuuauccggaaguggagcuuaauuucauuuccguauuuuggccucagcugcccaacggcuuggaggcugccuacgaguucgcagacagggaugaagugcgguuuuucaaagggaauaaguauugggcuguccagggacaaaacgugcuccacgguuacccaaaagacaucuauucaaguuuuggcuucccucguacaguuaagcacauagaugccgcgcugagcgaagagaacaccgggaaaacguacuuuuucguggccaauaaguauuggcgcuacgacgaauacaaaagaucuauggaccccggauauccaaagaugauugcacaugauuuucccggcaucggucacaaggucgacgcuguguucaugaaagauggguucuuuuacuucuuucauggcacuaggcaguauaaguucgacccuaaaacaaagcggauuuuaacccugcagaaagccaacuccugguuuaauugccgaaagaacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1668 - RNA, 1387 nt, Artificial Sequence
  mRNA product Design1 comprising derived and/or modified sequence from Homo sapiens__NP_002412.1__HsMMP1(1-19,100-469) (opt3)
gggagaaagcuuaccaugcacagcuuucccccucugcuccuucuguuguucuggggcguggucucccauucuuucguuuuaaccgaggggaacccaagaugggaacagacacaccugacuuacaggaucgagaauuauacgccggaccuaccccgggccgauguggaccaugcuauugaaaaggcauuucaacucuggucaaacguaaccccucugacauucacuaaagugagugagggacaggccgauauaaugaucagcuuuguccgcggugaccaccgagauaauuccccauucgacggccccgggggaaaccuugcgcaugcuuuucagccuggcccagguauugggggagaugcccacuucgacgaagaugagcguuggaccaauaacuuuagagaguacaaucugcacaggguggcagcccaugaauugggccacucucucggccugucgcauucaacagacaucggggcucugauguaucccagcuacaccuucaguggagauguucagcucgcacaagacgauauugacgguauccaggccauauauggccggucccagaacccugugcagccaaucgggccgcaaacucccaaggcuugcgacucuaaauuaacauuugaugccauuaccacgauccgcggagaggucauguucuuuaaggacagauucuacaugaggacuaauccuuucuauccagaaguggagcugaacuuuauuagcguauucuggccccagcuuccuaauggcuuggaggcggcauacgaauuugccgaucgggacgagguucgcuucuuuaaagguaacaaguacugggcugugcaggggcagaauguccugcacggauauccaaaggauaucuacuccucauucggcuuuccccgaaccgugaaacacauagacgccgcacuaagugaagagaacacaggcaagacuuauuucuuuguggcuaauaaauacuggagauaugaugaauacaagaggagcauggacccgggguauccuaaaaugauugcccaugauuuccccggaaucggucacaaggucgacgcgguuuuuaugaaggauggcuucuuuuacuucuuccaugggacccggcaauacaaauuugacccaaagacaaaacguauucucacccugcagaaggccaacucuugguucaacugucgcaaaaauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1669 - RNA, 3574 nt, Artificial Sequence
  mRNA product Design1 comprising derived and/or modified sequence from Clostridium histolyticum__BAA77453.1__ColG (opt3)
gggagaaagcuuaccaugaagaaaaacauccugaagauucucauggacagcuacuccaaagagucuaagauacagaccgugagaagggucacaucaguuagucuucuggccguguauuugacuaugaauacgagcuccuuaguacuggcuaaacccaucgaaaacaccaaugauacaucuauuaagaacguggagaagcuacggaaugcaccuaacgaagaaaauucgaaaaaggucgaagacucaaagaacgauaagguggagcacguuaaaaauaucgaggaagccaagguggagcaagucgcgccagaaguaaagagcaaaaguacucuccgcuccgcuucuauugccaacaccaauagcgagaaguacgacuucgaguaucugaacggccuuuccuacacagaacugaccaauuugaucaaaaacauaaaguggaaucagaucaacgggcucuuuaacuauucaacuggaagucagaaauucuuuggugauaagaaucgagugcaggcaauuaucaacgcccugcaagagagcggccguacauacaccgcuaaugacaugaaagggauugaaacguucacugagguucugagagcaggauuuuaucucggcuacuacaacgaugguuuaucuuaucugaaugacaggaacuuccaggauaagugcaucccggccaugauagcuauucagaagaaucccaacuuuaaacuugggaccgccgugcaggacgaagucaucacauccuugggaaagcugauuggcaaugcgucagcaaacgccgagguggugaauaacugugucccuguucuaaaacaauuccgggagaaucucaaccaguacgcuccagauuaugugaagggcacugccguaaaugaacugaucaaagggaucgaguuugacuucagcggagcagcuuacgaaaaggaugugaagaccaugcccugguaugguaaaauugacccuuuuauaaacgagcuuaaggcccugggcuuguacgggaacaucacaagugcgaccgaaugggccucugacgucggaauuuauuaccucuccaaauucggccuguacagcacgaaucgcaacgauaucgugcagucguuagagaaggcaguugacauguauaaauacgguaagauagcuuuuguggccauggagagaauuacuugggauuaugacgggaucggaucuaauggcaagaaagucgaucaugacaaguuccuggaugacgcugaaaaacacuaccucccaaagacauauaccuucgauaacggcacuuuuaucauuagggccggggacaaaguguccgaggaaaagaucaagcggcuuuacugggcaucacgcgagguaaaaagucaguuccaucgaguugugggaaaugauaaggcccuggaagucgguaacgcugacgacguguugacaaugaaaauuuuuaauagccccgaggaguauaaguucaacaccaauauaaacggcgucuccacggauaaugggggacuauacaucgaaccuagaggcaccuuuuacacauaugagaggacuccacaacagucuauuuucagccuggaggagcucuuucggcacgaguacacccauuaucugcaggcgcguuaccuuguggacggucugugggggcaaggcccguucuaugaaaagaaccgcuugacaugguuugaugagggaacugcagaguucuuugccggcucaaccagaacaagugggguucuccccaggaaguccauccugggauacuuagcuaaagacaagguggaucaccgguauagccugaagaaaacccuaaauucugguuacgacgauucagacuggauguucuacaacuauggcuuugccguagcacacuaccucuaugaaaaggauaugccuacuuucaucaaaaugaauaaggccauucugaacacggacgucaaaaguuacgaugaaauaaucaagaaacuuagcgacgaugcuaacaaaaauacagaguaucagaaccauauucaggaguuggccgacaaguaccagggggcaggaaucccacugguguccgacgauuaucucaaagaccacggcuacaagaaagcgucugaaguuuacucggagauuagcaaggcugccucccugaccaauacuucagugaccgcagaaaagagucaauauuucaacacauuuacccuucgagguacuuacacaggggagacgucuaaaggcgaguucaaggauugggacgaaaugagcaaaaagcuggauggaaccuuggagucccucgccaaaaauucauggagcggcuauaagacucugacagcuuacuuuaccaacuaucgcgucacaucugacaauaaggugcaguacgauguaguguuccaugggguuuuaacugacaacgccgauaucuccaauaacaaagcacccauagcuaaggucaccggaccuaguacgggugccgugggcagaaauaucgaauuuagcgggaaagacucuaaggaugaggacggaaaaauuguguccuaugauugggacuucggcgacggugcgaccucaagggggaagaacaguguccacgccuacaaaaaggcuggcacauacaauguuacucugaaggugaccgaugacaaaggagcaacagccacugagagcuuuaccaucgaaauuaagaacgaagauacgacaaccccaaucacuaaagagauggagcccaaugacgauauaaaggaagcuaacggcccgauuguggaggggguaacagucaaaggagaccuaaacggcucggaugacgccgauaccuucuauuuugacgugaaggaagauggugacguuacuaucgagcucccuuacuccgggucuagcaauuucaccuggcugguguauaaggagggagacgaucagaaccacauugcaucaggcaucgacaaaaauaacaguaaggucgguacauuuaaauccacgaagggccggcauuacguguucauauauaaacacgauucugcgagcaauaucuccuacucacuuaacauuaagggguugggaaaugaaaagcugaaagagaaggaaaacaaugacagcagugauaaagccaccguuauccccaacuuuaauacuacaaugcagggcucucuccugggggacgauucccgcgacuauuacagcuucgaggugaaggaagagggagagguaaacauugaauuagauaaaaaggacgaguucggcgucaccuggacacugcauccagaaucgaauaucaacgauagaauaacuuacggucaaguggacgggaauaaggugucaaacaaagucaaacuuaggccuggaaaauauuacuugcucguuuauaaguacucuggcagugguaauuaugagcugcgugugaacaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1670 - RNA, 3298 nt, Artificial Sequence
  mRNA product Design1 comprising derived and/or modified sequence from Clostridium histolyticum__BAA77453.1__HsALB(1-18)_ColG(111-1118) (opt3)
gggagaaagcuuaccaugaagugggugaccuucaucagccugcucuuucuuuucuccucugccuacucaauugcuaacacaaauagugagaaauaugacuuugaauaccugaacggcuugagcuauacugaguuaacgaaucugauaaagaacaucaaauggaaucagauuaacgggcuauucaauuacuccaccggaucucaaaaguuuuucggugauaaaaacagaguccaggcaaucauuaaugcccuccaggaaucgggcaggacauauacugcgaacgacaugaaggggaucgagaccuuuacagaaguucugcgggcuggauucuaccuuggcuauuacaaugauggucugucauacuugaacgaccgcaauuuucaggauaagugcauacccgccaugaucgcaauucagaaaaacccuaauuucaagcucgggaccgccgugcaagacgagguaaucacuagccugggaaaacugauuggcaacgcuagugcaaacgccgagguggucaauaacugugugccaguucucaagcaguuucgagaaaauuuaaaccaguaugcuccggauuacgugaaaggcacagccgucaaugagcugaucaaggggauagaauuugacuuuuccggagcggcauaugagaaggaugugaaaaccaugcccugguacgguaagauugacccuuucaucaacgagcuuaaagccuugggccuguaugggaauauuacgucugcuacugaaugggccagcgauguaggaaucuacuaucuauccaaguucggccucuacucaaccaaccguaaugacaucguucaaagucuggagaaagcaguggauauguacaaguaugguaaaauugcuuuugucgccauggaaagaauaacaugggacuacgacgggaucggaagcaacggcaagaagguggaucacgacaaauuccuugaugacgcggagaagcauuaucugccaaaaacuuacaccuuugauaauggcacauucauuaucagggccggggacaaggugucugaagagaaaauaaagcgguuguauugggcaucccgcgaggucaagucacaguuucacagaguugugggaaacgauaaagcucucgaaguagguaaugccgacgaugugcugaccaugaagauuuucaacagccccgaggaauacaaauuuaauacgaacaucaacggcgucaguacugacaaugggggauuauauaucgagccuaggggcacauucuacaccuacgaacggacuccacagcagucuauuuucucccuggaggagcuguuccgccaugaauauacacacuaccuucaagcucgauaucugguggaugguuugugggggcagggccccuuuuacgagaagaacagacuaaccugguucgacgaaggaacggccgaguuuuucgcaggcagcaccaggacaucggggguucugccucggaaaucuauccucggauaucuggccaaggacaagguggaucaucguuacucccuuaaaaagacucucaauucagguuaugacgauagugacuggauguucuacaacuacggcuuugcugucgcgcacuauuuguacgaaaaagauaugccaaccuucauuaagaugaauaaagcaauacucaacacagacguaaagagcuaugaugagaucauuaagaaacuguccgacgaugccaauaagaacacugaguaccagaaucacauccaagaauuagcugacaaauaucagggggccggaaucccgcuggugucugaugacuaccuaaaggaucauggcuauaaaaaggcaagcgagguuuacucagaaauuaguaaagccgcuucccucaccaacacaagcgugaccgccgagaagucucaguacuuuaauacuuucacgcugcgcgguacauauaccggggagacuucaaagggcgaauuuaaagacugggacgagaugaguaagaaacuugauggaaccuuggaaagccuggcaaagaacuccuggucuggcuacaaaacacucaccgcguauuucacuaauuacagagucacaucggacaacaaggugcaguaugaugucguguuucacgggguucugacggacaaugcugauauaagcaacaacaaggcccccaucgcaaaagugaccggaccuuccacuggugccguaggcaggaauauugaguucucagggaaggacaguaaagaugaagacggaaagaucgucucuuacgauugggacuuuggcgauggugcuacaagccgggggaaaaacuccgugcaugccuauaagaaggcaggcaccuacaauguuacacuuaaagugacugacgauaagggagcuaccgccacggagucauucaccauugagaucaaaaacgaagacacaacuaccccaauaacaaaggagauggaacccaaugacgauaucaaagaggcgaacggcccuauugucgaaggggugacuguaaagggagaccugaauggcagcgaugacgccgauaccuuuuacuucgacgugaaggaggauggugacguuacgaucgaguugccauauucuggguccaguaacuuuacauggcucgucuacaaagaaggagaugaccaaaaucacauugcuagcggcaucgauaagaacaauucuaaaguggguaccuucaaguccacuaaaggccgacacuauguguucauauacaagcaugacucagcaaguaacauuagcuauucgcugaauaucaaaggguuaggaaacgagaagcugaaggaaaaagagaauaacgacuccucugauaaggccacagucauucccaacuuuaauaccacuaugcagggcagccuacucggggacgauucacgcgacuacuauaguuucgaaguuaaagaggagggagaagugaacaucgagcuggauaagaaagacgaauuuggcgugaccuggacacuucacccggaguccaauauaaacgauagaaucacguacggucagguagacgggaauaaggucucuaacaaggugaaauugaggccuggaaaguacuaucugcucguuuacaaauauagcggcuccgguaauuacgagcugcgggugaacaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1671 - RNA, 3646 nt, Artificial Sequence
  mRNA product Design1 comprising derived and/or modified sequence from Clostridium histolyticum__BAA77453.1__HsALB(1-18)_ColG(1-110)_CS-F_ColG(111-1 118) (opt3)
gggagaaagcuuaccaugaagugggugaccuucaucagccugcucuuucuuuucuccucugccuacucaaugaaaaagaacauucugaaaauauugauggacaguuauagcaaggaguccaaaauccagacagucagaaggguuacuucugugucguuacuggcuguauaccuaacgaugaauaccucaagccucgugcuggcaaagcccauugaaaacacaaaugauacuagcaucaagaacgucgagaaacuucggaaugccccuaacgaagaaaauuccaagaaaguggaagacucuaagaacgauaaaguugagcacgugaagaauauugaggaagcgaaggucgagcaaguggcuccagaaguaaaaagcaaguccacccugcgcucagccagucgacguagaaggaaacggaucgcaaacacaaauagcgagaaguaugacuuugaguacuugaacggccucucuuauaccgaacugacuaaucugaucaaaaacauaaaguggaaucagauuaacggacucuucaacuacuccacaggaucacagaaauuuuucggugauaagaaucgcguucaggccaucauuaacgcuuuacaagagagcggcagaaccuauacggcaaaugacaugaaggggaucgaaacuuuuaccgaggugcugagggccggauucuaccuuggcuacuauaacgaugguuugaguuaccugaaugaccggaacuuucaggauaaaugcauaccggcuaugauugccauccagaagaaucccaacuucaaacuagggacagcgguccaggacgaagugauuacuucucucggaaagcugaucggcaaugcauccgccaacgcugagguggucaauaacuguguuccugugcuuaaacaauuucgcgagaaucugaaccaguaugccccagauuacguaaagggcaccgcagugaaugaauugaucaaggggauugaguucgacuuuagcggagcugccuaugaaaaagaugucaagacaaugcccugguacgguaaaauagacccuuucaucaacgagcucaaggcgcugggcuuauaugggaacauuaccucggccacggaaugggcaucugacgugggaaucuacuaccuguccaaauucggccucuauucaacuaaucgaaacgauauaguucagagucuugagaaggcuguggacauguacaaguaugguaaaauugccuuugucgcuauggagagaaucacaugggauuacgacgggaucggaagcaauggcaagaaaguggaucaugacaaguuccuggaugacgccgaaaaacacuauuugccaaagaccuacacuuuugauaacggcacauucauuaucagggcaggggacaagguauccgaggagaaaauuaagcggcuauauugggccucucgugagguuaaaagccaguuucaucgcguggucggaaaugauaaggcucuggaaguggguaacgcggacgacguccucaccaugaaaauauucaauucacccgaggaguacaaguuuaacacgaauaucaacggcgugaguaccgauaaugggggacuguacauugaaccuagaggcacauucuauacuuacgagaggaccccacaacaguccaucuuuagccuugaggaacuguuccggcacgaguauacacauuacuugcaggcacgauaucucguugacggucugugggggcaaggcccguuuuacgagaaaaaccgcuuaacuugguucgaugaaggaaccgccgaauuuuucgcuggcucuacaagaaccucaggggugcugcccaggaagaguauccuaggauaucucgccaaggacaaaguagaucaccgguacagccugaagaaaacucuuaauuccgguuacgacgauucugacuggauguucuauaacuacggcuuugcagucgcccacuauuuguacgagaaggauaugccuacguucauuaaaaugaauaaggcuauacugaacacagacgugaagucguaugaugaaaucauuaaaaagcucagcgacgaugccaacaaaaauaccgaguaccagaaccauauccaggagcuggcagacaaguaucagggggcggggauuccacuuguuuccgacgauuaccugaaagaccacggcuacaagaaggcuucagaaguguauagugagaucucuaaagccgcaaguuugacuaauaccuccgucacagccgaaaagucacaauacuuuaacaccuucacucuccgcgguacauauacgggggagaccagcaaaggcgaauuuaaggauugggacgagaugucuaaaaagcuggauggaacuuuagagucccuggcuaagaauaguuggagcggcuacaaaacacuaaccgccuauuucacaaacuacagagugacuucugacaauaagguacaguaugaugugguuuuucaugggguccucaccgacaacgcagauauauccaauaacaaagcucccaucgccaaggugacgggaccuucaaccggugcggugggcaggaauauugaguucagugggaaagacagcaaggaugaagacggaaaaaucgucucguacgauugggacuuuggcgacggugccacaucccgugggaagaacucuguucacgcuuacaagaaagcaggcacuuauaaugugacccugaaggugacagaugacaaaggagccacugcuaccgagagcuucacgauugaaaucaagaacgaagauacaaccacuccaauaacaaaagagauggagcccaaugacgauauuaaggaagccaacggcccgaucguagagggggucaccgugaagggagaccuuaacggcucagaugacgcagauacuuuuuacuucgacguuaaagaagauggugacgugaccauugaguugccuuauaguggguccucuaauuuuacauggcuggucuacaaggagggagacgaucagaaccacaucgcgagcggcauagacaaaaauaacuccaagguggguacguucaaaucaaccaagggccggcauuauguuuucaucuacaagcacgauagcgccaguaauauuucuuauucccucaacaucaaagggcugggaaaugaaaaguuaaaagagaaggaaaacaaugacagcucggauaaagcuacugugauucccaacuuuaauacaaccaugcagggcucacugcuuggggacgauucucgagacuacuacaguuucgagguaaaggaagagggagaggucaacaucgaauuggauaagaaagacgaguuuggcgugacauggacucuccauccagaauccaauauaaacgauagaauuaccuauggucaaguggacgggaauaaggucagcaacaaaguuaagcugaggccuggaaaauacuaucuacugguguacaaguauucuggcagcgguaauuacgagcuccgcguaaacaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1672 - RNA, 3322 nt, Artificial Sequence
  mRNA product Design1 comprising derived and/or modified sequence from Clostridium histolyticum__BAA34542.1__ColH (opt3)
gggagaaagcuuaccaugaacuuccugaagaucauucucaauagaggcaaaaccaugaagaggaaaugccuuagcaagcggcugauguuggccauaacaauggcuacuaucuuuacggugaacuccaccuuacccauuuacgcagccgucgacaaaaauaacgcgacagcugccguucagaaugagucuaagcgcuauacugugucauaccugaagacccuaaacuauuacgaucucguagaccugcuugugaaaacagaaaucgagaaucugccugauuuguuccaauauaguagcgacgcaaaggaauuuuacgggaacaaaacccgaauguccuucauuauggaugagaucggacguagagccccacaguauacugaaauagaccacaaggguaucccgacacucgucgaggugguuagggcuggcuuuuaccugggguuccauaauaaagagcugaacgaaauuaauaagcggucuuuuaaggagcgcgugauccccucgauucucgcaauccagaaaaacccuaauuucaaguuaggaaccgaaguccaggauaaaauagugucagccacgggccugcuugcugguaacgagacugccccacccgagguaguuaauaacuuuaccccuauuuugcaagacuguaucaagaacauugauagauacgcgcuggacgaucuaaaaagcaaggcacucuucaaugugcuggccgcuccaacauaugacaucacugaauaccuuagggccaccaaagagaagcccgaaaacacaccuugguaugggaagaucgauggauuuauuaaugagcugaaaaaguuggcacucuacggcaaaauaaacgacaauaacaguuggaucauugacaauggcaucuaucacauagcuccacuggggaaguuacauuccaacaauaaaauuggaaucgaaacccugacggaggucaugaagguguacccguaucucucuaugcagcaccuucagagcgccgaucagaucaagcggcauuacgacuccaaagaugcggaggguaacaagauuccccuggacaaauucaagaaagaaggcaaggagaaguacugcccuaaaacuuauacauuugaugacgggaaggugaucauuaaagccggagcacgcgucgaagaggaaaagguuaaacgauuguacugggcuucaaaggaggugaauagucaauucuucagaguauauggcauagauaagccacuagaggaagguaaccccgacgauauccugaccauggugauuuacaauagcccugaggaauauaaacucaacucuguccuguacggguaugacacuaauaacggaggcauguacaucgagccagaaggcacauuuuucaccuacgagagggaggcccaggaauccacguauacccuugaggaacuguuucggcacgaguacacacacuauuugcaggggcguuacgcugugcccggacaguggggucgcacuaagcucuaugauaacgacagacugaccugguacgaggaaggcggggccgaguuauucgcaggaucaacaaggacuagcggcauccugccgcggaaaaguauuguuucuaauauacauaacaccacacgaaauaaccgcuauaagcuauccgacaccgugcacagcaaauacggugccucguuugaguucuacaauuaugcuuguauguuuauggauuacauguauaacaaggacauggggauccucaauaaacugaacgaucuugcgaagaauaacgacgucgauggcuacgacaauuauauuagagauuugucuuccaacuacgcacugaaugacaaguaucaagaucauaugcaggaaaggaucgacaacuacgaaaaucucacugugccuuucguagccgaugacuaccugguucggcacgcuuauaaaaaccccaacgagauuuacucagagaucagugaaguggccaaacuuaaggaugcaaagagcgaggucaaaaagucccaguauuuuucuacguucacacugcgcggaagcuacaccggcggggccucaaagggaaaauuggaagaccaaaaggcuaugaauaaauuuauagacgauagucucaagaaacuggacacuuauuccuggagcgguuacaagaccuuaacagccuauuucaccaacuacaagguggauucuucaaauagagucacuuacgacgugguuuuucacggcuaucugccaaacgagggggauaguaaaaauagccuaccuuacggaaagaucaacggcacauauaaagguacggaaaaggagaaaauuaaguucuccucugaggggucguucgaccccgauggcaagaucgugagcuacgaaugggacuuuggagauggcaauaaauccaacgaggaaaauccagagcauucauaugacaagguagggaccuacacugucaaacucaaggugacagaugacaaaggagaaaguucuguuagcaccacaacugcagagauuaaggaucuguccgagaacaaacuucccgugaucuauaugcacgucccuaagucaggugcguugaaucagaaggugguauucuacggcaaagggaccuacgacccagacggaagcauagcuggcuaucagugggauuuuggugacgggucugauuucuccagugaacagaacccgagccauguguacacgaagaaaggcgaguauaccguuacacugagggucauggacucuuccggacaaaugucagaaaagacuaugaaaauuaagaucaccgaucccguguacccuauuggcacagagaaggagccaaauaacaguaaagaaacugccagcgggcccaucgugccuggaauaccagucucgggcaccaucgagaauacguccgaccaggauuauuuuuacuucgacguuauuacacccggugaagugaagaucgauauuaacaaacucggguauggaggcgcaaccugggugguauacgacgagaacaauaacgccgucucuuacgcuacugaugacggucagaaucugagcggcaaguuuaaagccgacaagccggggcguuauuacauccacuuauauauguucaacggaucauacaugccuuaucggauaaauauugaaggcaguguggggcgaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1673 - RNA, 3283 nt, Artificial Sequence
  mRNA product Design1 comprising derived and/or modified sequence from Clostridium histolyticum__BAA34542.1__ColH (opt3)
gggagaaagcuuaccaugaagagaaaaugccugagcaagaggcucaugcuugccaucaccauggcuacaauuuucacugugaacuccacgcugcccauauacgcagccgucgacaaaaauaacgcgaccgcugccguucagaaugagucuaagcgguauacagugucauacuugaaaacuuuaaacuauuacgaucugguagaccuacucgugaagaccgaaaucgagaaucugccugaucuuuuucaauauaguagcgacgcaaaggaguucuacggcaacaaaacacgcauguccuuuauuauggaugaaaucgggcgacgugccccacaguauaccgaaauugaccacaagggaaucccgacucuggucgaggugguuagagcugguuucuacuugggcuuucauaauaaagagcucaacgaaauaaauaagaggucuuucaaagagcgggugauccccucgauucuggcaauccagaagaacccuaauuuuaagcuggggacagaaguccaggauaaaauugugucagccaccggacucuuagcuggcaacgagacggccccacccgagguaguuaauaacuucacuccuauccugcaagacuguauaaagaauauugaucgcuacgcgcuugacgauuugaaaagcaaggcacuguuuaacgugcuagccgcuccaaccuaugacaucacagaauaccucagagccacuaaagagaagcccgaaaacaccccuugguaugguaaaauugauggguucaucaaugagcugaagaagcuggcacuguacggaaaaaucaacgacaauaacaguuggauuauagacaauggcaucuaucacauugcuccauugggcaagcuccauuccaacaauaaaaucgggauagaaacacugaccgaggucaugaagguguacccguauuuaucuaugcagcaccuucagagcgccgaucagauuaaaaggcauuacgacuccaaggaugcggagggaaacaagaucccccucgacaaauuuaagaaagaagguaaggagaaauacugcccuaagacguauacuuucgaugacggcaaggugaucauuaaagccggggcacgggucgaagaggaaaagguuaaacgccuuuacugggcuucaaaggaggugaauagucaauuuuuccgaguauauggaaucgauaaaccacuggaggaaggcaaccccgacgauauuuugacaauggugauauacaauagcccugaggaauauaagcuaaacucuguccuguacgguuaugacaccaauaacgggggaauguacaucgagccagaaggcacuuucuuuacauacgagagagaggcccaggaauccaccuauacgcucgaggaacuguucaggcacgaguacacccacuaucuucagggccgguacgcugugcccgggcaguggggacguacaaagcuguaugauaaugaccgcuugacuugguacgaggaagguggcgccgagcucuuugcagggucaaccagaacaagcggcauucugccgaggaaaaguaucguuucuaacauccauaacacuacccggaauaaccgauauaaguuauccgacacagugcacagcaaauacggagccucguucgaauuuuacaauuaugcuuguauguucauggauuacauguauaacaaggacauggguauucugaauaaacuaaacgaucucgcgaagaauaacgacgucgauggguacgacaauuauauacgcgaucugucuuccaacuacgcacuuaaugacaaauaucaagaucauaugcaggagagaaucgacaacuacgaaaauuugaccgugccuuuuguagccgaugacuaccugguuaggcacgcuuauaagaaccccaaugagauuuacucagagaucagugaaguggccaagcucaaagaugcaaagagcgaggucaaaaagucccaguauuucucuacuuuuacgcugcggggcagcuacacaggaggcgccucaaaagggaaacuugaagaccaaaaggcuaugaacaaguucauugacgauagucugaagaaauuggacaccuauuccuggagcggauacaagacucucaccgccuauuuuacaaacuacaaaguggauucuucaaaucgcgucaccuacgacgugguuuuccacgguuaucugccaaacgagggcgauaguaagaauagcuuaccuuacgggaagaucaacggaacuuauaaaggcacagaaaaggagaaaauaaaguuuuccucugaggguucguucgaccccgaugggaaaaucgugagcuacgaaugggacuucggcgauggaaauaaguccaacgaggaaaauccagagcauucauaugacaagguaggcacguacaccgucaaacugaaggugacugaugacaaaggggaaaguucuguuagcacaaccacagcagagauuaaggaucuauccgagaacaaacuccccgugaucuauaugcacgucccuaagucaggagcgcugaaucagaaagugguauuuuacgguaagggcacuuacgacccagacgggagcauugcuggauaucagugggauuucggcgacgguucugauuuuuccagugaacagaacccgagccauguguacaccaagaaaggggaguauacgguuacccuuagagucauggacucuuccggccaaaugucagaaaagacaaugaaaaucaagauaacugaucccguguacccuauuggaaccgagaaagagccaaauaacaguaaggaaacagccagcggccccaucgugccugggauuccagucucgggaacuaucgagaauaccuccgaccaggauuauuucuacuuugacguuauaacgcccggcgaagugaagaucgauauuaacaaauuggguuaugggggagcaacaugggugguauacgacgagaauaacaacgccgucucuuacgcuaccgaugacggccagaaucugagcgguaaguucaaagccgacaagccgggcagguauuacauccaccucuauauguuuaacgggucauacaugccuuaucguauuaauaucgaaggaagugugggccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1674 - RNA, 3217 nt, Artificial Sequence
  mRNA product Design1 comprising derived and/or modified sequence from Clostridium histolyticum__BAA34542.1__HsALB(1-18)_ColH(41-1021) (opt3)
gggagaaagcuuaccaugaagugggugaccuucaucagccugcucuuucuuuucuccucugccuacucaguccagaacgagaguaaaagauauacaguuagcuaccugaagacuuugaauuauuacgacuuaguggaucugcuaguaaaaacggaaauugagaaccuccccgaccuguuucaauauuccucugaugcuaaggaguucuacggcaauaaaaccaggaugucguuuauaauggacgaaaucggccggcgcgcaccucaguauacagaaauugaucacaagggaaucccaacucuuguggaggucgugcgagccgguuucuaccugggcuuucauaacaaggaguugaaugaaauuaacaaacguucauucaaggagagaguuaucccgagcauacucgcgauccagaaaaaucccaacuuuaagcuggggaccgaagugcaggacaaaauugucagugcuacaggacugcucgccggcaaugagaccgcaccuccagaggugguaaacaauuucacucccaucuuacaagauugcauuaagaacaucgacagguacgcccuggaugaccuuaaguccaaggcuuuguuuaauguucuggcagccccuacauaugauauaaccgaauaccuacgggcuacgaaggagaaaccagaaaacacucccugguaugguaagauugacggguucaucaaugagcucaaaaagcuggcccuuuacggaaaaauuaacgauaacaauucuuggaucaucgacaacggcauuuaucacauagcgccucugggcaaguugcauagcaauaacaagaucgggauugaaacccucacagaggugaugaaagucuacccauaucuguccaugcagcacuuacagucagcagaccagaucaagcgccauuacgauaguaaagacgccgagggaaauaagauaccgcuggauaaauuuaagaaggaagguaaagagaaguacugucccaaaacuuauaccuucgacgauggcaaggugauuaucaaagcuggggccagaguggaagaggaaaaggucaagaggcucuacugggcaagcaaagagguuaacucucaauucuuucggguguauggaaucgacaagccucuugaggaaggcaauccagaugacauucugacaaugguaaucuacaacucccccgaggaauauaaacuaaauucaguguuguacgguuaugauaccaacaaugggggaauguacauugagccugaaggcacguucuuuacuuacgagcgcgaggcucaggaaagcacauauacccuggaggaacucuuccgacacgaguacacucacuaucugcagggcagauacgccgucccagggcaguggggaaggacaaaacuuuaugacaacgaucggcugaccugguacgaggaagguggcgcggaguuguuugccgggaguacgcguaccucuggaauacucccccgcaaauccaucgugagcaauauucauaacacaacuagaaauaacagguauaagcugucggacaccguucacucuaaguacggcgcauccuucgaauuuuacaacuaugcuugcauguucauggacuacauguauaauaaagauauggguaucuuaaacaagcugaaugaccuagccaaaaacaaugauguggacggguacgauaacuauauccgggaccucucaaguaauuacgcucugaacgauaaguaucaagaccauaugcaggagcgaauugauaauuacgaaaaccuuacagucccguuuguggccgacgauuacuugguacgccacgcauauaaaaauccuaacgagauauacagcgagaucuccgaaguugccaagcugaaagacgcuaagucugaggugaagaaaagccaguauuucucaacuuuuacccucagaggcaguuacacaggaggcgcguccaaggggaaacuggaagaucaaaaggcaaugaauaaauucauugacgacagccuuaagaagcuggauaccuauucuuggucaggauacaaaacuuugacggccuauuuuacaaacuacaaggucgacaguagcaauagggugaccuacgaugucguguuccacgguuaucuccccaacgagggcgacuccaaaaacucucugccauacgggaagaucaauggaacuuauaaaggcaccgaaaaggagaagauuaaauucucgagcgaggguuccuuugauccugacgggaagaucguuucauacgaaugggauuucggcgacggaaacaaaaguaaugaggaaaaccccgagcauucuuaugauaaggugggcacauacaccguaaaauuaaaggucacugacgauaagggggaaagcuccgugucaacaacgaccgcugagauaaaagaccugagcgagaauaagcuaccaguuaucuauaugcacgugcccaaaucuggagcccucaaccagaaggucguguuuuacgguaaaggcacuuacgauccugacggguccauugcaggauaucagugggacuucggcgaugguagugacuuuagcucugaacagaauccaucccauguauacacaaagaaaggggaguauaccgugacacugcggguuauggauucaaguggccaaaugagcgaaaagacuaugaagaucaaaauuaccgacccggucuaccccaucggaacggagaaggagccuaacaauucgaaagaaaccgccuccggcccaauagugcccgggauuccugugucuggaacaaucgagaacacuagcgaucaggacuauuucuacuuugaugucauuaccccaggcgaaguuaagaucgacauaaauaaacuugguuaugggggagcuacaugggugguguacgaugagaacaauaacgccguaucauacgcaacugacgauggccagaauuugagugguaaguucaaggcggacaaacccggccgcuauuacauccaccuguauauguuuaacggguccuacaugccguauagaauuaacaucgaaggaucugucgggaggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1675 - RNA, 3355 nt, Artificial Sequence
  mRNA product Design1 comprising derived and/or modified sequence from Clostridium histolyticum__BAA34542.1__HsALB(1-18)_ColH(1-40)_CS-F_ColH(41-102 1) (opt3)
gggagaaagcuuaccaugaagugggugaccuucaucagccugcucuuucuuuucuccucugccuacucaaugaaaagaaagugccugaguaaaagguugauguuagcuauuacaauggcaacuauauuuacggucaacagcacccugcccaucuaugccgcgguugacaagaauaacgcuacagccgcacggcgccgacguaaaagagugcagaaugaguccaagagguacacuguaucuuaucuaaagacccucaacuacuaugaucugguggaccuucuggucaaaacagaaauugagaauuugccugaucucuuccaauacucgucagacgccaaggaauuuuauggcaacaaaacccggaugagcuucaucauggaugagauugggcgcagagcuccacaguacacugaaaucgaccacaagggaauaccgacacugguggagguugugagggcagguuuuuaccugggcuuccauaauaaagagcucaacgaaaucaauaagcggaguuuuaaggagcgcgucauucccuccaucuuagccauucagaaaaacccuaauuucaagcuggggaccgaagugcaggauaaaaucguaucugcuacgggacuuuuggccggcaacgagacugcgccacccgagguugugaauaacuuuaccccuauacugcaagacuguauuaagaauaucgaucgauaugcacuagacgaucucaaaagcaaggcccuguucaacguccuugcugccccaacauacgacauuacugaauaucugagagcaaccaaagagaagcccgaaaacacaccuugguacgguaagaucgauggguuuaucaaugaguugaaaaagcucgcucuguauggaaaaauuaacgacaauaacuccuggauaaucgacaauggcauuuaccacaucgccccauuaggcaagcugcauucaaacaauaaaauagggauugaaacccucacggaggugaugaagguguauccguaccuuaguaugcagcaucugcagagcgcggaucagaucaagaggcacuacgacucuaaagaugccgagggaaacaagauccccuuggacaaauucaagaaagaagguaaggagaaguauugcccuaaaacuuacacauucgaugacggcaaggucauuaucaaagcaggggcucggguugaagaggaaaaggugaaacgucuauauugggccuccaaggagguaaauucacaauuuuuccgcguguacggaauugauaagccacuggaggaaggcaaccccgacgauauacucaccauggucaucuauaauagcccugaggaauacaaacugaacagugugcuuuaugguuacgacacuaauaacgggggaauguacauugagccagaaggcacauuuuucaccuaugagagagaggcucaggaaucuacguacacccuggaggaauuguuuaggcacgaguauacacacuaccuccagggccgguaugccguucccgggcaguggggacgaacuaagcuguacgauaaugaccgcuuaaccugguaugaggaagguggcgcagagcuguucgccggguccacaagaacuagcggaauccuaccgaggaaaucgaucgugucuaacauucauaacaccacacggaauaaccgcuacaagcucuccgacaccguccacucaaaauacggcgcuaguuuugaguucuauaauuacgcguguauguuuauggauuauauguacaacaaggacauggguauacugaauaaacuuaacgauuuggcaaagaauaacgacguggauggguaugacaauuacaucagagaucugagcuccaacuaugcccucaaugacaaguaccaagaucauaugcaggaaaggauugacaacuacgaaaaucugacuguaccuuucguugcugaugacuaucuugugcgucacgccuacaaaaaccccaaugagaucuauucugagauuagcgaagucgcaaagcugaaagaugccaagucagaggugaaaaagagucaguacuuuuccacguucacauugcggggcagcuauaccggaggcgcuucuaaggggaaacucgaagaccaaaaggccaugaacaaauuuaucgacgauucacugaagaaauuagacacuuacaguuggagcggauauaagacccugacagcauacuucaccaacuacaaggucgauuccucuaaucgagugacuuaugacguuguguuccacgguuaccuaccaaacgagggcgauucgaaaaauagccucccuuaugggaagauaaacggaacauacaaaggcacggaaaaggagaaaaucaaguuuuccucagaggguaguuucgaccccgaugggaagauuguaucuuaugaaugggacuuuggcgauggaaauaaaagcaacgaggaaaauccagagcauuccuacgacaaggucggcaccuauacugugaaacugaagguuacagaugacaaaggggaaucaagcgugucuaccacaacugcggagaucaaggaucuuuccgagaacaaauugcccgucauuuacaugcacgugccuaagaguggagcucugaaucagaagguaguguucuacgguaaaggcaccuaugacccagacgggagcaucgccggauaccagugggauuuuggcgacgguucugauuucuccucagaacagaacccgagucauguuuauacgaagaaaggggaguacaccgucacacucagagugauggacagcucgggccaaauguccgaaaagacuaugaaaauaaagauuaccgaucccguguauccuaucggaacagagaaggagccaaauaacucuaaagaaacugcaagcggccccauugucccugggaucccaguuucaggaaccauagagaauacgagugaccaggauuacuuuuauuucgacgugaucacacccggcgaagugaagauugauaucaacaaacuggguuacgggggagccaccuggguagucuacgacgagaauaacaacgcuguguccuaugccacugaugacggccagaauuuaucugguaaguuuaaagcagacaagccgggcagguacuauauucaccuguacauguucaacgggagcuauaugccuuaccgcaucaauauagaaggauccguuggccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1676 - RNA, 793 nt, Artificial Sequence
  mRNA product Design1 comprising derived and/or modified sequence from Homo sapiens__NP_001133.1__HsAMELX (opt3)
gggagaaagcuuaccaugggcaccuggauccuguucgccugccuccuuggggcugcauuugccaugccccugccuccacacccgggacaucccgguuacauuaacuucagcuaugagguguugacaccuuuaaagugguaccaguccauaagaccacccuauccuucuuacggcuaugaaccaaugggaggguggcugcaccaucaaaucauucccguccuaucacagcagcacccuccaacucauacgcuccagccgcaccaccauauccccguugugccugcgcaacagccaguaauuccccagcagccuaugaugccagugcccggccaacacaguaugaccccgauccagcaucaccagccuaaucugcccccuccagcucagcaacccuaccagccacagcccguccaaccucagccacaccagccgaugcagccccaaccuccagugcaucccaugcagccucuuccaccccagccgccucugccacccauguuuccuaugcagcccuugccaccuaugcuccccgaccugacacuggaggccuggccaagcacugauaaaaccaagagggaagagguugacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1677 - RNA, 352 nt, Artificial Sequence
  mRNA product Design1 comprising derived and/or modified sequence from Homo sapiens__NP_001133.1__HsAMELX-TRAP (opt3)
gggagaaagcuuaccaugccccugccuccacacccgggccaucccggguacaucaacuucagcuaugaggugcucaccccucuuaagugguaccaguccauuagaccacccuauccuucuuacggauaugaaccaauggguggcuggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1678 - RNA, 385 nt, Artificial Sequence
  mRNA product Design1 comprising derived and/or modified sequence from Homo sapiens__NP_001133.1__HsAMELX-LRAP (opt3)
gggagaaagcuuaccaugccccugccuccacacccgggccaucccggguacaucaacuucagcuaugaggugcucaccccucuuaagugguaccaguccauuagaccacccccuaugcugccagacuugacauuagaagccuggcccucuacugauaaaacgaagagggaggaagucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1679 - RNA, 424 nt, Artificial Sequence
  mRNA product Design1 comprising derived and/or modified sequence from Homo sapiens__NP_001133.1__HLA-A2-SP_HsAMELX(17-60) (opt3)
gggagaaagcuuaccauggccgugauggcucccagaacccugguccuccuucugagcggcgcauuggccuuaacacagacuugggcgaugccucugccaccgcaccccgggcauccuggauacaucaacuucuccuaugagguucuaacgccacucaagugguaccaaucuauuaggcccccuuauccaucauacgguuaugaacccaugggcggguggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1680 - RNA, 457 nt, Artificial Sequence
  mRNA product Design1 comprising derived and/or modified sequence from Homo sapiens__NP_001133.1__HLA-A2-SP_HsAMELX(17-47,168-191) (opt3)
gggagaaagcuuaccauggccgugauggcucccagaacccugguccuccuucugagcggcgcauuggccuuaacacagacuugggcgaugccucugccaccgcaccccgggcauccuggauacaucaacuucuccuaugagguucuaacgccacucaagugguaccaaucuauuaggcccccuccaaugcugcccgaccuuacccuggaggcuuggccuucaacagauaaaacuaagcgggaagaaguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1681 - RNA, 796 nt, Artificial Sequence
  mRNA product Design1 comprising derived and/or modified sequence from Homo sapiens__NP_001134.1__HsAMELY (opt3)
gggagaaagcuuaccaugggcaccuggauccuguucgccugccucgugggggcugcauuugccaugccccuuccuccacacccgggacaucccgguuacauuaacuucagcuaugagguccugacaccuuugaagugguaccaguccaugauaagaccacccuauucuucauacggcuaugaaccuaugggagggugguuacaccaucaaaucauuccaguugugagucagcagcacccccugacucauacgcuacagagccaccaccauaucccuguagugccagcgcaacagccgaggguccggcagcaggcucucaugcccgugccuggccaacaguccaugaccccaacacagcaccaucagcccaaucugccucuuccagcccaacagcccuuucagccgcaaccuguucagccccagccacaccagccuaugcaaccccagccacccgugcagccuaugcagccacuguugccgcaacccccucucccacccauguucccucugcgcccacugcccccgauucucccugacuuacaccuggaggcauggccagccacugauaaaaccaagcaggaagaggucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1682 - RNA, 355 nt, Artificial Sequence
  mRNA product Design1 comprising derived and/or modified sequence from Homo sapiens__NP_001134.1__HsAMELY-TRAP (opt3)
gggagaaagcuuaccaugccccugccuccacacccgggccaucccggguacaucaacuucagcuaugaggugcucaccccucuuaagugguaccaguccaugauuagaccacccuauucuucauacggauaugaaccuauggguggcuggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1683 - RNA, 388 nt, Artificial Sequence
  mRNA product Design1 comprising derived and/or modified sequence from Homo sapiens__NP_001134.1__HsAMELY-LRAP (opt3)
gggagaaagcuuaccaugccccugccuccacacccgggccaucccggguacaucaacuucagcuaugaggugcucaccccucuuaagugguaccaguccaugauuagaccacccccuauacugccagacuugcacuuagaagccuggcccgcuacagauaaaacuaagcaagaggaagucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1684 - RNA, 427 nt, Artificial Sequence
  mRNA product Design1 comprising derived and/or modified sequence from Homo sapiens__NP_001134.1__HLA-A2-SP_HsAMELY(17-61) (opt3)
gggagaaagcuuaccauggccgugauggcucccagaacccugguccuccuucugagcggcgcauuggccuuaacacagacuugggcgaugccucugccaccgcaccccgggcauccuggauacaucaacuucuccuaugagguucuaacgccacucaagugguaccaaucuaugauuaggcccccuuauucaaguuacgguuaugaaccaaugggcggguggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1685 - RNA, 460 nt, Artificial Sequence
  mRNA product Design1 comprising derived and/or modified sequence from Homo sapiens__NP_001134.1__HLA-A2-SP_HsAMELY(17-48,169-192) (opt3)
gggagaaagcuuaccauggccgugauggcucccagaacccugguccuccuucugagcggcgcauuggccuuaacacagacuugggcgaugccucugccaccgcaccccgggcauccuggauacaucaacuucuccuaugagguucuaacgccacucaagugguaccaaucuaugauuaggcccccuccaauacugcccgaccuucaccuggaggcuuggccugccaccgauaaaacaaagcaggaagaaguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1686 - RNA, 787 nt, Artificial Sequence
  mRNA product Design1 comprising derived and/or modified sequence from Sus scrofa__NP_999071.1__SsAMELX-001-1 (opt3)
gggagaaagcuuaccaugggcaccuggauccuguucgccugccuccuuggggcugcauuuagcaugccccugccuccacacccgggacaucccgguuacauuaacuucuccuaugagguguugacaccuuuaaagugguaccagaauaugauaagacacccauauacuucuuacggcuaugaacccaugggaggguggcugcaucaccaaaucauuccugucguuucacagcagacgccacagagucaugcccuacaaccccaccaccauaucccuauggugccagcgcagcagccgggcauuccccagcaaccuaugaugccacuccccggucagcacagcaugaccccuacacagcaucaccagccaaaccugccccuuccggcucaacagccuuuucagccccaaccaguacagccucagccccaccagccacugcaaccccaguccccuaugcauccaauccagccguugcucccccagccuccacugcccccuauguucucuaugcaaucgcugcucccagacuuaccccuggaggccuggccggcaacugauaaaaccaagagggaagagguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1687 - RNA, 355 nt, Artificial Sequence
  mRNA product Design1 comprising derived and/or modified sequence from Sus scrofa__NP_999071.1__SsAMELX-TRAP (opt3)
gggagaaagcuuaccaugccccugccuccacacccgggccaucccggguacaucaacuucagcuaugaggugcucaccccucuuaagugguaccagaauaugauuagacacccauauacauccuacggauaugaacccauggguggcuggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1688 - RNA, 388 nt, Artificial Sequence
  mRNA product Design1 comprising derived and/or modified sequence from Sus scrofa__NP_999071.1__SsAMELX-LRAP (opt3)
gggagaaagcuuaccaugccccugccuccacacccgggccaucccggguacaucaacuucagcuaugaggugcucaccccucuuaagugguaccagaauaugauuagacacccaucccuguugcccgacuuaccucuggaagccuggccagcuacagauaaaacuaagagggaggaagucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1689 - RNA, 427 nt, Artificial Sequence
  mRNA product Design1 comprising derived and/or modified sequence from Sus scrofa__NP_999071.1__HLA-A2-SP_SsAMEL(17-61) (opt3)
gggagaaagcuuaccauggccgugauggcucccagaacccugguccuccuucugagcggcgcauuggccuuaacacagacuugggcgaugccucugccaccgcaccccgggcauccuggauacaucaacuucuccuaugagguucuaacgccacucaagugguaccaaaauaugauuaggcaccccuauaccucuuacgguuaugaaccuaugggcggguggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1690 - RNA, 460 nt, Artificial Sequence
  mRNA product Design1 comprising derived and/or modified sequence from Sus scrofa__NP_999071.1__HLA-A2-SP_SsAMEL(17-49,167-189) (opt3)
gggagaaagcuuaccauggccgugauggcucccagaacccugguccuccuucugagcggcgcauuggccuuaacacagacuugggcgaugccucugccaccgcaccccgggcauccuggauacaucaacuucuccuaugagguucuaacgccacucaagugguaccaaaauaugauuaggcaccccucucugcuuccugaccugccauuggaggcuuggcccgccaccgauaaaacaaagcgggaagaaguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1691 - RNA, 751 nt, Artificial Sequence
  mRNA product Design1 comprising derived and/or modified sequence from Sus scrofa__P45561-2__SsAMELX-001-2 (opt3)
gggagaaagcuuaccaugggcaccuggauccuguucgccugccuccuuggggcugcauuuagcaugccccugccuccacacccgggacaucccgguuacauuaacuucuccuauauaagacacccuuacacaucuuauggcuacgagccaaugggagggugguugcaucaccagaucauucccguggucucacaacagacuccucagagucaugccuuacagccacaccaccauauccccaugguuccugcgcaacagccaggcauuccgcagcagcccaugaugccucugccaggucaacacagcaugacgcccacccagcaucaccagccuaaucuaccacuccccgcucagcaaccguuucagccucagcccgugcaaccacagccucaccagccccugcagccacaaucccccaugcauccuauccagccacuucugccgcagcccccuuugccacccauguucucuaugcagucgcuccugccugaccugccacucgaagccuggcccgcaacagauaagacuaaaagggaggaaguagacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1692 - RNA, 787 nt, Artificial Sequence
  mRNA product Design1 comprising derived and/or modified sequence from Sus scrofa__NP_998965.1__SsAMELX-001-3 (opt3)
gggagaaagcuuaccaugggcaccuggaucuucuuugccugccugcucggggcuagccuugcaaugccccugccuccacacccgggacaucccgguuacauuaacuucuccuaugagguguugacaccuuuaaagugguaccagaauaugauaagacacccauauacuucuuacggcuaugaacccaugggaggguggcugcaucaccaaaucauuccugucguuucacagcagacgccacagagucaugcccuacaaccccaccaccauaucccuauggugccagcgcagcagccgggcauuccccagcaaccuaugaugccacuccccggucagcacagcaugaccccuacacagcaucaccagccaaaccugccccuuccggcucaacagccuuuucagccccaaccaguacagccucagccccaccagccacugcaaccccaguccccuaugcauccaauccagccguugcucccccagccuccacugcccccuauguucucuaugcaaucgcugcucccagacuuaccccuggaggccuggccggcaacugauaaaaccaagagggaagagguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1693 - RNA, 436 nt, Artificial Sequence
  mRNA product Design1 comprising derived and/or modified sequence from Sus scrofa__K7GPB2__SsAMELX-002 (opt3)
gggagaaagcuuaccaugggcaccuggauccuguucgccugccuccuuggggcugcauuuagcaugccccugccuccacacccgggacaucccgguuacauuaacuucuccuaugagguguugacaccuuuaaagugguaccagaauaugauaagacacccaucucugcuacccgaccucccucuggaagccuggccagcgacugauaaaacgaagagggaggaagucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1694 - RNA, 829 nt, Artificial Sequence
  mRNA product Design1 comprising derived and/or modified sequence from Sus scrofa__K7GLD0__SsAMELX-003 (opt3)
gggagaaagcuuaccaugggcaccuggauccuguucgccugccuccuuggggcugcauuuagcaugccccugccuccacacccgggacaucccgguuacauuaacuucuccuaugaggacuuguacuuagaagccauaagaaucgauaggacagcguuugugcugacuccucuaaagugguaucagaauaugauucggcacccauacacgucuuauggcuacgagcccaugggaggguggcuccaucaccaaaucauuccugucguuucacagcagaccccacagagucaugcucugcaaccccaccaccauaucccuauggugccagcccagcagccgggcauaccccagcaaccuaugaugccacuucccggucagcacagcaugacaccuacucagcaucaccagccaaaccugcccuugccggcacaacagccuuuccagccccaaccaguacagccucagccccaccagccacuccaaccccaguccccuaugcauccaauccagccgcugcugccccagccuccauuacccccuauguuuucuaugcaaucgcuccugccagaccuucccuuggaagccuggccggcuaccgauaaaacaaagcgcgaggaaguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1695 - RNA, 715 nt, Artificial Sequence
  mRNA product Design1 comprising derived and/or modified sequence from Sus scrofa__K7GPE9__SsAMELX-004 (opt3)
gggagaaagcuuaccaugggcaccuggauccuguucgccugccuccuuggggcugcauuuagcaugccccugccuccacacccgggacaucccgguuacauuaacuucuccuaugagguguugacaccuuuaaagugguaccagaauaugauaagacacccaacuccccaaucucaugcccugcagccucaccaucacaucccaaugguccccgcgcagcagccuggcauuccacaacagccgaugaugccccuaccugggcagcacucaaugacgccaacccagcaucaccaacccaaccucccucugccagcucagcagcccuuucagccgcaaccuguucagccccagccacaucaaccucuucagccccagaguccaaugcaccccauccagccucuguugccacaaccgccccucccuccaauguucagcaugcagucccugcugcccgaccucccuuuagaagccuggccagcaacagauaaaacuaagagggaggaaguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1696 - RNA, 739 nt, Artificial Sequence
  mRNA product Design1 comprising derived and/or modified sequence from Sus scrofa__J9JIM4__SsAMELX-201 (opt3)
gggagaaagcuuaccaugccccugccuccacacccgggccaucccggguacaucaacuucagcuaugaggugcucaccccucuuaagugguaccagaauaugauuagacacccauauacauccuacggauaugaacccauggguggcuggcugcaucaccaaauaaucccugucguuucucagcagacuccacagucacaugccuugcaaccccaccaccauauuccuauggugccagcucagcagccggggaucccccagcaaccuaugaugccauuacccggacagcacaguaugacgccuacccagcaucaccagccaaaccugccccuaccggcacaacagccuuuucagccccaaccaguacagccucagccccaccagccacuccaaccccagagcccuaugcauccaauucagccgcugcuuccccagccuccacugcccccuauguucuccaugcaaucuuugcucccagaccugccccuggaggccuggccggcgacagauaaaacuaagagggaagagguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1697 - RNA, 3178 nt, Artificial Sequence
  mRNA product Design1 comprising derived and/or modified sequence from Homo sapiens__NP_006120.1__HsBMP1 (opt3)
gggagaaagcuuaccaugcccggcguggccagacugccucuccuucugggguuguuacugcuaccaaggccgggacggccccucgaccuggcugauuacaccuaugaccuugcagaggaagaugacagcgagccucugaacuacaaggauccaugcaaagccgcggcuuucuugggugacaucgcccucgaugaagaggaccugcgcgcauuucagguccaacaggccguugaucugcgacgucacacagcuagaaaguccucuauuaaagcagccgugcccggcaauacuucaacgccuaguugucagagcaccaacgggcagccacaaaggggagcuugcggccgguggcgcgguagauccaggucucggcgcgccgcgacaucgcgacccgaaagaguauggccugacggggugauaccauucgucaucggaggcaauuuuacuggcucacagagggcaguguuccggcaggccaugcgucauugggagaagcacaccuguguuacauuucucgagcgcaccgaugaagacagcuauauuguguucacuuacagaccgugcggguguugcaguuaugucggaaggcgggguggcgggccccaggcuaucuccauuggaaagaacugugauaaguuuggcaucgugguacaugaguuaggucacguugugggguucuggcaugaacacacacgaccugaccgcgacagacacgucucuauagugagggagaauauccaaccaggacaggaguacaacuuucugaagauggaaccccaggagguggaaagccuuggcgagaccuaugauuucgacuccauuaugcauuacgcccggaauacguuuucacgcggcaucuucuuggauacuauugucccuaaauacgaaguuaacggggugaagccacccaucggacagagaaccaggcugaguaaaggugacauagcacaagcucguaagcuauauaaaugcccggccuguggcgagacacuccaggauagcacugggaauuuuucuuccccugaguaccccaacggauauucagcgcacaugcauugcguauggcggauuagcgugaccccaggcgaaaagaucauucugaauuucacaagucuugaccuguaccgaucuagauuguguugguaugauuacgucgaggugagggacgguuucuggcgcaaggccccucuccgggggagauuuugcggcuccaaacugcccgaaccaaucguuagcaccgauucgagguuauggguggaguuccgaucuuccucaaacugggucggaaagggcuuuuucgcaguguaugaagcuaucugcgggggagacguuaaaaaggauuacggucacauucagagucccaauuacccugacgacuaucgcccaagcaaaguauguauauggcggauccaaguguccgagggcuuucacgucgggcugacguuccagucuuuugagauugaacgucaugauagcugcgccuacgacuaucucgaggugagagauggacacucagaaaguuccacucuuaucggcagguacugugguuaugagaagccggacgauauaaaaagcacaucuucacgccugugguugaaguucgucagugacgggagcauuaacaaggcuggcuuugccgugaauuucuuuaaagaaguugaugagugcucccggcccaacagaggaggcugugagcagaggugccuaaacacccuggggucuuacaaguguucgugcgacccuggauaugaacucgcaccagauaaacgacgcugugaggccgcuugcgguggcuuccugacuaaacuuaaugggagcaucacaucccccggauggccuaaagaauacccacccaacaagaauuguaucuggcagcugguggcgccgacccaauaccggauuucauugcaguuugacuucuucgagacggagggcaacgauguaugcaaguaugacuuugucgaagugagaaguggucucaccgcagauucuaaacugcaugggaaguucugcggcagcgagaaaccugaaguuaucacaucccaguacaauaacaugaggguggaguuuaagucagacaauacugucagcaaaaagggauucaaggcccacuuuuucucugacaaagaugaauguuccaaggacaacggcgggugccagcaagauugugugaauaccuuuggaaguuaugagugccagugucguagcggcuucguauuacaugacaacaaacacgauugcaaggaggcugguugugaccacaaagugacaucuacuuccgggaccauuacaucaccaaauuggcccgauaaguacccuaguaagaaagaaugcaccugggccauaagcucgacucccggacaucgcguuaagcugacguuuauggagauggacaucgaaucccagccagagugugcauaugaucaccuagaagucuucgacggccgggaugccaaagcuccugugcucgguagauuuugcggcucuaagaaacccgagccagugcuggccacagggagcaggauguuccuucgauuuuacucagacaacaguguccagcggaagggauuccaagcaucccaugcgaccgaguguggcgggcagguucgcgcugaugugaaaacuaaggacuuguauucucacgcccaguucggagacaauaacuacccgggcgguguggauugcgaauggguaauugucgcagaggaaggguacggaguggagcugguuuuucagaccuucgaaguggaggaggaaacagacugcggcuaugauuacauggagcucuuugacgguuaugauagcaccgccccuagacugggcagguacuguggguccggacccccagaagaggucuauucagcuggcgacagcgugcuuguuaaguuccacagugaugacacuaucacgaaaaagggguuucaucugcgguacacaucuaccaaauuccaagauacuuugcacucccgaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1698 - RNA, 1408 nt, Artificial Sequence
  mRNA product Design1 comprising derived and/or modified sequence from Homo sapiens__NP_001191.1__HsBMP2 (opt3)
gggagaaagcuuaccaugguggccggcaccagaugccugcucgcuuugcuguugccccaggucuuacugggaggggcagccggucuaguuccugagcucggcaggcggaaguucgcggcugccagcuccgggcgcccaucuucacaaccgagugacgaagugcugagcgaguuugaacuucgacuguuguccauguucggacucaaacagcgucccacaccuucuagagaugcaguagugccacccuacaugcuggaccuguauaggcggcacucgggccagccugguucaccagcccccgaucaucgccucgagagagcugcaagcagggccaacacuguccggaguuuucaccaugaagaguccuuagaggaacugccugagacgucugggaagaccacacgccgauucuuuuucaaucuuagcuccaucccaacugaagaguuuauuaccucagcugagcuucagguguucagagaacaaaugcaggacgcccugggaaacaauaguagcuuucaccauaggauaaacaucuacgagauuaucaaaccggcgacagcaaauucuaaguuccccguuacccggcuacucgauacucgucuggugaaccagaaugccucccgcugggaaucauuugacgucaccccugcugugaugagauggacagcccagggccacgcaaaccacggcuucguaguugagguggcucaucuugaagagaaacaaggggucagcaagaggcacgugcggauuagucgaucucugcaucaggaugagcacuccuggagccagauccgcccauugcucgugacguuuggacacgacgguaagggccauccccugcacaaaagagaaaagaggcaggccaaacauaagcaacggaaacgcuuaaagucgucuuguaagagacacccucuguaugucgauuucuccgacguuggguggaaugauuggauaguggcgccacccggauaccaugccuucuauugccacggcgaguguccguuuccucucgcagaccaccuuaacucaacuaaucaugcuaucguacagacccuggugaacagugucaauagcaaaauucccaaggccugcugugugccaacagaauuguccgcuaucucuaugcuauaccuggaugagaacgaaaaaguugugcucaagaauuaucaggacauggucguggaggguugcggguguaggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1699 - RNA, 1444 nt, Artificial Sequence
  mRNA product Design1 comprising derived and/or modified sequence from Homo sapiens__NP_001193.2__HsBMP4 (opt3)
gggagaaagcuuaccaugauccccggcaacagaaugcugauggugguccuccuuugccagguucuguuagggggagccagccacgcuuccuugauuccugagaccgguaagaaaaagguggcagaaauacaaggccaugccgggggaaggcggucuggccagucacacgagcugcuacgcgacuucgaagcgacacuccugcagauguuuggucuucgacguagaccacagccgaguaaaagcgcuguaauccccgauuacaugagggaccuguaucgguugcaauccggggaggaagaggaggaacagauucauucuacuggacucgaguacccugaacgcccagccucgagagcaaauacggugaggucauuccaccaugaggagcaccuggaaaacauccccggcaccagcgagaauagugccuuucgguuccuguuuaaccucuccucuauuccugaaaaugaggucaucagcuccgcugaauuacgccuguuccgagaacagguggaucagggcccagacugggagagaggguuucacaggauaaacaucuaugagguuaugaagcccccugcagagguggucccaggacaucuuauuacacgguugcuggauacucgucuagugcaccauaauguaacccgcugggaaacauucgacguuucaccggccgugcucagauggaccagggagaaacaacccaacuacggucuggcuaucgaagucacucaccuucaccagacacggacccaucagggccagcacgugcgaauuagucgcagccugccucaagggucuggaaauugggcccaguugagaccacuccuggugacguuuggccaugaugguagggggcacgcguuaacucggcgcagaagggcaaagcguucccccaagcaucacucacagcgggcccgaaagaaaaacaaaaauuguagaaggcacagccuguaugucgacuucagugauguuggauggaacgacuggaucguggcuccuccaggcuaccaagccuuuuauugccauggcgauugucccuucccgcucgcagaccaccuuaauucuaccaaccaugcuauaguacagacacuggucaauuccgugaacagcucgauuccuaaggccugcugugugcccacugaguugucugcgaucuccaugcuauaccuggaugaguacgacaaaguugugcucaagaacuaucaggaaauggucguggaggggugcggaugucgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1700 - RNA, 1759 nt, Artificial Sequence
  mRNA product Design1 comprising derived and/or modified sequence from Homo sapiens__NP_001709.1__HsBMP6 (opt3)
gggagaaagcuuaccaugcccggccuagggagaagggcccaguggcucugcuggugguggggacuucuguguagcugcugugguccuccaccguugcggcccccuuuaccagcugcagccgcggcugccgcaggcgggcaacugcuaggagacggcgguucccccgggcgcaccgagcagccuccacccucuccucagucaaguagcggauuccucuaccgacgucugaagacacaggagaaaagagaaaugcaaaaggaaauccuuuccgugcugggcuugccacacaggccgcggccccuccauggccugcagcagccucagccacccgcccugcgccaacaggaggaacagcagcaacagcagcaacucccuagaggggagccacccccgggaagguuaaaaucugcuccucuguuuaugcuugauuuguauaacgcacugucggccgacaaugaugaggacggugcuucagaaggcgagcggcagcagagcuggccccacgaagccgcgaguuccucucagcgccgacaaccaccucccggggcagcccauccacuaaacagaaagagccuccuggcucccggauccggcucagguggggccaguccucuuacuagcgcacaggauucugcuuuccugaaugacgccgauauggucauguccuuuguuaacuugguggaguacgacaaagaguucucaccaaggcagcggcaccauaaggaauuuaaguucaaucucagccagauuccggagggagaaguagugacggcggccgaguuucguauauauaaagauugcgucaugggcaguuucaagaaccaaaccuuucugaucucuauuuaccagguguuacaggaacaccagcaccgcgacuccgaucuguuccuccuugacacaagaguugugugggcaagcgaggagggcuggcuggaauuugauaucacugcuaccucgaauuugugggucgugacaccccaacauaacauggggcuacagcugucuguaguuaccagggacggagugcacguccauccucgggccgcuggucucgugggccgagacgggccauaugauaaacagcccuucaugguggccuuuuucaaggucuccgagguucacgugcgcacuacaagaucagcaaguagcaggcggcgccagcaauccagaaauaggucuacccagagccaggacguagcccgugugucaagugcuuccgauuacaacagcucugaacugaaaacggcgugucggaagcacgagcuuuaugucucauuccaagaccugggauggcaggauuggauuaucgcaccuaagggcuacgccgcuaauuacugcgacggugaauguaguuuuccauugaacgcccauaugaaugcaacuaaccacgccauagugcagacccucguucaucugaugaaucccgaguaugugccgaaaccuugcugugcuccaacaaaguuaaacgccaucagcguccuguacuucgaugacaacuccaaugugauucugaaaaaguaucgaaacaugguaguuagagcaugcgggugucacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1701 - RNA, 1513 nt, Artificial Sequence
  mRNA product Design1 comprising derived and/or modified sequence from Homo sapiens__NP_001710.1__HsBMP7 (opt3)
gggagaaagcuuaccaugcacgugagaagccugagggccgcugcaccccauuccuucgucgcccucugggcgccucuuuuucuguugcggucugcuuuagccgacuucucacuggauaacgagguucacaguagcuuuauccaucgccgacuacguucccaggaaagaagggagaugcaacgggaaauucucucuauacugggccuuccacaccgcccgagaccccaucugcaggggaagcacaauucggcaccuauguucauguuggaccucuacaacgccauggcuguggaggaaggagguggcccagggggacagggcuuuucauaucccuacaaagcaguauucagcacccaggguccuccacuggccagucugcaagauucccacuuucucacagacgcugauauggugaugucuuucgucaauuuaguggagcaugacaaggaguuuuuccaccccagguaucaucaccgggaauuucgcuucgaucugagcaaaaucccugagggggaagccguuacugcggcagaguuucgaauuuacaaggacuauaucagagagagguucgauaacgaaacguuccggauuuccguguaccagguccuucaggagcacuugggacgugaaucagaccuguuucuacucgauagucgcacccugugggccagcgaggaaggcuggcuuguguucgacaucacagcuacuucuaaucauuggguaguuaacccaagacacaaucugggcuugcagcucuccguggagacccuggaugggcaaucaauaaacccgaaauuagccggacugaucgguaggcauggcccccagaauaagcagccuuuuauggucgcauucuuuaaggcuacagaggugcacuuccggagcauucgaaguaccgggucuaaacagcgcucccaaaacagaagcaagacucccaaaaaucaggaagcccucaggauggcgaacguggccgaaaauucgucuuccgaccagcggcaagcaugcaagaaacaugagcuuuaugucucauuucgcgaccugggauggcaggauuggaucauugcuccagagggcuacgccgcuuacuauugugaaggugagugcgccuucccuuugaacaguuacaugaaugcaacaaaccacgccaucguucagacccuagugcacuuuauaaacccagagacgguacccaagccguguugcgcuccuacucagcugaaugcgauuagcgugcucuauuucgacgauuccucuaacgucauccugaagaaauacagaaauauggugguuagggcaugugggugccauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1702 - RNA, 517 nt, Artificial Sequence
  mRNA product Design1 comprising derived and/or modified sequence from Homo sapiens__NP_006264.2__HsCCL7 (opt3)
gggagaaagcuuaccaugaaggccagcgcugcacugcucugccuucuguugaccgccgcggcuuucucuccccagggcuuagcccaaccuguggggaucaacacauccacuacguguugcuacagauuuauuaauaaaaagauaccaaaacagaggcuggagucauaucggcgcaccacaaguagccacuguccgcgagaagcagucaucuucaagacuaaacuagacaaggagauuugcgccgaucccacccagaaguggguucaggacuuuaugaaacaucucgauaagaaaacacaaaccccuaagcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1703 - RNA, 3841 nt, Artificial Sequence
  mRNA product Design1 comprising derived and/or modified sequence from Homo sapiens__NP_001954.2__HsEGF (opt3)
gggagaaagcuuaccaugcugcucacccuuaucauucuguugcccguggucagcaaguucuccuuuguuucuuuaucagccccucagcacuggaguugcccagagggcacacuggcugggaacggaaauagcacuuguguggguccggcacccuuccuaauauuuucccauggcaacucuaucuucagaauugacacggaagggaccaauuacgagcaacucguaguggacgccggagucucggugaucauggacuuucacuauaacgaaaagaggauuuacuggguugaucuggagcggcagcuucugcagcgcguguucuugaauggcucacgacaggaacgugucugcaacaucgagaagaaugugagcgguauggcgauaaacuggaucaaugaggaaguaauuuggaguaaccaacaggaggggaucauuacaguuacugacaugaaaggaaauaacucccauauccuccugucugcucugaaguauccugccaauguggcagucgauccaguggaaagauuuauauucuggagcuccgagguggccggcucacucuacagggcugacuuagauggcgucgggguuaaagcacugcuugagaccagugaaaagauuacagccgugagcuuggacguacuggauaagcggcuauuuuggauccaguauaaccgcgagggaucuaauucccucauuuguucaugcgacuacgaugguggcagcgugcacaucaguaaacaucccacccagcacaaccuguucgcuaugucucuuuuuggggacagaaucuucuauuccacuuggaagaugaaaacaauuuggauagccaacaagcacaccggaaaagauauggucaggaucaaucugcauagcucguuugugccuuugggcgaacucaagguugugcacccacuggcgcaacccaaggcagaggacgacacgugggaaccugagcagaaauuauguaagcugcggaaagguaacugcucauccacugucugugggcaggaucuccagucacaucuuugcaugugugccgagggauacgcucugagucgcgaccgaaaguacugcgaagaugugaaugagugugccuucuggaaccacggcugcaccuugggcugcaaaaauacaccagggagcuauuacuguacuugcccgguaggauucguucuacugcccgacgguaagagaugucaccaacucguguccugcccuaggaacgucucugaauguagccaugauugcgugcugaccucagagggcccacuuuguuuuugccccgaagggaguguccuggagcgggacggaaaaacauguuccggcugcagcucuccugauaaugguggguguucacaguugugcgugccacucagucccguuagcugggagugcgacuguuucccgggcuaugaucugcaguuagacgaaaaguccugcgcagcuucuggaccucaacccuuucugcuauucgccaacucgcaggauauucgucacaugcauuuugacggcaccgacuacgggacgcuccugagccagcagaugggaaugguguaugcgcuugaucacgacccaguagagaauaagaucuacuucgcccauacugcauugaaauggauagaacgcgcuaacauggaugguucccaaagagagaggcugauugaagagggcgucgacgugccugaggggcucgccguugauuggaucggacggcgauuuuauuggacagaccgcggcaagucacugaucgguagaagugaucuuaaugggaaaaggucuaagauuaucaccaaagaaaacauuagccagccccggggcauagcugugcacccaauggccaagcgccuguucuggacugacacaggaaucaaucccagaauugaguccucuagcuugcagggccucgggaggcuggucaucgcaucuuccgauuuaaucuggccuaguggaauuaccauagacuuucugacggauaagcuauacuggugugacgccaaacagagcgugaucgaaauggcuaaccucgaugguucuaagcgucggcgacugacccaaaaugacguaggccacccauucgcgguggcaguuuuugaggacuacgucugguucuccgauugggccaugccgucagugaugagagugaacaaaaggacagggaaggaccgcguccggcuucagggaaguauguugaaacccagcucgcugguuguggugcauccucucgcuaagccaggcgccgaucccugccuguaucagaacggugggugugagcacauuugcaagaaaagauuaggcacugcaugguguuccugcagggaaggauuuaugaaggccucugacggcaaaaccugucuggcucuugaugggcaucaguugcucgccggaggcgagguagaccugaagaaucaagucacaccucuagauauccugagcaaaacucgcgugucagaagacaacauuaccgagagucagcacaugcucguugcagaaaucaugguguccgaucaggacgauugcgcgccagucgguuguucuauguacgcucgaugcauaagcgagggggaggacgccacaugccagugucugaagggauucgcaggcgaugguaaacuuugcuccgacaucgacgaaugugagaugggcgugcccguuugcccgccugccucaagcaaauguauuaauaccgaagggggauaugugugccgguguagugagggcuaccaaggggauggaauccacugcuuggacauugaugaaugucagcugggcgagcauucuugcggugagaacgcuuccuguacuaauacggaagggggauauacaugcaugugcgccggccguuuaagcgagccaggucucaucugucccgacucgaccccucccccacaccugagagaagaugaccaucacuacucaguaaggaacucugauagugagugcccucuuucccaugacggcuauugucugcacgauggggucugcauguacauagaagcauuggacaaguacgcuuguaauugcguggugggauauauuggcgagcgcugucaguaccgggaucucaaauggugggagcugagacacgccgggcauggacaacagcagaaggucaucguuguggcgguaugcguggucgugcuaguuaugcugcuccugcuuagcuuguggggcgcccacuauuacaggacucagaaacuguuaucuaagaaccccaaaaauccauaugaagagagcucccgagacgugcgcucacggagaccggcugacaccgaagaugguaugaguagcuguccucaacccugguucgucgugauuaaggagcaucaggaccucaagaacgggggacagccaguugcaggcgaggauggucaggccgcugacggcucuaugcaacccacauccuggaggcaggaaccucagcugugcgggaugggaaccgagcagggcuguuggaucccagugucaagugauaaagggagcugcccccaagucauggaacguuccuuucacaugccuucuuacggaacucagacacuugagggcgguguagaaaagccgcauucgcugcuaagcgccaauccacucuggcagcaacgcgcacuggaucccccucaccagauggaguugacgcagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1704 - RNA, 727 nt, Artificial Sequence
  mRNA product Design1 comprising derived and/or modified sequence from Homo sapiens__NP_001423.1__HsEREG (opt3)
gggagaaagcuuaccaugaccgccggcagaaggauggagaugcugugcgcugggcgggugcccgcacuccuucuguguuugggauuccacuuacugcaggccguccuaagcacaacuguuaucccuuccugcauuccaggugaaucuucagacaacuguacggcgcucgugcaaaccgaggauaauccgcgcguagcucaggugaguauaacaaagugcagcuccgacaugaacggcuacugucugcaugggcagugcaucuaucuugucgauaugucucagaauuacugucgaugcgaagugggauauacuggcguucguugugagcacuuuuuccugaccgugcaucaacccuugucgaaagaauacgucgcccucacagugauucugaucauucuguuucucaucaccguaguugguucaacuuauuacuucugcagaugguauaggaaccgcaagagcaaagagccuaagaaagaguacgaacgggugacaaguggggacccagaguuaccccaggucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1705 - RNA, 685 nt, Artificial Sequence
  mRNA product Design1 comprising derived and/or modified sequence from Homo sapiens__NP_000791.1__HsFGF1 (opt3)
gggagaaagcuuaccauggccgagggcgaaaucaccacauucacugcucugacggagaaguuuaaccuucccccugggaauuacaaaaagccaaaacuccuguauugcagcaacggaggucacuucuugagaauuuuaccggacggcaccguggaugggacaagggaccgguccgaucagcauauacaacugcagcuaucugcagaaucagucggagagguuuacaucaagaguacugaaaccggccaguaucucgccauggacacagauggucugcuuuacgggagccagacccccaaugaggagugucuguuuuuggaacgccucgaggaaaaccacuauaauacuuacauuuccaaaaagcaugcggagaagaacugguucgugggacugaaaaagaauggcucuugcaaacgaggcccucguacacacuaugggcaaaaggcuauccuguuucucccauuacccguaucgucagacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1706 - RNA, 1084 nt, Artificial Sequence
  mRNA product Design1 comprising derived and/or modified sequence from Homo sapiens__NP_001997.5__HsFGF2 (opt3)
gggagaaagcuuaccauggugggcgucgggggaggugacguugaggaugugacccccagaccuggcgggugccagaucagcggaaggggcgcccgggguuguaacgggauuccaggagcugcagccugggaagcggcucugccgcgccgacgucccagaaggcacccuuccguaaauccacggucucgcgccgcaggcucacccagaacaaggggccggcgcacugaggaacgaccuagugggagcagacucggagacaggggucggggccgugcccuuccagggggacgccugggcgguagagggaggggacgggcucccgagcgagugggcggccgcgggagaggaagggguacggcagccccucgggcugccccagcggcacgcggcuccagaccggggcccgccggaaccauggcugccggcucuauaacaacuuugccugcauuaccagaagauggugggucgggcgcuuuucccccuggacauuucaaggacccaaaaaggcuguacugcaagaacggcggguucuuucuacguauccaccccgauggacgggucgacggugugcgagagaaaucagauccgcauauuaagcuccaacugcaggccgaggaaagaggcguugugagcaucaaaggggucugugcgaauagguaucuugccaugaaggaggacggacgccuguuggcaaguaagugcgugaccgaugaauguuucuuuuucgagcggcucgaguccaacaauuacaacacauauagaucuaggaaauacaccagcugguauguagcucugaagcgcacuggccaguacaaacuggguuccaagacagggccuggccagaaagccauucucuuuuuacccaugucagcuaagaguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1707 - RNA, 802 nt, Artificial Sequence
  mRNA product Design1 comprising derived and/or modified sequence from Homo sapiens__NP_002000.1__HsFGF7 (opt3)
gggagaaagcuuaccaugcacaaguggauccugaccuggauucuccccacacuucuguacagaagcugcuuccauauaaucuguuuggugggcacuauuuccuuagccugcaacgacaugacgccugagcagauggcuaccaaugucaacuguucuucaccagaaaggcacacacggaguuaugauuacauggagggaggagacauccgcguucgacgucuguuuugcagaacucaaugguaucuaaggauugauaaacgggguaaggugaaaggcacccaggaaaugaagaauaacuacaauaucauggagauacgcacaguagcaguggggaucgucgccauuaaaggaguggaaagcgaguucuaucucgcgaugaacaaggagggcaagcuguacgcuaaaaaggaauguaaugaggacugcaacuuuaaagaacuuauccuggagaaucauuauaacaccuacgccuccgcaaaguggacucacaaugguggggagauguucguugccuugaaccagaaagggauuccggugagaggcaagaagaccaaaaaggaacagaaaacagcucauuuucuccccauggcaaucacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1708 - RNA, 844 nt, Artificial Sequence
  mRNA product Design1 comprising derived and/or modified sequence from Homo sapiens__NP_001936.1__HsHBEGF (opt3)
gggagaaagcuuaccaugaagcugcuccccagcgugguccuuaaacuguucuuggccgcuguuuuauccgcacuggugaccggcgagucucuagaaagacucaggcgggggcuggccgcgggaacaucaaacccugacccaccgacuguaaguacggaucagcuucugcccuuggguggcgggcgcgaccgaaaggugcgugaucuccaagaggcugaccuggaucugcucagagucaccuuaagcuccaaaccucaggcccuggcaacaccaaauaaggaggaacacggaaaaaggaagaagaaaggcaagggucuugggaaaaagcgggaccccugcuugcgcaaauacaaggauuuuuguauccauggagaaugcaaguaugugaaagagcugagagccccuucuuguauuugccacccaggcuaccauggcgagaggugucacgggcuaucgcuccccguugaaaaccggcuguauacuuacgaccauaccacaauacuugcuguggucgcagugguacugucaagcguuugcuugcucgugaucgucggacuguuaauguuccgcuaucaccgaagagguggcuacgauguggagaaugaagagaaggugaaacuggggaugaccaacagucacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1709 - RNA, 2404 nt, Artificial Sequence
  mRNA product Design1 comprising derived and/or modified sequence from Homo sapiens__NP_000592.3__HsHGF (opt3)
gggagaaagcuuaccaugugggugaccaagcugcuccccgcccuucuguugcagcacgucuuacugcaucuacuccugcuuccuaucgcuauuccauacgcagagggccaaagaaaaaggcggaacacaauacacgaguucaagaaaagcgccaagacuacgcugaucaaaauugacccggcguugaagaucaagaccaaaaagguuaauacagcugaucagugcgccaaccgcuguacucgaaauaaagggcuccccuuuaccugcaaggcauucguguuugacaaagcccguaagcagugucugugguucccuuuuaacuccaugucuucaggaguaaagaaagaguucggucaugaauuugaucuguaugagaauaaggacuacauuagaaacugcaucauaggcaaagggaggaguuauaagggaacagugagcaucaccaaauccggcauuaagugucagccauggucuucgaugaucccccacgaacauucauuccucccuagcaguuaccgggguaaagauuuacaagagaauuauugccgcaacccaagaggggaggaaggaggccccugguguuuuacuuccaauccugaggucagguacgaagugugcgacauuccacaguguucugagguugagugcaugacauguaacggcgaaagcuaucgggggcugauggaucacaccgaguccggaaagaucugccagcgcugggaccaccagacgccgcaucgacacaaguuccuucccgaaagauacccugauaaagguuuugacgauaauuacugcaggaacccagacggccaaccccggccuugguguuauacuuuggauccacauacccguugggaauacugcgcuauaaagacaugugcagacaauacuaugaacgacaccgaugugccccuggaaacaaccgagugcauucaggggcagggagagggcuaucgcgguacggucaauacuaucuggaacgggauuccgugucagagaugggacucacaauacccucacgaacacgauaugacacccgagaacuucaaaugcaaggaccuaagggaaaauuauugucggaacccagauggaagugagagcccuuggugcuuuaccacugaccccaauauccgagugggcuacuguucucagaucccaaacugcgauaugucccauggccaggacuguuaucgcgggaaugguaaaaacuacaugggaaaucucucacaaacaagaagcggccugaccugcaguaugugggauaagaacauggaagaccuucacaggcauauuuucugggagcccgaugccucuaagcugaaugagaacuacugccggaauccugacgacgaugcucacgggccaugguguuauacgggaaacccguugauacccugggacuacugcccuaucucccgcugugaaggcgauaccacaccaacuauuguaaaucucgaccaucccguuaucagcugcgccaaaaccaagcagcugagaguggucaacgguauaccuacaaggacuaauauuggguggauggugucguuacguuaucggaacaaacacaucuguggcggaucucugaucaaggaguccugggugcucaccgcgcgacagugcuucccaucaagagaucuuaaagacuacgaagcauggcugggcauucacgauguccaugggaggggagacgagaaguguaagcagguuuugaacgugagucagcuaguauauggucccgaaggcagcgaucuggugcucaugaaacuggcccgcccggcuguccuugacgauuuuguguccacaaucgaccugccuaauuacgggugcaccauuccagagaagacuucuuguagcguuuauggauggggcuacacggguuugauaaacuacgaugggcuccugcggguggcccacuuauauaucaugggcaaugagaaaugcucacaacaucacagaggaaaggucacacugaacgaaagugagauuugugcaggcgcugagaaaaucggguccggacccugcgaaggugacuacggcgggccucuagugugcgagcagcacaagaugaggaugguacucggaguuaucgugcccggccgcgguugugccauuccaaaucgaccugggauauucguccggguggcguauuacgccaaguggauccauaaaauuauccugaccuauaaggucccccagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1710 - RNA, 2143 nt, Artificial Sequence
  mRNA product Design1 comprising derived and/or modified sequence from Homo sapiens__NP_005336.3 __HsHSPA1A (opt3)
gggagaaagcuuaccauggccaaggcugcagccaucggcauugaccuggggaccacauacagcugcgugggagucuuccagcacgguaaaguugagauaaucgcgaacgaucaaggcaauagaacuacgcccuccuauguggcuuuuaccgacacagaaaggcucauuggggaugccgcaaagaaccagguagcccuuaauccucagaacacuguguucgacgcuaaacggcugaucggacgcaaguuuggcgauccagucgugcagucugacaugaaacauuggccguuccaaguuauuaaugauggugacaagcccaaggugcaggucucauacaaaggggagaccaaggcauuuuauccugaagagaucaguagcaugguguugacaaaaaugaaggaaauagccgaggcuuacuuaggauauccaguaaccaacgccguuaucacugugcccgcguacuucaaugauucccagcgacaggcaacaaaagacgccggcgucauugcuggccugaacgugcuacguaucauuaaugagccuaccgccgcagcuaucgccuaugggcucgauagaacgggaaagggugaaaggaacgugcugauauuugaccuuggcgggggaacuuucgaugucucuauucugaccaucgacgacggcauuuuugagguuaaggcgacagccggugauacucaccuugggggagaagacuucgauaaucggcucgugaaccauuuuguagaggaguucaaacgcaagcacaaaaaggacaucucgcaaaauaaaagagcagugaggcggcugcgcaccgcuugugaacgagccaagagaacacugucaagcaguacccaggcuucccucgagaucgauucuuuauuugaaggcauugacuucuacacgagcauaacuagggcccgguucgaggaacugugcuccgaucuuuuucguucaacauuggagccagucgagaaagcacugcgcgacgccaagcuagauaaggcucagauccaugaccucgugcugguuggcgggaguacccggauucccaaagugcagaaguugcugcaagauuucuuuaacggaagggacuugaauaaaagcaucaacccugacgaagcggucgcauacggugccgcugugcaggccgcaauacucaugggcgauaagucugagaacguacaggaccuguuacugcucgauguugccccacuuucccugggguuggaaacugcuggaggcgugaugacagcccuaauuaaaagaaauucaaccaucccgacgaagcaaacccagaucuucacaacuuauagcgacaaccagcccgguguccugauucagguguacgagggggaacgagcaaugaccaaggauaauaaccuccugggccgcuuugagcuuaguggaaucccuccagcgcccagaggcgucccucaaauugaggugacauucgacauagaugcuaaugggauccugaacguuacugccaccgacaaaucuacaggaaaggcaaauaaaauuaccaucacuaacgauaaggguagguuguccaaagaagagaucgaacggauggugcaggaggccgaaaaguauaaggcugaggacgagguacagcgcgaaagagucagcgccaaaaaugcacucgagucguacgcuuuuaacaugaagucugccguggaagaugagggccugaaagggaagauuuccgaggcggacaaaaagaagguuuuagauaaaugucaggaagugauaucauggcuggacgccaauacgcuagcugagaaggacgaguucgaacacaaaaggaaggaacucgagcaagucugcaacccaaucauuaguggacuguaucagggcgccggugggcccggcccgggaggcuuuggggcacagggaccuaaagguggcagcggguccggacccacaaucgaggaaguggauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1711 - RNA, 2143 nt, Artificial Sequence; identical to SEQ ID NO: 1710
  mRNA product Design1 comprising derived and/or modified sequence from Homo sapiens__NP_005337.2 __HsHSPA1B (opt3)

SEQ ID NO: 1712 - RNA, 2143 nt, Artificial Sequence
  mRNA product Design1 comprising derived and/or modified sequence from Homo sapiens__NP_005518.3 __HsHSPA1L (opt3)
gggagaaagcuuaccauggccaccgcuaagggcaucgcaauugggauagaccugggaacaacuuacagcugcgugggugucuuccagcacggcaaaguugagaucauugccaacgaucaagggaauagaacgacccccuccuauguggcguuuacagacacugaaaggcucaucggagaugcugccaagaaccagguagcaaugaauccucagaacaccguguucgacgccaaacggcuuauuggccgcaaguuuaaugauccagucgugcaggcugacaugaaacuguggccguuccaaguuaucaacgagggugggaagcccaagguguuggucucuuacaaaggagaaaauaaggcauuuuauccugaggaaauaucaaguaugguguuaacaaaacugaaggagaccgccgaggcuuuccuaggccauccaguaacuaacgccguuaucacagugcccgcguacuuuaaugauagccagcgacaggcaaccaaagacgccggcgucauugcugggcucaacgugcugcguaucauuaaugaaccuacggccgcagcuaucgccuauggacuugauaaggguggccagggggagagacacgugcugauauucgacuugggaggcgguacuuuugaugucuccauucucaccaucgacgaugggauuuucgaaguuaaggcgacagccggagacacucaucugggcggcgaggacuuugauaacaggcuggugucucacuucguagaggaauuuaaacggaagcauaaaaaggacaucucgcaaaauaaacgcgcagugagaaggcuccggaccgcuugugagcgcgccaagcgaacauuaucaagcaguacccaggcuaaccuggaaaucgauucccuuuacgaggggauugacuucuauacgucuauaacuagagccagguucgaagaguugugcgcagaucuguuucggggaacacuagagccagucgaaaaagcccuccgugacgcuaagauggauaaggcgaaaauccacgacauugugcugguugguggcagcacccgcauccccaaggugcagagacuucugcaggauuacuucaaugggagggacuugaacaaauccauaaacccugaugaggcagucgccuacggagcugccgugcaagcagccauucucaugggcgacaagucagaaaaaguacaggaccuguuacugcucgauguugcuccacuuagucuggguuuggagacugccgggggcgugaugacagcacuaaucaagcggaauagcaccaucccgacgaagcagacccaaauuuuuacaacuuauucugacaaccagcccggaguccugauccagguguacgaaggcgagcgagcgaugaccaaagauaauaaccuccuggggcgcuucgaccuuacagggauuccuccagcucccagaggugucccucagauagaggugacuuuugauaucgacgccaauggcauucugaacguuaccgcaacagauaaguccaccgggaaagugaauaagaucacuaucacgaacgacaaaggaagguugucaaaggaagagauugaacggaugguacucgaugccgagaaguauaaagcugaagacgagguccaacgcgagaagauagccgcuaaaaaugcacuggaaagcuacgccuucaacaugaagagugugguuucugaugagggcuuaaaagguaagaucuccgaaagcgacaagaauaaaauucuggauaaguguaacgagcuacucucguggcuggaggugaaucagcuugcggaaaaagacgaguuugaccacaagagaaaagaauuggagcagaugugcaacccaaucauuacaaagcuguaucagggaggcuguaccggacccgccugcggcacuggguacgucccgggaaggccugcuaccggucccacaaucgaagagguggauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1713 - RNA, 2137 nt, Artificial Sequence
  mRNA product Design1 comprising derived and/or modified sequence from Homo sapiens__NP_068814.2 __HsHSPA2 (opt3)
gggagaaagcuuaccaugagcgccagaggccccgcuaucgggauugaccugggaaccacauacuccugcgugggugucuuccagcacggcaagguugagauaaucgcaaacgaucaagggaauaggacuacgccuucuuauguggccuuuaccgacacagaacggcucauuggagaugcggcuaaaaaccagguagccaugaauccaacuaacaccaucuucgacgcaaagcgccuuauuggccgaaaauuugaggaugccacagugcagucagacaugaagcauuggccguuccgugucgugagugaaggugggaaacccaagguucagguggaguacaagggagaaaccaaaacauuuuucccugaggagaucagcuccaugguccugacuaagaugaaagaaauagcugaggcauauuugggcggcaaggugcacucugccguaaucaccguuccagcuuacuuuaaugauucgcaaagacaggccacgaaagacgcggggacuauuaccggauuaaacgugcugaggaucauuaaugaacccacagcagccgcuaucgccuauggucuagauaagaagggcugugcagggggagagaaaaacguccucauauucgaccugggcggugggacuuuugaugugucaauucuuaccaucgaggacggaauuuucgaagucaagagcacagcuggcgauacccaucugggcggggaggacuuugacaaucggauggugagucacuuggccgaagaguucaaacgcaagcauaaaaaggauaucggaccuaacaaaagagcgguuaggcggcuccgcacggccugcgaacgagcaaagagaacucuguccucuagcacacaggcuuccaucgagauugacucacuguacgaggguguggauuuuuauaccaguauaacuagggcccgguucgaggaacucaaugcugacuuauuccguggcacacuggaaccaguagagaaggcccuucgcgaugcaaaauuggacaaggggcagauccaagaaauugugcuggucggaggcagcaccagaauccccaaaauacagaagcuacuccaggacuuuuucaacgguaaagagcugaauaagucuauuaacccugaugaggccguggcuuacggggcggcaguucaggccgcuauccuuaucggcgauaaguccgaaaaugugcaagaccuguugcuccuggaugucacgccauuaucacugggaauugagaccgccggcggggugaugacaccgcucaucaaaaggaacacuaccauucccacaaagcagacucagaccuuuacaaccuacagcgacaaccaaaguucuguacuuguucagguguaugaaggagagcgggcaaugacuaaagacaauaaccuguuggguaaguucgaucuaacgggcauaccuccagcuccccgaggggucccucagaucgaagugacauuugacauugaugccaauggaauccugaacgucaccgccgcagacaaauccacuggcaaggagaauaagaucaccauuacaaacgauaaaggucgccucagcaaggacgauauagacagaauggugcaggaggcggaaagguacaaaucggaggaugaagcuaaucgggaccgcguugccgcaaagaacgcccuggagucuuauaccuacaauaucaaacaaacuguggaggaugaaaaacuuagagggaagauuuccgagcaggacaagaacaagauccuggauaaaugucaggaaguaauuaauugguuggacaggaaccagauggcugagaaggacgaauaugagcacaaacaaaaggagcucgaacgugucugcaauccaaucauaucaaaacuguaccagggcggacccggcgggggaagugguggcgggggaagcggcgccuccggugggccgacaaucgaggaaguggauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1714 - RNA, 2740 nt, Artificial Sequence
  mRNA product Design1 comprising derived and/or modified sequence from Homo sapiens__NP_002145.3 __HsHSPA4 (opt3)
gggagaaagcuuaccaugagcguggucggcaucgaccugggguuccaguccugcuacguugccguggcuagagcaggagguauugagaccauagccaacgaauauucugauagguguacacccgcgugcaucucauuuggcccuaagaaucggaguauuggggcugccgcaaaaagccaaguaaucuccaacgccaagaauacugugcagggauucaaacgcuuucacggccgagcuuucucugacccauuugucgaggcagaaaagucgaaccucgccuacgauauugugcagcuuccgacgggucugaccgggaucaaaguuacauauauggaggaagaacguaauuucacuaccgaacaggugacagcuauguuguuaucaaagcugaaggaaaccgccgagagcguccucaaaaagcccgugguagacuguguugugagugucccuugcuuuuacacugaugcggaaagaagguccgugauggacgcaacacaaauagccggacuaaacugucugcggcuuaugaaugagaccacggcuguggcccuggcauauggcaucuacaaacaggauuugccagcucucgaggaaaagccccgcaacgucguuuucguggacaugggccauucugccuaucagguaagcgugugcgcguuuaauagagggaaacugaagguccuggccacugcauucgauaccacacucggagguaggaaguuugacgagguguuaguuaaccacuucugugaagaguuuggcaaaaaguacaaacuggauauuaaguccaaaauccgggcucuuuugcgccugucacaggaaugcgagaagcucaaaaagcuaaugagugccaaugcuagcgaccugccucuuucuauugaguguuucaugaacgauguggacgucuccgggacuaugaaucgaggaaaguuccuggaaaugugcaacgacuugcucgccagaguggagccaccccugaggucaguauuagaacaaaccaaacugaagaaagaggauaucuacgcaguugaaauagugggcggugccacacggauuccugcugucaaggagaaaaucagcaaguuuuucgggaaggagcucaguaccacgcuuaaugcggacgaagcagugacucguggaugugcccugcagugcgcuauuuugucuccagccuuuaaaguccgcgaguucuccaucacagaugugguuccguaucccaucagccuaagauggaacucgccugcagaagaggggucuuccgacugcgaaguguuuucaaagaaccaugccgcuccauucaguaaaguacugaccuuuuacaggaaggagcccuucacucucgaggccuauuacagcuccccucaggaucugccauaucccgacccggcaauugcgcaguuuucuguccaaaaagugacaccucagagcgauggcucaaguuccaagguuaaggugaaaguccgggugaauguacacggcauauucagcgugucuucagcuagucuuguugaaguccauaagagcgaggaaaacgaggagcccauggaaaccgaccagaaugccaaagaggaagagaagaugcaaguggaucaggaggagccacacguggaggaacagcagcaacagacgccugcagagaacaaagccgaauccgaggaaauggagaccucucaggcuggaucgaaggacaagaaaauggaucagcccccacaagccaagaaagcaaaggucaaaacaagcacuguugaccugcccaucgagaaucaguugcucuggcagauugaccgagaaaugcugaacuuauacaucgagaaugaagguaagaugauaaugcaggauaaacuggagaaggaacgcaacgacgcuaagaaugccguggaggaguauguguacgaaaugagagauaaacuauccggcgaguacgaaaaguuuguaucagaggacgauaggaacaguuucacccucaaacuggaggacacagaaaauuggcuuuaugaggauggggaagaccaaccuaagcaggucuacguggauaaauuggcggagcugaagaaccucggacagccaauuaagauccgguuucaggaaucugaggagcgcccgaaacuguucgaggagcuuggcaagcaaauccagcaguauaugaaaauuaucagcuccuucaagaauaaagaagaccaauacgaucaccuggacgccgcugauaugacuaagguugagaagucaaccaacgaagcaauggaguggaugaauaacaaauugaaccuccagaauaagcagagccugacaauggaccccguggucaaaucuaaggagauugaagccaaaauaaaggaguuaaccuccacuuguaguccuaucauuagcaagccaaaacccaagguggaaccuccaaaagaggaacagaagaacgcugagcaaaauggucccguugacgggcagggcgauaacccgggaccucaggccgcagagcagggcacggacacagcggugccaucugauuccgacaaaaagcugcccgaaauggauaucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1715 - RNA, 2737 nt, Artificial Sequence
  mRNA product Design1 comprising derived and/or modified sequence from Homo sapiens__NP_055093.2 __HsHSPA4L (opt3)
gggagaaagcuuaccaugagcguggucggcaucgaccugggguuccucaacugcuacauugccguugcuagauccggagguauagagaccaucgcaaaugaauauucugauagguguacacccgccugcauuucacuuggcagucggacucgcgcgaucgggaacgcugccaagagccagauugugacgaauguacgaaacaccauccacggauuuaaaaagcugcauggccguuccuucgacgauccuauagugcaaacagagagaaucagguugccauacgaauuacagaaaaugccgaaugguucugcaggggucaaggugcgguaucuggaggaagagagacccuuugccauugagcagguuacuggaaugcuacucgcuaaacugaaggaaaccucggagaacgcacuuaagaaaccuguggccgacugugucaucucaauucccagcuucuuuacagaugcugaaagaaggagugugauggccgcggcacagguagccggccugaauugcuugcggcucaugaacgagaccacugcuguugcccuggcauacggcaucuauaagcaagaccugccaccucucgaugagaaaccacgcaauguggucuucauagacauggggcacuccgcuuaccagguguuagugugugccuuuaacaagggaaaacugaagguccuugcgacaaccuucgaucccuauuuggguggccgaaauuuugacgaagcccugguugauuacuucugcgacgaguuuaagacgaaauacaagauuaacgugaaagaaaauucuagagcacuacucaggcuguaucaggagugugaaaaacuuaagaagcugaugagcgcuaacgccuccgauuugccucucaauaucgagugcuucaugaacgaccuggacguaucaaguaaaaugaaccgggcucaguuugagcaauuaugugccagccugcucgcacguguggaaccaccgcuuaaggccgucauggagcaggcuaaucugcagcgcgaagauauuucuuccaucgagaucguugggggagcgacucgcauucccgcagugaaggaacagauaaccaaauucuucuugaaggacaucucaacaacucuaaacgccgaugaggcuguggccaggggcugcgcacugcaaugugccauucucagcccugcuuuuaaaguccgggaguucaguaucaccgaccuggugccauacucuauaacacuucgauggaagaccuccuuugaagaugguagcggggagugcgaaguauucugcaaaaaucaucccgccccuuuuucgaagguuauuacguuccacaagaaagagccauuugaacuggaggcauucuauacuaacuugcaugaggugcccuacccggacgcgcgcaucggaucuuuuacaauccagaaugucuucccucaguccgauggcgacucaaguaaggugaaagucaaggugagaguuaacauucacggcaucuuuagcguggcuuccgccucuguaauugaaaaacaaaaucucgagggggaucacagcgacgcacccauggaaaccgagacuucauucaagaacgagaauaaggauaacauggacaaaaugcaggucgaccaggaagagggacaucagaagugucacgccgaacauacaccagaggaagagauagaucacaccggugcuaaaacgaagagugccguguccgacaaacaagauaggcugaaucagaccuuaaagaagggcaaaguuaagagcaucgaccugccuauucagucuucacuaugccggcagcucgggcaagaucugcuuaacaguuauaucgagaaugaaggaaaaaugaucaugcaggacaaguuggagaaagaacgcaacgaugcaaagaaugcuguggaggaauacgucuaugacuuuagagauaggcugggcacaguguacgagaaauucauuacucccgaggaccucagcaagcuguccgccguacuugaagauaccgagaacuggcuguacgaagacggugaggaucagccaaaacagguguauguugacaaguugcaagaacucaagaaauacgggcagcccauacagaugaaguauauggagcacgaggaacguccuaaagcgcugaacgacuuaggcaagaagauccagcuggucaugaaagugauugaggccuaccggaauaaggaugaacgauaugaccaucuagauccaacagagauggagaaaguggaaaaguguaucucugacgcuaugucguggcucaacagcaaaaugaaugcacaaaacaagcugucccuuacucaggauccggucguuaaggugucagagauuguggccaaaaguaaggaauuggacaauuucugcaaccccaucauauacaaaccuaagccaaaagcugagguacccgaagauaagccuaaggccaauucugagcacaacggaccaauggacggccagagcgggaccgagacaaaauccgauucaaccaaggacagcucucaacauacuaaauccaguggagaaauggaggucgauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1716 - RNA, 2182 nt, Artificial Sequence
  mRNA product Design1 comprising derived and/or modified sequence from Homo sapiens__NP_005338.1__HsHSPA5 (opt3)
gggagaaagcuuaccaugaagcugagccucguggccgcuaugcuucuguuguuauccgcagccagagcggaggaagaggacaaaaaggaagaugucggcaccguuguggggaucgaccugggaacaacuuacucuugcguagguguguucaaaaacggcagggucgagauuauagcuaaugaucaggggaaccggaucacgcccucauauguggccuuuaccccugaaggagagcgccuaauuggcgacgcagccaagaaucaacucacaaguaacccagagaauacuguuuucgaugcuaaacgacugaucggucguaccuggaacgacccgagcgugcagcaggauauuaaguuucuucccuucaaggucguggaaaagaagacaaaaccuuacauccagguagacauagggggaggccaaaccaagacuuuugcaccagaggaaaucuccgccaugguucugacaaaaaugaaggagaccgcugaggccuauuugggcaagaaagugacgcacgcggucgugacugugcccgcauacuucaaugaugcccagagacaggcuaccaaggacgccgggacaauugcaggacucaacgucaugaggaucauuaaugaaccuacugcugccgcgaucgccuauggucuggauaaacgggagggcgaaaagaacauacugguuuuugaccucgggggaggcaccuucgaugugucuuuacugacaauugacaaugguguauuugagguggucgcaaccaacggggacacgcaucuuggaggcgaagauuucgaccagcgcgugauggagcacuuuaucaaauuguacaagaaaaagacuggcaaggauguuagaaaagacaauagggcugugcaaaagcugcggcgcgaggucgaaaaagccaagcgagcucuaucgucacagcaucaggccagaauugagaucgaaucuuucuaugagggggaagauuuuagugagacacucaccagggcaaaauucgaggaacugaacauggaccuuuuccgguccacuaugaagccagugcagaagguacuggaggauucugacuugaaaaagagcgauaucgacgaaauuguucucgugggagguuccacacguauacccaaaauccaacagcuggucaaggaguuuuucaauggcaaagaaccuucacgcgggauuaacccagaugaggccguggcuuacggagcggcaguccaggccggcguguuaaguggugaccaagacaccggggaucugguucuccuugacguguguccgcugacguugggcaucgagaccguaggaggcgucaugacaaagcuaauacccagaaacacugugguuccuaccaagaaaagccagauuuuuagcacagcuuccgauaaucagccaacugugaccaucaaggucuacgaaggggagaggccccugacaaaagacaaccaccuccugggaaccuucgaucuuacugguaucccuccagcaccccggggcgugccgcagauugaaguaacguuugagaucgacgugaaugggauucugcgaguuacagccgaggauaagggaaccggcaacaaaaauaagauaacuaucaccaacgaccaaaaucgcuugacaccugaagagauugaaagaauggucaacgaugccgagaaguucgcugaagaggacaaaaagcucaaagagaggaucgauacccggaaugaacuggagucauaugccuacagcuuaaagaaccagaucggugacaaagaaaagcuagggggcaaacugaguucugaggauaaggaaacuauggagaaggcaguggaggagaaaauugaauggcucgaaucccaucaggacgcggacauagaggauuuuaaggcuaaaaagaaagaacuggaggagaucgugcagcccauuaucagcaaacuuuauggaucggccggcccaccucccacaggggaagaggacacggcagaaaaggaugaguugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1717 - RNA, 2149 nt, Artificial Sequence
  mRNA product Design1 comprising derived and/or modified sequence from Homo sapiens__NP_002146.2__HsHSPA6 (opt3)
gggagaaagcuuaccaugcaggcccccagagagcuggcugugggcaucgaccucgggaccacauacagcugcgucggaguuuuccaacaggguaggguggaaauucuugcaaacgaucagggcaaucggacuacgccuuccuauguagccuuuaccgacacagagcgccuggugggggaugcggcuaagucucaggccgcauugaacccacacaauacugucuucgacgccaaacgauuaauaggacguaaguuugcugauaccacagugcaaucagacaugaaacauuggccguucagaguugugagugaaggcgguaagcccaaagucaggguguguuaccgcggggaggauaagaccuuuuauccugaagagaucagcuccaugguacugucuaagaugaaagagacugcagaagccuaccuaggacagccaguuaagcacgcugugauuacaguccccgccuauuucaacgacucgcagcggcaggcgaccaaagaugcaggcgccaucgcuggccucaaugugcugagaauuaucaacgagccuacggccgcagcuauagccuacgggcuugacaggcggggagcgggugaacgcaaugugcugaucuuugauuugggcgggggaacuuucgacgucucaguucucagcauugaugccggcguguuugagguaaaggcaaccgcuggugacacacaucucgggggagaggacuucgauaaccgacuggugaaucacuuuauggaagaguucagaaggaaacauggcaaggaccugaguggcaacaagcgggccuuacgucgccugagaacugcuugcgaaagggccaaacggacccuuuccucuagcacacaagcaaccuuggagaucgauucccuguuugaaggggucgacuucuauacgucaauuacucgagcccgcuucgaggagcuauguagugaucucuuuagaagcacacuggaaccaguggagaaggcucuuagggacgcgaaacuggauaaggcacagauccacgacguuguguuggucggagguucuacccggauacccaaagugcagaagcuccugcaggauuucuuuaauggcaaagaauuaaacaaguccauuaauccugacgaggccguagcuuacggggccgcaguucaagccgcugugcugaugggagauaagugcgaaaaaguccaggaccuccuucuguuggacguggccccacuaucacugggccucgagacugccgguggggucaugacaacccugauccagcgcaacgcgacgauuccgaccaagcaaacacagacuuucaccacauacagcgauaaucagcccggcguguuuauccagguuuaugagggagaaagagcuaugacuaaagacaacaaccuucugggcagguucgaguugagugggaucccuccagcaccccguggagugccucaaauugaaguaaccuuugauauagacgcaaaugguauccucucugucacagccaccgaucgguccacuggcaaggcuaacaaaauuacgaucacaaaugacaaggggcgacugagcaaggaggaaguggagagaaugguucacgaggccgaacaguacaaagcagaggaugaagcucagagggaccgcguggccgcgaagaacucguuagaggcccaugucuuccacgugaaaggaucucugcaggaggaaucccuacgggauaagauaccagaggaagacagaaggaaaaugcaagauaagugucgcgagguacucgcuuggcuggaacauaaucagcuugcagagaaggaggaauaugagcaccagaaacgagaauuggagcagauuugccggcccaucuuuucacgucuguacggcgguccgggggugccuggcggaaguagcuguggcacccaagccagacagggggaccccuccacuggaccaaucauugaagagguugauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1718 - RNA, 1321 nt, Artificial Sequence
  mRNA product Design1 comprising derived and/or modified sequence from Homo sapiens__P48741__HsHSPA7 (opt3)
gggagaaagcuuaccaugcaggcccccagagagcuggcugugggcaucgaccucgggaccacauacagcugcgucggaguuuuccaacaggguaggguggaaauucuugcaaacgaucagggcaaucggacuacgccuuccuauguagccuuuaccgacacagagcgccuggugggggaugcggcuaagucucaggccgcauugaacccacacaauacugucuucgacgccaaacgauuaauaggacguaaguuugcugauaccacagugcaaucagacaugaaacauuggccguuccagguugugagugaaggcgguaagcccaaagucagaguguguuacaggggagaggauaagaccuuuuauccugaagagaucagcuccaugguacugucuaagaugaaagagacugcagaagccuaccuagggcagccaguuaagcacgcugugauuacaguccccaccuauuucucgaacucacagcggcaagccacgaaagacgcgggcgcaaucgccggccucaaggugcugccuauuaucaaugaggcuacugccgcagcuauagccuacgggcuugaucgcagaggagcggguaaaaggaacgugcugaucuuugacuugggcgggggaaccuucgaugucagcguucucaguauugacgccggcguguuugaaguaaaggcaacagcuggugauacucaucuugggggagaggacuucgacaaucggcuggugaaccacuuuauggaggaguuccgccgaaagcauggcaaagaucucuccggcaauaagagagccuuaaggcggcugcguaccgcuugcgagcgcgccaaaagaacaccaucuagcuccacccaggcaacgcuugaaaucgacucauuguuugagggggucgauuucuauaagaguauuacuagggcccgguucgaagaacuguguagcgaccuauuucgaucuacacucgagcccguggaaaaagcucugcgcgaugcgaagcuggacaaagcacagauccacgauuucguucugggagguggcuugcacucccauccucagggggccgagguggcugccggacuccugcaaagacagggcgcagaacaggagcaccaaccaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1719 - RNA, 2158 nt, Artificial Sequence
  mRNA product Design1 comprising derived and/or modified sequence from Homo sapiens__NP_006588.1 __HsHSPA8 (opt3)
gggagaaagcuuaccaugagcaagggccccgccguggggaucgaccugggaaccacauacuccugcgucgguguuuuccagcacggcaaaguggagauuauagcuaacgaucaagggaauagaacuacgccuucuuauguagcauuuaccgacacagaaaggcucaucggagaugccgcgaagaaccagguggcuaugaauccaacuaacaccgucuucgacgccaaacggcuuauuggccgccgauuugaugacgcagugguucagucagauaugaagcauuggccguucaugguggucaaugacgccggucgucccaaagugcagguagaguacaagggggaaacaaagaguuuuuauccugaggaaguuagcuccauggugcugaccaaaaugaaggagaucgcugaggcauacuugggaaaaacugucacaaacgccguggugaccgucccagcuuauuucaaugauucucaaagacaggccacgaaggacgcgggcacuauugcaggcuuaaacguucugaggaucauaaaugaacccaccgccgcugccaucgcauacgggcuagauaaaaaggugggagcugagcggaacguacucauuuuugaccuggguggcgggacauucgaugugucgauccuuacuauugaagacggaaucuuugaggucaagucaaccgccggcgacacacaccuggguggggaggauuucgacaaucgcauggugaaccauuuuauagcggaauuuaaaagaaagcacaaaaaggauauuagcgagaauaaaagggccguucggcgcuugcgaaccgcaugugaaagagcuaagaggacgcucaguuccucuacucaggccagcaucgagauugacucccuguaugaaggaaucgauuuuuacacaucaaucacccgggcucguuucgaggagcugaacgccgaccucuuccgcggcacuuuagauccuguggaaaaagcacugagagacgccaaacuugauaagagucagauucaugacauagucuuggugggcgggagcacaaggaucccaaagauucaaaagcugcuacaggauuucuucaauggaaaagagcucaacaagucuaucaaccccgacgaagcuguagcguacggugcagccguucaggcugccauacuguccggcgacaaaucagagaaugugcaggaucuucuguugcucgacgucaccccucugagcuuagggauugaaacggcaggaggcgugaugaccguccugaucaagcggaacacaacuaucccaaccaagcaaacacagacuuuuaccacauauagugauaaucagccgggugugcucauucaaguuuacgagggggagcgagccaugaccaaagacaacaaucuucugggcaaguucgaauugacuggaaucccucccgcuccacgcggcgugccccagauugagguaacguuugauauagacgccaacgggauccuaaaugucucugcaguggauaaauccacaggaaaggaaaacaaaauuaccaucacuaaugacaaggguagacugagcaaggaggauaucgaaaggaugguucaggaggcggagaaauauaaggcugaagacgagaaacagcgggauaaggugucgucuaaaaacucccucgaaucauacgccuucaauaugaaggcaaccgucgaggacgagaagcugcaaggcaaaauuaacgaugaagacaagcagaaaauacuugacaagugcaaugagaucauuaacuggcuggauaaaaaucagacagccgaaaaggaggaauuugagcaccagcaaaaagaguuggaaaagguguguaacccuaucauuaccaagcucuaucagagugcugggggaaugccaggcgguaugcccgggggcuucccgggaggcggggccccucccagcggaggugcauccucuggcccaacuaucgaggaaguagacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1720 - RNA, 2257 nt, Artificial Sequence
  mRNA product Design1 comprising derived and/or modified sequence from Homo sapiens__NP_004125.3 __HsHSPA9 (opt3)
gggagaaagcuuaccaugaucagcgccuccagagcugcagccgcgaggcuggugggcgcugccgcaucucgggggcccaccgccgcucgccaccaggacucauggaacggacucagucaugaggcauuccgacuugucagccguagagauuacgccuccgaagcuauuaagggugccguugugggcauagaccuggggacaacuaauucuugcguagcggugauggagggaaaacaagcaaaggucuuggaaaacgccgagggcgcuaggacgaccccuucggugguugccuuuacagcagauggugaacgguuaguggggaugccagcuaaacgccaggccgucacuaauccgaacaauaccuucuaugcgacaaagagacugaucggaaggcgguacgacgaucccgaggugcagaaagacauuaagaacguaccuuuuaagaucguucgcgccucaaauggcgaugcauggguggaggcucacggcaaacuauauagcccaagucagauuggggccuucguccucaugaagaugaaagaaaccgcugagaacuaccugggacauacugccaagaaugcagugaucacagugcccgccuauuuuaacgacucccaacgacaggcuaccaaagaugcgggucagauaucuggccuuaauguccugagaguuaucaacgaaccuacggcagccgcuuuggccuacgggcucgacaagagcgaggauaaggugauugcaguauaugaccugggaggcgguacuuucgauaucuccauucuggagauccagaaagggguguuugaagucaagucaaccaauggagacacauuccucggcggcgaggacuuugaucaagccuuacugaggcacauagugaaagaguucaagcgggaaacugggguugaccuuaccaaagauaacauggcuuugcagcgugugcgcgaagccgcagagaaggcgaaaugugagcugaguagcucuguccagacagacauuaaucuaccauaccucaccauggauuccucaggacccaagcaucugaacaugaaguugacgagagcucaguuugaagguaucgugacugaccugauuaggcggacaaucgccccuugccaaaaagcaaugcaggaugccgagguaagcaagagugacaucggcgaaguuauuuuggucgggggaaugacccgaaugccaaaagugcagcaaacugugcaggaucucuucggccgcgcuccgucuaaggccgucaaccccgacgaggcaguggcuauaggugccgcgauccaagggggcguucuggccggagaugugacagacguauuacugcucgacgucaccccucuuucccugggcauugaaacgcuugggggaguguuuaccaaacuaaucaauagaaacacaacuauaccaaccaaaaagagccagguuuucucgacagcugcagauggucagacucagguggagauuaaggucugucagggcgagagggaaauggccggggacaauaagcugcucggacaguucacccugaucggcauucccccugcuccacggggugugccccaaaucgagguaacauuugauaucgacgccaacgggauugugcacguuucugcaaaagauaagggcaccggacgcgaacagcagauagucauccaguccucaggcgggcuuaguaaagacgauauugagaauauggugaagaacgcggaaaaguacgccgaggaggacagaaggaaaaaggaacguguggaggcugucaauauggccgaaggaaucauccacgauacugagacgaaaauggaggaguucaaggaccaacugccggcagaugaaugcaacaaauugaaggaagagauuagcaagaugcgggaacuccuggcucgaaaagacuccgagacaggugagaauauaagacaggccgcaucuagcuuacagcaggccucacugaagcuauuugaaauggcuuauaaaaagauggcgagugagagggaaggcuccgggagcucuggaaccggcgagcaaaaagaagaucagaaggaggagaaacagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1721 - RNA, 2245 nt, Artificial Sequence
  mRNA product Design1 comprising derived and/or modified sequence from Homo sapiens__NP_079291.2__HsHSPA12A (opt3)
gggagaaagcuuaccauggccgacaaggaggcuggcgggagcgauggacccagagaaaccgcaccuacauccgccuacucuucaccagcgaggagucugggugacacuggcaucacgccgcucagccccucccacauugugaacgauaccgacucuaaugucucggagcagcaaucauuccuuguugugguagcuguggauuuugggacaacuagcaguggauaugccuacuccuucaccaaagaaccugagugcauacaugucaugcggcgcugggaaggcggugacccaggggugucuaaccagaagacacccaccacuauccuguugacaccugagcgaaaauuucacagcuucggauaugcagcccgugauuuuuaccaugacuuagauccaaaugaggcuaagcaguggcuguaucuagaaaaauucaagaugaagcuccacaccacgggcgaccugacuauggauaccgaccuuacagcagccaacggcaaaaagguuaaagcucuggagauuuuugccuacgcguugcaguauuucaaggaacaagcacucaaagagcuguccgaucaggccgggucagaguuugaaaauagugacgugagaugggucaucacugugcccgcuauuuggaagcagccugccaagcaguucaugaggcaagcagcuuaccaggccggacuggcgagcccagagaacucugaacagcucaucauagccuuagagccggaagcagcuuccaucuacugucggaaacugcgccuucaucagaugauugaguugucaagcaaggccgcuguaaaugguuauaguggcucugacaccguuggggccggauuuacacaagcaaaagagcacaucagaaggaaccggcagucccgcaccuuccugguggaaaaugucauuggcgagaucuggagcgaacuagaggaaggugauaaguacgugguggucgacuccgggggaggcacgguugaucucacugugcaccagauacgacugcccgagggccaucuuaaagagcuguauaaggccacagggggaccuuacgguucuuugggcguagacuaugaauuugagaaacuccuguacaagauuuucggggaagauuucaucgagcaauuuaagauuaaaagaccagcugcguggguggacuuaaugaucgcauucgaauccaggaagcgggccgcugcccccgaucguaccaacccucugaauaucacucucccauuuucauucauugacuauuacaaaaaguuucgcggacacagugucgagcaugcacuuagaaaaagcaacguggauuucguuaagugguccucucagggcaugcugaggaugagccccgacgccaugaaugcuuuguuuaagccgacaauagauucaaucauugagcaccuacgggaccuguuccagaaaccugaagugaguaccgucaaguuucucuuccugguggguggguuugccgaggcaccccuucugcagcaagcgguacaggcugccuucggcgaccagugccgaaucauaauuccacaggauguuggauugacgauccucaaaggcgcagugcuguuuggguuagacccugccgucaucaaggugcgcagaucgccccugaccuacggagucggugugcuaaacagguauguugaaggcaaacacccacccgagaagcuccuggugaaggaugggacacggugguguacugacguauucgauaaauucauuagcgcugaccaaucugucgcccuuggagaguuggugaagcgcucauacaccccugcaaaaccaagucagcugguuaucgugauuaauauauauagcuccgaacaugauaacgucucuuuuaucacagacccgggcgugaagaaaugcgguacucucagacuggaucuuaccgggacaucgggcaccgcuguacccgccaggcgugagauucagacucugaugcaguucggagacacggaaaucaaggcgacagccaucgauauugcuaccagcaaguccgugaaaguuggcauagacuuuuugaacuacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1722 - RNA, 2278 nt, Artificial Sequence
  mRNA product Design1 comprising derived and/or modified sequence from Homo sapiens__NP_443202.3 __HsHSPA12B (opt3)
gggagaaagcuuaccaugcuggccgugcccgagaugggccuccaggggcuuuacaucggaagcuccccugaaagaucuccagucccgucacccccugguaguccaaggacccaagagagcugcggcauugcuccccugacaccuucccagucuccaaagcccgaaguucgggcaccucagcaggccucguucucagugguaguggcgauagacuuugggacuacgagcaguggauaugcuuucuccuuugccucugauccagaggcaauccacaugaugcgcaaaugggaaggcggugacccgggggucgcccaccaaaagacccccacauguuuguuacugacuccugagggagcuuuccacagcuuuggcuacaccgcacgagauuauuaccaugaccuagauccagaggaagcccgugacuggcucuauuucgagaaauuuaagaugaaaauucacuccgcuacagaucugacccuuaagacucagcuggaagccgugaacggcaagacaaugcccgcguuggagguuuucgcacaugcccucagauuuuucagggagcacgcucugcaggaacugcgggagcagucaccuagucucccagaaaaagacaccgugcgcugggucuuaacggugcccgccaucuggaagcaaccggcaaaacaguuuaugagagaggcugccuaccuggcggggcuuguaagcagggaaaaugccgagcaguugcugauugcacuagagccugaagcugccucuguuuauugccggaagcuccgccugcaccagcuucuggauuuguccggacgagcucccgguggcgggagacucggagagaggcggucaaucgacagcaguuuccgucaagcccgcgaacagcugagaaggucucggcauucccgaaccuuuuuaguggagagcggcgucggugaacugugggcagagaugcaggccggggaucgcuacgugguggcugacuguggaggcggcacugucgaucucacaguucaccaacuugagcagccacaugggacucugaaagaauuguacaaggcgucgggagguccuuauggcgcaguggggguagaccuagccuucgagcagcugcucugcagaauauucggagaagacuuuaucgcuaccuucaagaggcagcggcccgccgcauggguggaucugacaauugccuuugaggcucgcaaaagaaccgccggcccacacagggcgggugcacuuaacaucucucugcccuucuccuuuauugacuucuaccguaagcaacgggggcacaaugucgaaacggcuuugcgaagaucaagugugaacuuuguuaaauggagcucccagggcaugcucaggaugucuugugaggccaugaaugagcuguuccagccuacugugagcggaaucauacagcauauugaagcauuacuggcccgcccagagguccaaggcgugaagcuacucuuucugguagggggauucgcugaaucagccguucuucagcacgcagugcaggcugccuugggugcgcggggccugagagucguggucccgcaugauguggggcucacaauccugaaaggagccguucuuuuuggccaggcucccggugugguaaggguccgccgaaguccucugaccuauggggugggcguuuugaaccgguucgugccaggacgucaucccccugagaagcuccuggucagagacggcaggcgcuggugcacugauguguuugagcgguucguagcagccgaacaauccguggcuuuaggggaggaaguuagaaggagcuacuguccagcccgacccggacagcgccggguccugauuaaucuauauugcugugcagcggaggacgccagauucaucacagauccgggugugaggaaaugcggcgcucucucucuggaacuugagccugccgacugugggcaggauaccgcaggagcuccacccggccgucgcgagauccgggccgcaaugcaguuuggugacacggaaauuaaggugaccgccgucgauguuucaacaaacagaagugugagggcuagcauagacuucuuguccaauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1723 - RNA, 1633 nt, Artificial Sequence
  mRNA product Design1 comprising derived and/or modified sequence from Homo sapiens__NP_008879.3__HsHSPA13 (opt3)
gggagaaagcuuaccauggcccgggagaugaccauccugggcagcgcugugcucacacuucuguuggcaggguacuuagcccagcaauaucugccccuaccuacuccaaaggucauuggaauagaccucgguacgaccuacugcuccguuggcguguucuuuccggggacaggaaaaguaaaggugauccccgaugaaaacggccacauuucuaucccuucaauggucaguuucacugacaaugauguguauguugguuacgagagcguggaacuggcggacuccaacccacagaauaccauuuaugaugcuaaaagguuuaucgggaagauauucacagccgaggaacuugaggcagagaucggacgguaccccuuuaaaguccugaacaagaauggcaugguggaguucucuguaaccucgaacgaaacuauuacaguuucaccugaauaugugggcagccgcuugcuccugaagcugaaagagauggccgaggcuuaccucgggaugccagucgcaaaugccgugaucagugugcccgcugaauuugacuuaaagcagcgaaacuccaccauugaggccgcgaaucuggcaggacuuaaaaucuugcgugucauaaacgaaccuacggccgcugccauggcauacggucugcauaaggcugauguuuuccacgugcuaguaauugaccucggcgggggaacucuggaugugucucuucugaauaaacagggcgguauguuuuugaccagagccaugagcgggaacaauaagcucggaggccaagacuucaaccagaggcuguuacaguaucuguacaagcagaucuaucaaacauacggcuuugucccaucccggaaagaggaaauucaucgccucagacaggcgguggagaugguuaaguugaaucugacuuugcaccagucagcccagcuaagugugcugcucaccgucgaggaacaagauaggaaagagccgcauagcucugacacagaacugcccaaggauaaacuuuccucagcagacgaccaccgggugaacagcggguucggacgcggucugagugauaagaaaucuggcgagucccagguauuguuugaaaccgagaucagccgaaaacucuucgacacgcugaacgaggauuuauuccagaagauccugguuccuauucaacaggugcuaaaggaagggcaccucgagaagacugaaauagacgaggucgugcuggucggaggcucgacaagaaucccaaggauuagacaggugauccaggaauuuuucgguaaagaucccaauaccucuguugacccugaucuugcugugguaacuggggucgccauacaagcuggcauugacggaggcuccuggccacuucaggugucagcccuggagauccccaacaagcaucuccagaaaacaaauuuuaacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1724 - RNA, 1747 nt, Artificial Sequence
  mRNA product Design1 comprising derived and/or modified sequence from Homo sapiens__NP_057383.2__HsHSPA14 (opt3)
gggagaaagcuuaccauggccgcuaucggcgugcaccuggggugcaccagcgcaugugucgccguuuacaaggacgguagagcgggagugguagcuaacgaugccggcgacagggugacacccgcagucguggccuauuccgagaaugaagagauuguugggcucgcugcaaaacagucucggauacgcaacaucucaaauacugugaugaaggucaaacaaauucuuggacgaaguagcuccgauccucaggcccagaaguacaucgcugaaucuaaaugccuggugauugagaagaacggcaaguugcguuaugaaaucgacacgggugaggagaccaaauucguaaauccagaagauguugccagauuaauauuuucgaagaugaaagagacagcgcauucagugcuggggagcgacgcaaacgaugucgugaucacugugccguucgacuuuggagaaaagcagaaaaaugcccuaggcgaggcugccagggcagcuggcuucaacguccuccggcugauucacgagcccagugccgcgcuucuggccuacgggaucggacaagauuccccuaccgguaagucuaauauuuugguuuuuaagcucggcgggacaagccugucccugucagugauggaaguaaacaguggaaucuaucgcgugcucagcaccaauacugacgauaacauaggcggugcacauuucacagagaccuuagcucaguaccuggccucugaauuucagagauccuucaaacacgacgucagggggaaugcucgggccaugaugaagcugacgaacucagcagagguggccaaacauagcuugaguacucugggaucugcuaauuguuuucuagauucccucuaugaaggccaggacuucgacugcaacguuagccgcgcgcgauuugagcugcuuuguucgccacuguucaacaagugcauugaggcaaucagaggcuugcucgaucaaaauggguuuaccgccgacgauauuaacaaagugguccuguguggagguucuuccaggauccccaaguuacagcagcugaucaaagaccucuucccugcuguggaacuucuuaauucaauuccacccgaugagguaauaccuaucggcgccgcaauugaagccgggaucuugauaggaaaggagaaccuacugguugaagacagucucaugauugagugcagcgcucgggauauccuggugaagggcgucgacgaguccggugccucucguuucacagugcuuuuuccaagcgggacuccgcugcccgcacgcagacagcacaccuugcaagcgccuggcucaaucaguuccgucugucucgaacuguacgagagcgauggcaaaaauucugcuaaggaagagacaaaauucgcccaggugguuuuacaggaccuggauaagaaagaaaacggacuaagggacauucucgcagugcugaccaugaagcgggacgggucacuucacguaacgugcacugaucaagagacaggaaagugugaggccaucaguauugaaauagcuagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1725 - RNA, 2794 nt, Artificial Sequence
  mRNA product Design1 comprising derived and/or modified sequence from Homo sapiens__NP_006635.2 __HsHSPH1 (opt3)
gggagaaagcuuaccaugagcguggucggccuggacguugggucccagucuugcuacaucgccguggcuagagcaggagguauugagaccauagccaacgaguucucagauagguguacacccaguguaaucagcuuuggcuccaagaaucggacuauugggguggcggcuaaaaaccaacagaucacgcacgccaauaacaccgucucuaauuucaagcgcuuucauggacgagcauucaacgacccuuuuauucagaaagagaaggaaaaucucucguaugaucuugugccacugaaaaacggcgguguugggaucaaggugauguacaugggagaggaacacuuguucucagucgagcagauaacagccauguuacugacuaagcuaaaagagaccgcugaaaauagccucaagaaaccggugacagacugcguaaucaguguucccuccuuuuucaccgaugcagagcguagaucugugcuggacgccgcucaaauugucggccuuaacugucugagguugaugaaugauaugacugccguggcgcucaacuauggcaucuacaagcaggaccugccuagccuggaugaaaaaccacggauuguggucuuuguugacauggggcauuccgcauuccaggugucagccugcgcuuuuaauaagggaaagcucaaaguauuagguacagccuucgaucccuuucugggcgggaagaacuucgacgagaaacuuguggagcacuucugugcagaauuuaagaccaaauauaaguuggaugcuaaaaguaagauccgcgcccugcuaagacucuaccaggagugcgaaaagcugaaaaagcugaugagcucuaauuccacggaccuuccuuugaacauagaguguuucaugaacgacaaagaugucucaggaaagaugaauaggagccaauuugaagaacucugcgcggagcuguuacagaaaauugaagugccacuguauagucuccuugagcagacucaucugaagguugaagacgugucugccgucgagaucgugggcggugcaacccggauucccgcuguaaaggaacgcaucgccaaauucuuugggaaggauaucuccacaacuuugaacgcugacgaggccguugcacgaggaugugcccuacagugcgcuauucugagcccugcguucaaagugagagaguuuucggucaccgaugcagugccauucccgauaucucucaucuggaaucacgacuccgaagauacagagggcguccacgaaguguuuucaaggaaccaugccgcucccuucaguaagguucugaccuuucuucggcguggcccuuucgagcuggaagccuuuuacagcgacccacaaggggugcccuacccugaggcaaaaauuggacgcuucguaguccagaauguguccgcccagaaggauggugagaagucuagaguuaaagugaaggucagggugaacacgcacggcaucuucacuauaagcacagcuucaaugguagaaaaagugccaaccgaggaaaaugagaugaguuccgaggccgacauggaauguuugaaccaacggcccccggagaauccugauacugacaagaacguucagcaggacaauagcgaagcagggacacagccccaaguccagaccgaugcgcagcagacgucucaaucaccaccuagucccgagcucaccagcgaagagaacaaaauuccagacgcugauaaggccaaugagaagaaaguggaccagcccccugaagcaaagaaaccaaagaucaaaguggucaacguugagcugccgaucgaagccaauuuaguguggcagcugggaaaggaucuacucaacauguauauugagacagaaggcaaaaugaucaugcaggacaagcuggagaaggagcgaaacgaugcuaaaaaugccguggaagaguacguauaugaauuucgcgacaaacuuugcggucccuacgagaaauucauuugcgaacaagaucaucagaacuuuuugagacugcucacugagaccgaggacuggcuguaugaagagggggaagaucaggcaaagcaggcuuacgucgacaaacuugaggagcugaugaagauaggcacaccugugaagguuagguuccaagaagccgaggaacggccaaaaauguuugaggaauugggacagcgccuccagcacuaugcgaagaucgccgcugauuucagaaauaaagacgagaaguacaaccacauugacgaguccgaaaugaaaaagguggagaagucugucaaugaagugauggaguggaugaacaauguuaugaacgcacaagccaaaaagucgcuggaucaggaccccgugguaagggcucaggaaaucaaaacuaagaucaaagaguuaaauaacaccugugagccugucgugacacagccaaagcccaagauugaaagcccgaaacuggagcguaccccuaauggcccaaacauagauaagaaagaagaggaccuagaagauaagaauaacuuuggggccgagcccccucaucaaaauggagagugcuaccccaacgaaaagaacuccgugaauauggaccucgauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1726 - RNA, 3217 nt, Artificial Sequence
  mRNA product Design1 comprising derived and/or modified sequence from Homo sapiens__NP_006380.1 __HsHYOU1 (opt3)
gggagaaagcuuaccauggccgacaaggugagaaggcagcggccccgccgacgugucugcugggcucugguugcagugcuccuugccgaucuguuggcguuaagcgacacccuggcuguaauguccguggaucuaggcucugagucaaugaaagucgccaucgugaagccugggguuccaauggaaauugugcucaacaaagagaguagaaggaagacaccggucauagugacucugaaagaaaaugagcgguucuuuggagacagcgcagccuccauggcuaucaagaaccccaaggcaacgcuucgcuacuuccaacaccuguuggguaaacaggccgauaauccucauguagcucucuaucaggccagauuuccagaacacgagcugaccuucgacccccagaggcaaacaguucauuuucagauuucuucgcagcugcaguucucaccugaggaagugcucggcauggucuuaaacuacagccggagucuggcggaggauuuugcagaacaaccaaucaaggacgccgugauuacugugcccgucuucuuuaaucaggcugagcgccgagccguucuucaggcagcuagaauggccggguugaaagugcugcagcuaaucaacgauaauaccgcgacagcccucuccuauggaguauucaggcggaaggacauaaacaccacugcacaaaauaucauguuuuacgauaugggcucugguagcacaguguguaccauugucacguaucagauggugaaaacuaaggaggcugggaugcagccucaacugcagauccguggaguuggcuucgaccgcacccuuggcgggcuggaaauggaguugagacucagggaacggcuggccggauuauuuaacgagcagcgaaagggucagcgcgcuaaagaugugagagaaaauccaagggccauggcaaagcugcuccgggaggccaaccgccuuaaaacaguccuguccgcuaaugcggaccacauggcacaaauugagggcuugauggacgauguggacuucaaggccaaaguaacuagaguugaguucgaggaacuaugcgcugaucuguuugagagggugccggggcccguccagcaggcccuccagucagcagaaaugagucuggacgagaucgagcaagugauacuugucggaggcgccacccgugugccucggguucaggaagugcuguugaaggcuguagguaaagaggaacucgggaagaacauuaaugccgaugaggcagcggcuaugggagccgucuaccaggcagccgcucugagcaaggccuucaaagugaagccauuuguugugcgagacgcagucguguaucccaucuuaguagaguucacaagagagguggaggaagaaccuggcauucauucucugaaacacaacaagaggguucuauuuucccgcaugggcccauacccccagcggaaagucaucaccuucaacagauacucacacgauuuuaauuuccauaucaacuauggggaccucggauuucuggguccggaagaucuuaggguguucggcagccaaaauuugacgacugugaagcugaagggggucggagacaguuuuaaaaaguacccugauuaugagucuaaaggcauuaaggcucacuucaaccucgacgaguccgguguucugagccuugaccgcguggaaucgguguuugagacacugguagaagauucugccgaggaagaguccaccuugacuaaacucgggaauacaauaucaagucuguucggcggaggcaccacgcccgacgcgaaggagaacgggaccgauacaguccaggaagaggaagagagcccagccgaaggauccaaggacgagccuggugaacagguggaauuaaaagaggaagcugaggcacccguugaagauggcucucagccacccccuccagagccgaagggggacgccacucccgagggagaaaaagcuaccgagaaggaaaauggcgauaaaagcgaggcccaaaagccuucagagaaggcagaagcggguccagaggggguggcccccgcuccugaaggcgagaaaaagcagaaaccagcccgaaagcggcguauggucgaagagaucggaguggagcugguugugcuagaccuccccgaucugccggaagacaaacuugcacagaguguacaaaaguugcaggaucugacacucagagaccuggagaaacaggaaagggagaaggcugccaacuccuuagaagcauucauuuuugagacucaggauaagcuguaccaaccugaguaucaggaagucagcaccgaggaacagcgcgaggaaaucucuggcaaacuuucagccgcuaguacaugguuggaggacgagggggugggagcgaccacugugaugcucaaggaaaaacuggccgagcuacggaagcugugucagggucucuucuuuagagucgaagagaggaaaaaguggccagagcgacugagcgcacuugacaauuugcugaaccauuccucuauguucuuaaagggcgcucgccucauacccgaaauggaucaaauuuuuacggagguugaaaugacaacccuggagaaagugaucaaugaaacuugggccuggaagaacgccacccuugcugagcaggcaaaacugccugccacagagaagcccguauugcucucgaaagacaucgaagcgaagaugauggcucuggaucgggaggugcaguaccuacugaauaaggccaaauucaccaagccaagaccuaggcccaaagacaagaacgggacucgugcagaaccaccgcucaaugccagcgcuuccgaucagggagagaaagucauuccucccgcaggccaaacagaagacgccgagccaaucucagagcccgaaaagguggagacggguagugaaccuggggauaccgagccacuggaacuuggcggacccggcgcggagccugagcagaaggaacagucuacugggcaaaaacgcccguugaagaacgacgagcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1727 - RNA, 2416 nt, Artificial Sequence
  mRNA product Design1 comprising derived and/or modified sequence from Homo sapiens__NP_005339.3 __HsHSP90AA1 (opt3)
gggagaaagcuuaccaugcccgaggaaacccagacacaagaccagccuauggaggaagaggaaguggagacuuucgccuuucaggcugagaucgcacagcugaugagccucauuauaaacacguucuacuccaauaaggaaaucuuucuuagagagcugauuucuaacucaagugaugccuuggacaaaaucagguaugagagcuuaaccgauccauccaagcuggacucuggcaaagagcuacacauuaaucucaucccgaacaagcaagaucggacacugacuauagucgacaccgggaucggaaugacaaaagcggaucuuauuaauaaccuggguaccaucgcuaagucgggcacuaaggccuucauggaggcauugcaggccggggcugacauuucaaugaucggacaguuuggcguugguuucuacagcgcauaucucguggccgaaaaaguaacagugauaaccaagcauaaugaugacgagcaguacgcuugggaaaguuccgccgggggaucuuuuacgguccgcacugauaccggcgagcccaugggccgagggacaaaagugauucugcaccugaaggaagaccaaacugaguaucucgaggaacguagaaucaaagagauuguuaagaagcauagccaguucaucggauacccuaucaccuuauuuguggaaaaagagagggauaaggaagucuccgacgacgaggcggaggaaaaagaggauaaggaagaggaaaaagagaaggaggaaaaagagucagaagacaagccagagauugaggauguggguagugacgaagaggaagagaagaaagauggcgacaagaaaaagaaaaagaagauaaaagaaaaguauaucgaucaggaggagcugaacaaaacaaagcccauuuggacccggaauccugacgauaucacgaacgaagaguacggggaguucuacaaaagccuuacuaaugacugggaagaucacuuggcaguaaagcauuuuucuguugaaggacagcuggaguuccgcgcccuacucuuugugccaagaagggcucccuucgaccuguucgagaaccggaagaaaaagaauaacauaaaacuuuauguccgccgaguguuuauuauggacaauugcgaagaacugaucccugaauacuugaacuucaucagaggcguggucgauuccgaggaccucccacugaacauuucaagggaaauguuacaacagagcaagauccugaaaguuauucggaagaaucucgugaagaaaugucuugagcuguuuacagaguuggccgaagauaaggagaacuauaaaaaguucuacgaacaguuuaguaaaaauauaaagcuagguauccacgaggacucucaaaaccguaaaaagcuguccgagcuccugcgcuauuacaccagcgcaucgggggaugaaaugguaucucuuaaggacuauugcacuagaaugaaagagaaucagaagcacauuuacuacaucacaggagaaaccaaagaucagguggcuaacuccgccuucgucgagaggcugcggaagcauggcuuggaagugaucuauaugauugagccgauagacgaguacuguguucagcaacucaaagaauuugagggcaagacgcuggugucagucaccaaggaaggguuagagcugcccgaagaugaggaggagaaaaagaaacaggaagaaaagaaaacaaaguucgagaaucuaugcaagaucaugaaagacauucucgaaaagaaaguggagaagguaguugugaguaaccgacuggucacuagcccuuguugcaucgugaccuccacauauggauggacugcgaauauggagcgcauuaugaaagcccaggcacuuagagauaacucuaccauggguuacauggcugccaagaagcacuuggaaaucaauccagaccauagcauaaucgagacacugaggcagaaagcugaagccgauaagaacgacaaaucagucaaggaccucgugauucugcuuuaugagaccgcacuguugaguuccggcuuuagccucgaggauccccaaacucacgccaaucggaucuaccgcaugauuaaacugggguuaggaaucgacgaagaugacccuacggcugaugacacaucugcggcaguuaccgaggaaaugccaccccuggagggcgaugacgauacuucaagaauggaagagguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1728 - RNA, 556 nt, Artificial Sequence
  mRNA product Design1 comprising derived and/or modified sequence from Homo sapiens__NG_005218__HsHSP90AA3P (opt3)
gggagaaagcuuaccauggacagcuccaagcuggauucuggcaaagggcuccacaucaaccuugugcccaauaagcagaaccaaacccugacaauugucgacacuagaauaggaaugacgaaaaccgauuugaucaauaacuuagguacaguuacuaagucaggcaccaaagccuucauggaggcucugcaggcagacgccgauauuaguaugaucgggcauuuuggagugggcuucuacagcgcguaucuaguagcuaagaaggugacagucauuuccaaacacaauaacgacgaacaguacaccugggagucuucggccggugggucauuuacugugaggacagaugaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1729 - RNA, 2392 nt, Artificial Sequence
  mRNA product Design1 comprising derived and/or modified sequence from Homo sapiens__NP_031381.2__HsHSP90AB1 (opt3)
gggagaaagcuuaccaugcccgaggaagugcaccauggcgaggaagaggucgaaaccuucgccuuucaggcugagaucgcacaacugaugagccucauuauaaacacauucuacuccaauaaggagaucuuucuuagagaacugauuucuaacgccucagacgcguuggauaaaaucagguaugagaguuuaacugacccuagcaagcuggauuccgggaaagaacuaaagauugacaucauaccaaauccgcaggagcggacgcucacccugguugauacaggaaucgguaugacuaaagcugaccuuauuaacaaucugggcaccaucgccaagucugggacaaaggcauucauggaggccuugcaggcuggagcagauauuucgaugaucggccaguuuggugugggguucuacucagccuaucucguagcugaaaaaguggucgugauaaccaagcacaacgacgaugagcaauacgccugggaaagcagugcgggaggcuccuuuacuguucgcgcagaccauggcgagcccauugggcgaggaacaaaagugauccugcaccugaaggaagaucagaccgaguaucucgaggaacguagagucaaagaggugguaaagaagcauucucaguucauugguuacccuaucacguuauaucuggaaaaagagagggaaaaggagaucagcgacgaugaggccgaagaggaaaaaggcgagaaggaagaggaggacaaagacgaugaagagaagccaaaaauugaagacguuggguccgaugaggaggacgauucaggaaaggacaagaaaaagaaaacuaagaaaauaaaggaaaaguacaucgaucaggaggaacuuaauaaaaccaagcccauuuggacacggaacccugacgauaucacucaagaggaauacggcgaguuuuauaaaaguuugaccaaugacugggaggaucaccuggcugugaagcacuucagcgucgaaggucagcuagaguuucgcgcccuccuguucauaccaagaagggcacccuuugaccuuuucgaaaacaaaaagaagaaaaauaacauuaagcuguacgugcggcgcguguucaucauggacucuugcgaugaguugaucccugaauaucucaauuuuauucgaggggucguugacuccgaggaucugccauuaaacaucucaagagagaugcugcagcagagcaaaauucucaaggugauaaggaaaaauaucguaaagaagugucuugaacuguucagugaguuggcugaagacaaagagaacuacaagaaauuuuaugaagccuucucuaagaaccuaaaacugggcauucaugaggauuccacaaaucggcgucgccucagcgagcugcuuagauaccacaccucgcaaucuggagacgaaaugacgucccugucagaguaugugaguaggaugaaggaaacucagaaaagcaucuacuacaucacaggcgaguccaaggagcaggucgcgaacucugccuuuguggaacggguucgaaagcgcggguucgagguggucuauaugaccgaaccgauugaugaguacugcgugcaacaguugaaagaauuugacggaaagagccucguaucaguuacuaaagagggucuggaguuacccgaagaugaggaagagaagaaaaagauggaagagaguaaggcaaaauucgagaaucuguguaagcuaaugaaagaaauacucgacaagaaaguggagaaggucacaaucuccaacagacuggugagcucuccuugcuguauugucaccucaacguauggcuggaccgcuaauauggaaaggaucaugaaggcccaggcccuucgggauaacaguacaaugggguacaugauggcuaaaaagcauuuggagauuaauccagaccaccccaucguggaaacucugcgccagaaagcagaggccgauaagaacgacaaagcuguuaaggaccucgugguacugcuuuuugagaccgcgcuguugagcuccggauucucucucgaagauccucaaacacacucgaauagaauauauaggaugaucaagcugggcuuagguauugacgaggaugaagucgcagccgaggagccaaacgcugccgugcccgacgaaaucccgccucuggagggggaugaagacgcaagccguauggaggaaguugauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1730 - RNA, 2629 nt, Artificial Sequence
  mRNA product Design1 comprising derived and/or modified sequence from Homo sapiens__NP_003290.1__HsHSP90B1 (opt3)
gggagaaagcuuaccaugagagcccugugggugcucggccuuugcuguguccuguugaccuucgggagcguuagggcugacgaugagguggacguagauggaacaguggaagaggacuuagguaagucccgggaaggcucucgcacugaugacgaggucgugcagcgagaagaggaggcaauccaacuggaugggcuaaacgccucacagauucgugaacucagagagaaaagugaaaaguuugcguuccaggcugagguuaauaggaugaugaaacugauaaucaacagccuuuacaagaauaaagagauuuuucugcgggaauugaucuccaacgccucugacgcacucgauaagauucgccugaucucgcugacggacgagaaugcccucucaggaaacgaagaguuaaccgugaagauaaaaugcgauaaggagaaaaaucugcuucacgucacagacacuggcguggguaugaccagagaggaguugguaaagaaccuggggacaaucgcuaaaagcggaaccagugaguuccuaaauaagaugacugaagcacaggaagauggccaauccacaucugagcucauuggccaguuugggguuggauucuauagcgccuuucugguggcugacaaggucaucgugaccuccaaacauaacaaugacacgcagcacauuugggaaucagauaguaacgaguucagcgugaucgccgaccccagggguaauacucuuggccgggggaccacaauaacucuggucuugaaggaggaagcgucugauuaccucgagcuggacaccauuaaaaacuuaguuaagaaauauucccaguuuaucaauuucccuauuuacguguggucaagcaagacagaaaccguagaggaaccaauggaggaggaagaggcagccaaagaagagaaggaggaaagugaugacgaggcugccguggaagaggaagaggaggaaaagaaaccgaagacgaaaaaggucgagaaaacugugugggauugggaacugaugaacgacaucaagcccaucuggcaacgcccuucuaaggagguugaagaggaugaguauaaagcauuuuacaaguccuucagcaaagaaucggacgauccaauggcuuauauucauuuuacagccgagggagaagugaccuucaagucuauacucuucguccccacuuccgcgccucgaggccuuuuugacgaguacgguaguaaaaagucagacuacaucaagcuguaugugagaaggguauucauuacagaugacuuucacgauaugaugccaaaauacuugaacuucguuaaggggguggucgacagcgaugaccuaccccugaaugugucccgggaaacccuccagcagcauaaacugcuuaaggucauccguaaaaagcuggugcgcaagacguuggauaugauuaaaaagauagccgacgauaaauauaacgacaccuuuuggaaggaguucggaacaaauaucaaacucggcguuaucgaggaucacucuaacagaacuaggcuggcaaaguuacugcgguuucagagcucacaccauccuaccgacauuacaagucuagaucaauacguggaacgaaugaaagagaagcaggacaagaucuauuucauggcuggcuccagccgcaaagaagccgagucuucaccauuuguagagagacuccugaagaaaggguacgaagucauuuaucuuacugagccgguggacgaauacuguauacaggcuuugcccgaguucgauggaaagagguuucaaaauguugccaaagaaggugugaaguucgacgagagugagaagaccaaagaaagccgggaggcagucgaaaaggaguuugaaccucugcucaacuggaugaaagauaaggcccugaaagacaagaucgagaaggcugugguaucccagcgccuuacagagucuccaugcgcgcugguggcaucgcaguacggcuggagcgggaauauggaaagaauuaugaaagcccaggcuuaucaaaccggaaaggauaucuccacuaacuacuaugccucacagaaaaagacguucgagaucaaucccaggcacccuuugauucgugacaugcuccggcgaauaaaagaagaugaggacgauaagacaguucuggacuuagcagucgugcuguucgaaaccgccacucuaagaaguggcuaccuccugccagauaccaaggcuuauggugacaggaucgagcgcaugcuucgguugucucugaacauugaucccgacgccaaaguggaggaagaaccggaagaggagccugaagagacagcagaagacaccacugaggauacagaacaggacgaggaugaggaaauggacgucgggacggaugaggaagaggaaaccgcgaaggagagcacugcugagaaagacgaacucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1731 - RNA, 2332 nt, Artificial Sequence
  mRNA product Design1 comprising derived and/or modified sequence from Homo sapiens__NP_057376.2__HsTRAP1 (opt3)
gggagaaagcuuaccauggccagagagcugagggcucuccuucuguggggccggcgcuugcgacccuuacugcgugcuccugcccuagcggcugugccagggggaaagccgauccucugccccagaaggaccacagcccagcuggguccucggcgcaacccagcauggagccuucaagccggcagacuguucuccacucagacggcugaagacaaagaggaacccuugcacucuauuauaucaaguaccgagagcguccagggguccacaucuaagcaugaauuucaggcagagacuaaaaagcuccuggauaucguugccaggucgcuguacucagagaaagaaguguucauucgggagcucaucagcaaugcuagugacgccuuagaaaagcugcgccacaagcuaguauccgauggacaagcguugccugagauggagauucaucugcagaccaacgcagaaaaaggcacaaucaccauacaggacacugguaucgggaugacacaggaggaacuugugucuaaucucggaaccauugcccgaagcggcuccaaggcuuuucuggaugcccuucaaaaccaggcagaggcuucaaguaaaaucauuggccaguucggggucggauuuuauagcgccuucaugguggcggacagaguugaaguguacucuagguccgccgcaccagguucacugggcuaucagugguugagcgaugggaguggagucuuugagaucgcugaggccucuggcgugcggacggguacuaagauaauuauccaccucaaauccgacuguaaggaauuuagcucggaggcucguguacgcgauguugugaccaaguacucuaauuuugucuccuucccccuguauuuaaacgggagaaggaugaauacacugcaagccauuuggaugauggacccuaaagaugugcgggaauggcagcaugaggaauuuuaccgauauguggcacaggcccacgacaagccacgcuacacucuccacuacaaaaccgaugcuccgcuuaacaucagaucaaucuucuauguccccgacaugaagccuaguauguuugacguuagcagggagcugggauccucuguggcguuguacagccggaaaguacuaauucaaacaaaggcaaccgauauacugccaaaauggcuccgcuucaucagaggcguggucgacucagaggauauuccccugaaucuuaguagggaacuguugcaggaguccgcccucauccguaagcugcgggacguguuacagcagcgacugauaaaguucuuuauugaucaaagcaaaaaggacgcugaaaaauaugccaaguucuuugaggauuacggccuauucaugagagaagggaucguuacggcaacugagcaggaggugaaagaagacaucgccaagcuccugagguaugagucuucagcacuuccuaguggacaguugacaagccuguccgaauacgccucucgcaugcgggcagguaccagaaacauuuauuaccucugcgcgccaaauaggcaucuggcugagcacucgcccuacuaugaggccaugaagaaaaaggauacugaaguccuuuucuguuucgagcaguuugacgaacugacauugcuccaucugcgcgaguucgauaaaaagaaauuaaucagcguggaaaccgacauuguaguugaccacuacaaggaggagaaguuugaagaucgauccccggcagccgagugccugucagaaaaagagacggaagaacuaauggcuuggaugcggaacgugcucggcagucgugucaccaaugugaaggucacacugagacuugacacucacccugccauggugaccguuuuggagaugggggcagcuaggcauuuccugcgcaugcaacagcucgccaaaacacaggaggagcgggcgcagcuguuacaacccacucuggaaauaaacccaagacacgcccuuaucaagaaauugaaucagcucagggcuucugagccuggacuggcacagcuacugguggaucagauuuaugaaaacgccaugaucgcugccggccucguagacgauccccgagcaauggucggucgccugaacgagcuuuuggugaaggcgcuggagcggcauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1732 - RNA, 679 nt, Artificial Sequence
  mRNA product Design1 comprising derived and/or modified sequence from Homo sapiens__NP_000609.1__HsIGF1 (opt3)
gggagaaagcuuaccaugggcaagaucagcucccugcccacccaacucuucaaaugcuguuuuugcgacuuccuuaaggugaaaaugcacacaaugucuucaagucaucuguuuuacuuggccuuaugucugcuaacuuucacgagcuccgcuaccgcagggccugagacacucugcggagccgaacuggucgaugcgcuucaguuuguuuguggugacagaggcuucuauuuuaacaagccaacuggguacggaucuucgucaaggcgggcuccgcagaccggcauuguggaugagugcuguuuccgcagcugcgaccugcgacguuuggaaauguauugugcaccccucaaaccugccaagagugccagauccguaagggcucagcggcacacagauaugccaaagacccagaaagaggugcaucugaagaaugcaucucgcgguagcgccgggaacaaaaauuacagaaugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1733 - RNA, 760 nt, Artificial Sequence
  mRNA product Design1 comprising derived and/or modified sequence from Homo sapiens__NP_000603.1__HsIGF2 (opt3)
gggagaaagcuuaccaugggcauccccaugggaaagagcaugcuggugcuccuuaccuuccuggccuuugcuuccugcuguauugcagccuacagaccuucugagacauugugcgggggugaauuagucgacacucugcaguucguuuguggcgauaggggguuuuauuucucacggccagcgagucgcgugagccgacguuccagaggaauaguagaggaaugcuguuuuaggucuugcgaccuagcucuccuggagacguacugugccaccccggcaaaaucggaacgggaugugucaacacccccuacuguccuuccagacaacuucccccgcuauccugugggcaaguuuuuccaauacgauaccuggaaacagagcacacagagacugaggcgggguuugccagcccuccugcgcgcucgaagagggcacguucuggcaaaggagcucgaggccuuuagggaagcuaaacggcaucgucccuuaaucgcccugccuacccaggacccagcgcacggaggcgcaccgcccgagauggccaguaaucgcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1734 - RNA, 856 nt, Artificial Sequence
  mRNA product Design1 comprising derived and/or modified sequence from Homo sapiens__NP_000591.1__HsIL6 (opt3)
gggagaaagcuuaccaugaacagcuucuccaccucugccuuuggccccguggcuuucucacuggggcuccuucuggucuugccugcagccuuuccagcgccgguucccccuggagaggacaguaaggauguggcugccccacacagacagcccuuaacaagcuccgaaaggaucgacaaacaaauucgguacauacuggaugguaucucugcacuacgcaaggagacuugcaauaaaucgaacaugugugaaucaagcaaggaggcccucgcugaaaauaaccugaaucuuccuaaaauggcagagaaggacggcugcuuccagaguggguuuaacgaggaaacgugucugguaaagauuaucaccggauugcucgaguucgaaguguaucuggaguaccugcagaaucgauuugaguccucugaagaacaggcccgugcuguccaaaugagcacaaaagugcucauucaguucuuacagaagaaagccaagaaccuggaugcgaucacuaccccagaccccacaaccaaugcaucccuuuugacuaaacugcaggcccaaaaccaguggcuacaggauaugacaacccaucucauacugagaucauuuaaggaguuccuucagaguagccugagggcuuugcggcaaaugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1735 - RNA, 1498 nt, Artificial Sequence
  mRNA product Design1 comprising derived and/or modified sequence from Homo sapiens__NP_002183.1__HsINHBA (opt3)
gggagaaagcuuaccaugccccugcucuggcuuagaggcuuccuguuggccagcugcuggaucauugugagguccucuccuaccccagggucagagggacacagugcugcaccggacugucccagcugcgccuuagcggcucugccuaaggaugucccaaacucccagcccgaaaugguugaggccgugaaaaagcauauacuaaauaugcuccaccugaaaaagcggccugacguaacacaaccagugcccaaagcagcccuucugaacgcuauccgcaaguugcaugucgguaaggugggcgaaaauggguacguugagauugaagaugacaucggacgacgugcagagaugaacgagcucauggaacagacuucugagauuaucacguuugccgaaucgggcaccgcuagaaaaacacugcacuucgagauaucaaaggaggguagcgaucugaguguggucgaaagggccgagguguggcucuuuuuaaaaguaccuaaggcgaaucggacucgcaccaaaguuacaaucagacuguuccagcagcaaaagcauccacaggggucccuugacaccggagaagaggcagaagaggugggcuugaagggcgagaggucugaacugcuacucagcgagaaagucguggaugcccggaaguccacuuggcacguguuuccggucucaaguagcauucagcgccugcuugaccaggggaaaucuucccuggauguucgaaucgcuugugaacaaugccaggagucaggagccagcuuggugcuccuggguaagaaaaagaaaaaggaagaggagggcgaagggaagaaaaagggaggcggugaagggggagcaggcgcugacgaggagaaagaacagagucacagacccuucuuaaugcugcaggccaggcaaucugaggaucauccucaccggcgucgcagaaggggccucgagugugacgggaagguaaacauuugcuguaaaaagcaguuuuucguguccuuuaaggauaucggauggaaugacuggauaauugcgccaagcgguuaucaugccaacuacugcgaaggcgagugucccucgcacaucgcagggacaucuggauccucacuuaguuuccacagcaccgucauuaaucauuaucggaugcgaggccacuccccuuuugcuaaccugaaaucuugcugugugccaacgaaguugcgccccaugagcaugcuauacuaugacgauggucagaauaucaucaaaaaggacauucaaaacaugauaguugaagagugcgggugcucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1736 - RNA, 1441 nt, Artificial Sequence
  mRNA product Design1 comprising derived and/or modified sequence from Homo sapiens__NP_002184.2__HsINHBB (opt3)
gggagaaagcuuaccauggacggccugcccgggagagcccucggagcugcaugccuucuguuguuagccgcggguuggcugggcccugaggcuugggggagcccaaccccgcccccuacaccagccgcacccccuccacccccuccaccgggaucccccggcgguucucaggauacuuguacgucaugcgggggauucaggcggccugaggaacuaggccgcguggacggcgauuuucucgaagccgucaagcgacacauccugagucgucuucaaaugagagggaggccaaacauuacccaugcuguucccaaagcagccauggugacagcucugcggaaguugcacgccggaaaaguacgcgaggacgguagaguggaaauaccucaucucgauggccacgcgagcccaggggcagacggacaggagagggucuccgagaucauuucuuucgccgaaacugauggccuggcuucgucacgggugcgccuguacuuuuucaucagcaaugaggguaaccagaaucucuuuguugugcaggccaguuuauggcuguaucuuaaguugcugcccuacguccuagaaaaagggucccgaagaaaggugaggguaaagguuuauuuccaagagcagggacauggcgaccgguggaacaugguggagaaacgugucgaucucaagcgcucuggcuggcacaccuuuccgcugacagaagcaauucaggcucuuuucgagagaggggaaaggcggcugaauuuggacgugcagugugauagcugccaagagcucgccguggucccuguuuuuguggaccccggagaagagucccaccgaccauucguagugguccaggcgcgccugggugauucaagacauaggauccggaaacgcggcuuagagugugacgggagaaccaaccugugcuguaggcagcaguuuuucauagacuuucgucucaucggauggaaugauuggauuaucgccccuacuggcuacuaugguaacuacugcgaagggaguugucccgcauaucuugcuggcgugccaggaagcgccucuuccuuccacacagcuguugugaaucaauaccggaugcgaggccugaaccccgggaccgucaauucaugcuguauuccuacgaaguugagcacuaugaguaugcuauacuucgacgaugaguauaacaucgugaaaagagacguaccaaauaugauaguugaagagugcggaugcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1737 - RNA, 3676 nt, Artificial Sequence
  mRNA product Design1 comprising derived and/or modified sequence from Homo sapiens__NP_000623.2__HsITGAM (opt3)
gggagaaagcuuaccauggcccugagagugcuccuucugaccgcuuugacauuaugccacggcuucaaccuggacacugagaaugcaaugacguuucaggaaaacgccaggggguucggacaaagcgucguucagcuacaggguucccgggugguagugggcgcgccccaggagaucgucgcugccaaucaacgcgggucucucuaccagugugauuauucaaccggaaguugcgaaccuauucgacugcaagugccaguugaggcagugaacaugagccuuggccuguccuuggccgcuacaacuucuccgccccagcuccuggcaugugguccuaccguccaucaaacaugcucggaaaauaccuacgugaaggggcuguguuuucucuucggaucaaacuuacgucagcagccacagaaauuucccgaggcccugagaggcugcccucaagaggacagcgauauagcuuuccuuaucgacggcaguggguccauuaucccacacgauuuuaggcggaugaaggaguucguaucuacuguuauggaacaguugaaaaagagcaaaacacuguuuucccuaaugcaguauucagaagaguuccgcauucauuuuaccuucaaggaguuucaaaauaaccccaauccuagaagucucgugaagccaaucacgcagcugcuuggaaggacucacaccgccacagguauacggaaagucgugcgcgaacuguucaacaucacuaauggcgcgcgaaagaacgcauucaaaauuuugguggucaucaccgacggggagaaguuuggagauccgcucggcuacgaagacguuauucccgaggccgauagagaaggugugaucagguauguaauaggggugggagacgcuuuccggagcgagaaaucucgucaggagcugaauacaauugccuccaagccuccacgcgaucaugucuuucaggugaacaauuucgaagcauuaaagaccauccaaaaccagcugagagagaaaauuuuugcuaucgaaggcacgcagacuggcucaagcaguucuuucgagcacgaaaugucccaggagggguuuagcgccgcgaucacaucgaacggaccccuccuuucuaccguugguuccuacgacugggccggcgggguguuccuguauacuucaaaggagaaaaguacauuuauuaauaugaccagggucgauagcgacaugaacgacgcauacuugggauacgcugccgcuauaauccuacggaaucgagugcaaucccugguacucggcgccccucgcuaucagcacauuggucugguugcaauguucagacagaacacggggaugugggaaucuaaugccaacgugaagggcacccagaucggagcuuacuuuggcgcgagccuuuguucagucgauguggacaguaauggguccacagaucuggucuugauaggagcaccacauuauuacgagcaaacuagggguggccaggugagcguuugcccccucccgcgggggcgcgccagauggcagugugacgcugugcuguauggagaacagggccaaccuugggguagguucggggccgcauuaaccguacugggcgaugucaacggagacaaacuaacagauguggccauuggcgcucccggggaggaagacaaucguggagccguuuaccucuuucacgguacuucuggcucagggaucaguccaagccauucccagcggaucgcaggaucuaagcugucgccucgacuucaguauuucggccagagcuuguccggugggcaggaucugaccauggacggccucguggaucugacagucggagcgcagggccacgugcuucuguugagaucacagcccguacucagggugaaagcuauuauggaguucaacccacgcgagguugcccggaaugucuuugaaugcaacgaccaaguggugaaggggaaggaggcaggagaagucagaguuugucugcacgugcagaaaaguaccagggaccgcuuacgagagggccagauccagucugugguaacuuacgaucuggcccuagacagcggucggccccauucccgugcugucuucaaugagacgaagaacucaacaagaaggcaaacccaggugcucgggcugacucagaccugcgaaacacuuaaauugcagcugccuaauugcauugaggauccaguuagcccgauagugcuccgccugaacuuuucuuuagucggaaccccucuguccgccuucggcaaccuucggccuguguuggcagaagacgcucaaagacucuuuacugcccuguucccauuugagaagaauugugguaacgauaauaucugccaggacgaucuaaguauuacauucagcuuuaugucucuggacugucucguugugggcgggcccagggaguucaacguaacggucaccgugcgaaaugauggagaagacuccuaccgcacucaggugacauuuuucuuuccucuggaucuuucauaucggaaagucaguaccuugcaaaaccagagaagccagaggucguggcgucuggcgugcgaguccgccucuagcacagaaguuucaggcgcuuuaaagaguacuuccuguucuaucaaucacccaaucuuccccgagaacagcgaagugaccuucaauauuacguuugacguagauuccaaggcaucacucgggaacaaacugcuucugaaggccaaugugaccagcgagaacaauaugccgcgcacaaacaaaacugaguuccaguuggaacucccugucaaguacgcuguguauaugguugugaccagucauggagucucuacaaaauaccugaauuuuacugccuccgagaacaccagccgggugaugcaacaccaguaucagguuucgaaccuaggccagagaucacugccaauaucucucguguuccugguccccguaaggcuuaaucaaacggugaucugggaccgaccucagguuacauuuagugaaaacuuguccucuaccugccauacuaaggagcggcugcccagccacagcgacuucuuagcagaacuccgcaaggcgccaguggucaauuguuccauugccgugugccagagaauccagugugauauucccuuuuucgguauccaagaggaauuuaacgcuacacugaaagggaaucuuucauucgacugguacauaaagaccagucacaaccaucugcuaaucguaagcacugccgagauucucuuuaaugauucuguguucacccuguugcccggacagggcgcauucgucaggucccagacagagacgaaaguugaaccauuugaggugccgaacccucugcccuuaaucguggguucaagugucggcgggcuccugcuucuggcuuugauuaccgccgcacucuauaagcugggauucuuuaaacggcaguacaaggacaugaugagcgaaggcgggccacccggagccgagccucaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1738 - RNA, 1621 nt, Artificial Sequence
  mRNA product Design1 comprising derived and/or modified sequence from Homo sapiens__NP_002415.1__HsMMP8 (opt3)
gggagaaagcuuaccauguucagccugaagacccuccccuuucuucuguuguuacacgugcagaucuccaaagccuucccugucucuucaaaggagaaaaacacaaagacuguucaagacuaccuggaaaaauuuuaucagcuaccaaguaaucaguaccagagcacgagaaagaacggcaccaaugugauuguagagaagcucaaagaaaugcaaagguucuuugggcugaacgugacaggaaagccgaaugaggaaacucuugauaugaugaaaaagccccggugcggugucccugacuccggcggguucaugcugaccccaggaaaccccaaaugggagcgcacaaauuugaccuaucgaauacguaacuacacuccucagcucucugaggcugaaguggagagagcaaucaaggaugccuuugaacuguggucgguugcgucaccacugauuuucacaaggaucagccagggcgaggcugacauuaauaucgccuuuuaucagcgggaucauggugacaacagucccuucgaugggccuaauggaauacucgcacacgccuuucaaccaggccagggcaucgggggagacgcucauuucgaugcagaggaaaccuggacgaacacuuccgccaauuacaacuuauuucugguggcugcccacgaguucggucauucucuuggcuuggcgcacagcuccgacccgggggcacugauguaucccaauuacgccuuccgcgaaaccucaaacuacagucuaccucaggaugacauugauggaauccaggcuauuuauggccucagcucuaacccaauccaacccacagguccuuccacuccaaagcccugugacccgucacugaccuuugacgccauaacaacccuuagaggggagauucuguucuuuaaagauagguacuucuggcggcgccacccucaguugcagcgagucgaaaugaauuuuaucagccucuucuggcccagucugccaacgggcauucaagcagcuuaugaggacuuugauagagacuuaaucuuccuguuuaagggaaaccaguacugggcccucucuggcuaugauauccuucagggguacccuaaagacauuuccaauuauggauuccccagcucggugcaggcgauagaugccgcaguauuuuacaggucuaagacuuacuucuuuguuaacgaccaauucuggcgguaugauaaucagcgucaguucauggagccagguuaccccaaauccaucucaggcgcuuuuccugggauugaaaguaagguggacgccgucuuccagcaagagcacuuuuuccauguguuuagcggaccacgcuauuacgcuuucgaucugaucgcccagagagugacaagggucgcacggggcaacaaaugguugaauugccgauaugguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1739 - RNA, 2341 nt, Artificial Sequence
  mRNA product Design1 comprising derived and/or modified sequence from Homo sapiens__NP_004985.2__HsMMP9 (opt3)
gggagaaagcuuaccaugagccuguggcagccccucgugcuuguccuguugguuuuaggcugcuguuucgccgcuccuagacaaaggcaguccacccuggugcuauuuccaggggaccuccggacaaaccugacugaucgccagcuugcagaggaauaccuguaucgauacggauauacgcguguagccgagaugagaggugaaucuaaaucauugggcccggcgcuccugcugcuccagaaacaauuaagucugcccgagaccggggaacuugacagcgcuacauugaaggccaugaggacuccucggugcggagugccagaucugggccgcuuccagaccuuugagggugaccuaaaauggcaccaucacaauaucacauacuggauucagaacuauuccgaggaucuccccagagcagucauagacgaugccuucgcuagggcauuugcccuguggucugcugugaccccucuuacuuucacacggguuuacucgcgcgacgccgauaucgugauucaguuuggggucgcggaacauggagacggcuauccauucgauggcaaggacgggcuguuggcacacgccuuucccccuggaccagguauccaaggcgaugcucauuucgacgacgaugagcucuggucacuggggaaaggagugguaguuccgacccgauuuggcaaugccgacggugcagcuugucacuuccccuuuauuuucgaagggagaagcuacagugccugcacgacugauggaagguccgacggcuuaccuugguguucuaccacagcgaacuacgauacugacgaucgguucggcuuuugcccaagcgagcgucuguauacccaggacgggaaugccgauggaaagcccugucaguucccuuuuaucuuccagggucaauccuacucagcaugcacaaccgacggccgcagugauggguauagauggugugcuacgacugccaacuacgacagggacaagcucuuuggauucugcccaacacgggcugauagcaccgugaugggcgguaauucugccggggagcuuugugucuuucccuucacuuuucugggcaaagaauauuccacaugcaccucagagggacgaggcgacgggcgcuuguggugcgcaacgaccagcaacuucgauagugacaagaaauggggauuuuguccggaucaggguuacucucuauuccugguggccgcucacgaauuuggccaugcgcucgggcuggaccacuccagcgugccugaggcacuuauguaucccauguacagauucacagaaggaccaccucugcauaaggaugacgucaauggcauaaggcacuuguacgguccccggccagagcccgagccucgcccaccgacuaccacaacuccccagccuaccgccccacccacaguuugcccuaccgggccacccacugugcacccgucggaaagaccuacggcuggcccaacaggacccccuucugccggccccaccgggccaccuacugcaggacccuccaccgccacaaccguaccacucucaccgguggaugacgcuuguaacgucaauaucuucgaugccauugcagagaucgguaaccaacuguauuuauuuaaagacggcaaguacuggagguucagugaagggcguggaagccggccucagggccccuuucugauugcggauaaguggccagcucuaccccgaaaacucgacuccguguucgaggaaagacugucuaagaaauuguuuuucuuuagcgguaggcagguuuggguguauacuggggccucaguccuuggcccucgccggcuggacaagcucggacugggcgcagauguggcccagguaacaggggcucuuagaaguggaaggggcaaaaugcuguuguucuccggucgccgacucuggcgguuugacguuaaggcccaaaugguggauccacguagcgcaucugaggucgacagaauguuccccggggugccucuggauacgcaugacgucuuucaguacagggagaaggcuuauuucugccaggaucgcuuuuacuggcgggugucaaguagaagcgaauuaaaucagguugaccaagugggauauguaaccuacgauauccugcaguguccggaggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1740 - RNA, 1633 nt, Artificial Sequence
  mRNA product Design1 comprising derived and/or modified sequence from Homo sapiens__NP_002418.1__HsMMP13 (opt3)
gggagaaagcuuaccaugcaccccggcgugcuggccgcuuuccucuuucuuagcuggacccauugcagagcacugccuuugccauccgggggagacgaggaugacuuaucugaagaggaucugcaguucgccgaaagguaccuacggucauauuaccacccgacaaaccucgcggguauccugaaggagaaugcugccaguagcaugacugaacgccuucgagagaugcaauccuuuuucggccuggaggucacggggaaauuggacgauaacacccucgacguuaugaagaaaccccguuguggagugccugauguaggcgaauauaauguguuuccaagaacacugaaguggucuaaaaugaaccugacuuacaggauugucaauuauacccccgacaugacacauucggagguggaaaaggcauucaagaaagccuuuaagguuuggucagaugugaccccucucaacuucacucgguuacacgacgguauagcugauaucaugauuagcuuugggaucaaagagcauggagacuucuacccauuugauggccccaguggccugcuugcacacgccuucccuccagggccgaauuauggaggugacgcucacuuugacgaugacgagacauggaccuccucuagcaagggcuacaacuuguuccuggucgccgcgcaugaguucgggcacucccuaggacucgaucauucaaaagaccccggcgcacugauguuuccuauuuacacguauacugguaagagucacuucaugcuuccagaugacgaugugcaggggauccagagccuguacggacccggcgacgaagauccuaauccaaagcaccccaaaaccccggacaagugcgauccuucuuugucccucgacgccauaacaucacugcgcggcgaaacuaugaucuuuaaagacagauucuuuuggagguuacauccccagcaaguagaugcugagcuguuccucaccaagagcuuuuggccagaacuuccuaaccggauugacgccgcauaugagcaccccagucaugaucugaucuucauuuuucgcgggcgaaaauucugggcuuugaauggauacgacauccuagaggguuauccaaagaaaauaucugaacugggccuccccaaggagguuaagaaaauuuccgccgcggugcacuuugaagauacagggaagacccugcuuuucagcggaaaccaggucuggagauacgacgauacgaaucauaucauggacaaagauuauccuaggcugauugaggaagacuuuccaggcaucggugauaagguggacgccguguacgagaaaaacggguacaucuauuucuucaauggcccgauucaguuugaguacucgauauggucuaaccggaucguccguguuaugcccgcaaacuccauuuugugguguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1741 - RNA, 1285 nt, Artificial Sequence
  mRNA product Design1 comprising derived and/or modified sequence from Homo sapiens__NP_001286.1__HsCCR1 (opt3)
gggagaaagcuuaccauggagacccccaacacaacugaagacuacgauacgaccacagaguucgacuauggcgaugccacuccuugccagaaggugaaugaaagagcuuuuggggcacaacugcucccaccgcuuuacagccuggucuucguuaucggauugguggguaacauuuuaguagugcugguccuagugcaguauaaaaggcucaagaauaugaccuccauauaccugcuuaaccuggccaucucugacuugcucuuucuguucacacugcccuuuuggauugauuauaaacucaaggacgauuggguuuucggcgacgcgauguguaaaaucuuaucaggguuuuacuauaccggacuguacagugagauuuucuuuaucauacuuuugacuaucgaucgguaccuggcuauugugcacgccgucuucgcacuacgcgcccgaacagugaccuuuggcguaaucacgagcauuaucauaugggcucucgcaauucuggccuccaugccuggucuuuauuucucuaagacucagugggaauuuacccaucacacaugcucgcugcauuucccacacgagucauugcgugaguggaaacucuuccaggcucugaaguuaaaucuguuugggcucguucuuccccuguuggugaugaucauuuguuacacuggaaucaucaagauucuacugagaaggccuaacgagaaaaagagcaaagccguccggcucauauucgugaucaugauuaucuuuuuccuguuuuggaccccauauaaucuuacaauacugauuaguguguuccaagacuuuuuguucacccaugaaugcgaacagucccgccaccucgaucuggcgguccagguuacggaggugaucgcauacacucacuguugcguaaaccccgugaucuaugccuuugucggcgagagauucaggaaguacuuacggcagcuguuucaucgccgaguggcuguucaccuagugaaguggcucccuuuccugucugucgacagacuugaaagggugagcuccacaucaccaaguaccggcgagcaugaauugagcgccggguuuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1742 - RNA, 853 nt, Artificial Sequence
  mRNA product Design1 comprising derived and/or modified sequence from Homo sapiens__NP_002598.4__HsPDGFA (opt3)
gggagaaagcuuaccaugagaacccuggccugccuccuucuguugggauguggguacuuagcucacgugcuggcagaggaagccgagauccccagggaagucauugagcggcuagcgcgcagccagauacauuccauccgagaccuccaacgucugcuugaaauugauucuguuggaucagaggacagucuggauacuagcuugagagcucacggugugcaugccacaaagcacguaccugagaaaaggccacucccgauccggcgcaagagauccauugaagaggcagugcccgccgucugcaaaacgaggaccgugaucuaugaaauaccucggucucagguugacccaacaucggcuaacuuccugaucuggcccccuuguguggaggucaagcgcugcacuggcuguugcaauaccucaagcgugaaaugucagccaagucgaguacaucacagauccguuaagguggcaaaggucgaguacgugaggaaaaagcccaaacugaaggaagugcagguccggcucgaggaacacuuagagugcgccugugcuacaaccucucugaacccugauuaucgugaagaggacacugggcgcccaagagagagcggcaaaaagaggaagcggaaacgacuuaagccgacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1743 - RNA, 943 nt, Artificial Sequence
  mRNA product Design1 comprising derived and/or modified sequence from Homo sapiens__NP_002599.1__HsPDGFB (opt3)
gggagaaagcuuaccaugaacagaugcugggcccuguuccucagccuuuguugcuaccugagguugguguccgcugagggcgaccccaucccugaagaguuauaugaaaugcugucugaucacucaauucggaguuuugacgaucuacagcgccuccugcauggggacccaggagaggaagauggugcagagcuugaccugaauaugacccgaagccacuccggcggggaguuggaaucucucgcccguggaagaaggucgcugggcucacugacaauagcggagccggcuaugaucgccgaauguaagacucggacggaggucuucgagauuagccgcagacucaucgauaggaccaacgcaaacuuuuuaguuuggcccccuugcguggaaguacaacgguguagugguugcuguaauaaucgcaacgugcagugccgaccaacacagguccagcugagacccgugcaaguuaggaaaauugagaucgugcggaagaaaccuauauucaagaaagccacugucacccuugaagaccauuuggcuuguaagugcgagacaguggcagccgcucguccaguaacccgcucccccgggggaucucaggaacagagagccaagacuccucagacaaggguuaccauccggacggugcgaguccgcagaccaccgaaaggcaagcacaggaaauuuaagcauacucacgauaaaaccgcgcugaaggagacacuaggcgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1744 - RNA, 1255 nt, Artificial Sequence
  mRNA product Design1 comprising derived and/or modified sequence from Homo sapiens__NP_057289.1__HsPDGFC (opt3)
gggagaaagcuuaccaugagccuguucggccuccuucuguugaccuccgccuuagcugggcagagacaaggaacacaggcagagucuaaccugucaaguaaguuucaguucagcuccaauaaagaacagaacggugugcaagacccccagcacgagaggaucauuacugucucuacgaauggcucgauacauucaccucgguuuccacacaccuacccgcgcaacacaguucuaguguggcgacucguagccguggaagagaaugucuggauccagcugacuuucgaugaacguuuugggcuugaggaccccgaggaugacauuugcaaguaugauuucguggaaguugaggaaccuagcgacggaaccauccugggcagauggugugguagugggacagugccaggaaaacagauuuccaagggcaaccaaaucaggauacgguuugucucugaugaguacuuccccagcgagccuggcuuuugcauccauuauaauauugugaugccacaguucaccgaagcgguaucccccucaguuuugccuccaagugcucucccgcuggaccugcucaacaaugccaucacugcauuuagcacauuagaggaucugauucgcuaccuugaacccgagagauggcaguuggaccuggaagaucuauauaggccuaccuggcagcuccuggggaaagccuucguguuuggacggaagucucgcgucguggaccuuaaccuguugacggaggaggugcgacucuacuccuguacuccaagaaauuucucagucagcaucagggaggaacugaagcggaccgauacaauauucuggcccgguugcuuacugguuaaacguuguggcgggaacugcgcuuguugccuccacaauuguaacgaaugccaaugugugccuaguaagguaacuaaaaaguaucaugaggugcuucagcugcgcccaaaaaccggagucagaggcuugcacaagucucuaacagacguggcacuggaacaccaugaggagugcgacugcguuuguagggguuccaccgggggaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1745 - RNA, 1312 nt, Artificial Sequence
  mRNA product Design1 comprising derived and/or modified sequence from Homo sapiens__NP_149126.1__HsPDGFD (opt3)
gggagaaagcuuaccaugcacagacugaucuucguguacacccucauuugcgccaacuuuuguagcugcagggacacauccgcuacuccccagucugcaucaauaaaggcccuucggaaugcgaaccugcgccgagaugacuuguaucguagagaugagacgauccaagucaaaggaaauggguacguucagaguccuagguucccaaacagcuauccgcggaauuuacugcuaaccuggcgccuccauucccaggaaaacacaaggauucagcugguguuugacaaucaauucggacuugaggaagcugagaacgauaucuguagauacgacuuuguagaaguggaggauauuucugagacuucgaccaucauacggggucgcuggugcggccacaaggaagugcccccucgaaucaaaucaagaacaaaucagauuaagaucaccuucaaaagcgacgauuauuuugucgccaagccaggguucaagauuuacuauagucuguuggaggacuuucagcccgcagccgcuuccgaaacuaacugggagucuguuacaagcuccaucucaggagugaguuacaauagcccuucugucaccgauccaacgcucauagcagacgcccuggauaaaaagauugcugaguucgacacuguggaagaccugcucaaauacuuuaaccccgaguccuggcaggaagauuuagagaauauguaucuggacaccccuagguaccggggccguucauaucaugaucgcaagagcaaaguagaccuugauagauugaacgacgaugccaagagguacaguuguacaccacggaauuauucuguuaacauccgagaggaacugaagcuagcgaacguggucuucuuuccgcgcugccuccuggugcaaagauguggugggaauugcggauguggcacugugaacuggagguccugcaccuguaauagcggcaaaacagucaagaaauaccacgagguucuucaguucgaacccgggcauauuaagcggcgcggcagagcaaaaaccauggcccugguggacauccaguuggaucaccacgagaggugcgacugcaucuguucgucucguccuccacggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1746 - RNA, 895 nt, Artificial Sequence
  mRNA product Design1 comprising derived and/or modified sequence from Homo sapiens__NP_003946.3__HsSOCS3 (opt3)
gggagaaagcuuaccauggugacccacagcaaguuccccgccgcuggcauguccagaccucuggacacaucucucaggcuuaaaacuuuuucaaguaagagcgaguaccagcuggucguuaacgcagugcggaaauugcaagaauccggguucuauuggucugccguaacgggaggugaggcgaauuuacugcuaucggcugaaccagccggcaccuuucucauccgcgauucaagcgaccagcgacauuucuuuacacugagugugaagacucaguccgggaccaaaaaccuucguauucagugcgagggaggcucuuucagccugcaauccgauccgagaucaacacagcccgucccuagguuugacuguguguugaagcucguucaccauuacaugccacccccuggugcaccaaguuuccccagcccuccaaccgaaccgucuuccgaggugcccgagcagccuucagcccagccacugcccgggagcccuccacggcgcgcuuauuacauauauaguggaggcgaaaagaucccccugguccucucuagaccguuauccagcaauguggcaacucugcaacaccuuugcaggaaaacaguaaacggccauuuggauucguacgagaagguuacccagcugccugggcccauucgggaauuucuagaccaguaugaugccccacucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1747 - RNA, 700 nt, Artificial Sequence
  mRNA product Design1 comprising derived and/or modified sequence from Homo sapiens__NP_003227.1__HsTGFA (opt3)
gggagaaagcuuaccauggugcccagcgccggccagcuggcucucuucgcacuugggaucguccuggccgcgugccaggcuuuggagaacuccaccucuccuuuaucagccgacccaccgguugcagccgcugugguaagucacuuuaaugauugucccgacagccauacacaauucugcuuucacggaacuuguagauuccuggugcaggaagauaagccugcaugcgucugucauuccgguuacgugggcgccaggugcgagcacgcugaccuacucgccguuguggcggcaucucagaaaaagcaagccauuacggcucuggucgugguaucgauaguugcccuugcagugcugaucauuaccugugucuugauccauugcugucaggugcggaaacacugcgaauggugucgcgcucucauuugccgacacgagaagccaucagcccugcugaaagggcguacagcgugcugucauagcgaaacuguggucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1748 - RNA, 1390 nt, Artificial Sequence
  mRNA product Design1 comprising derived and/or modified sequence from Homo sapiens__NP_000651.3__HsTGFB1 (opt3)
gggagaaagcuuaccaugcccccuagcggccugagacuccuuccacuguuguuaccgcugcuauggcuccuggugcuuacccccgggaggccugccgcuggacuguccacaugcaagacuaucgacauggaguuggucaaacggaagcgcauugaagcaauacgaggucagauccucucuaaacugcgucuggccucaccacccagucaaggcgagguuccuccagggccccucccugaagcgguguuagcucuguacaacagcacgagagauaggguagccggagaguccgcagaaccagagccggagcccgaagccgacuauuacgcuaaggaggugacccggguccuuaugguggaaacacacaaugagauuuaugauaaauucaagcagucuacucauucgaucuacauguuuuucaacaccucagaguugcgcgaagcaguuccugagccagugcugcuaagcagagccgaacucaggcugcuucggcugaaguugaaagucgagcagcacguggaacucuaucagaaguacaguaauaacuccuggcgcuaucugucuaaucgauuacuggcucccagcgacuccccugaguggcucucauuugauguaacaggcguugugagacaauggcuuaguagggguggggagauugaaggauuccggcugagcgcccauuguucuugcgacucccgugauaacaccuugcaggucgacaucaauggcuuuacuacaggccgcagaggggaucuagcgaccauacacggaaugaacaggccauuccugcuccugauggcaacgccccuugagcgggcccagcaucugcagucaagccgacaccgcagagcuuuggacacuaauuacuguuuuaguucuaccgagaaaaacugcugugugaggcaacucuacaucgauuuccggaaggaccuggguuggaaauggauucacgaaccgaagggcuaucaugccaauuuuugcuuagggccuugucccuacaucuggucccuggauacacaguauagcaaggugcuagcacucuacaaccagcacaauccaggagcuucggccgcgccuugcugugucccccaggcccuggaaccacuucccauuguuuauuacgugggccgcaaaccuaagguagagcaauugucuaacaugaucgugagauccugcaaauguucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1749 - RNA, 1462 nt, Artificial Sequence
  mRNA product Design1 comprising derived and/or modified sequence from Homo sapiens__NP_003229.1__HsTGFB2 (opt3)
gggagaaagcuuaccaugcacuacugcgugcugagcgccuuccucauccuucaucuggucaccguugcuuuguccuuaucuacauguucaacucuggacauggaucaguuuaugagaaagaggauugaggcaauacggggccaaauccuaaguaaacucaagcugacgagcccucccgaagacuauccagagccggaagaggugcccccugaaguaauuuccaucuacaacucuacccgcgaucuucugcaggagaaagccucgcgacgugcggcugccugcgagagagaaaggucagacgaggaauauuacgcaaaggagguguauaaaauugauaugccacccuucuuuccuagcgagaaugccaucccacccacauucuaccggccuuauuuucgcauagucagauucgacgugagugcuauggaaaagaacgcauccaauuugguuaaggccgaguuuaggguguuccggcuccagaacccaaaagcucgcgucccggaacagcgaaucgagcuguaccaaauucugaagucuaaagaucucacuagccccacccagagauacaucgacuccaaggugguaaaaacaagggccgaaggggagugguuaucauuugauguuaccgacgcggugcacgaguggcugcaucacaaggaucggaaucuuggauucaagauuaguuugcauuguccuugcuguacuuuugucccaagcaacaauuauaucauacccaacaaaucugaggaacuggaagcacguuucgccgguauugacggcacauccaccuacacgucaggggaucagaagacuaucaaaagcacccgcaagaaaaauaguggaaagacaccucaccuacuccugaugcuucugccaucuuauagauuggagucccagcaaacuaacaggcggaaaaagcgagcucucgacgccgcauacugcuuucgcaaugugcaggacaacuguugccugagacccuuauauauugauuucaagagggaccugggcuggaaauggauccacgaaccgaaggguuacaaugcuaacuucugugccggggcgugcccuuaucucuggagcucggauacccagcauucucgggugcuuucccuguacaauacaaucaaccccgaggccucagcaaguccauguugcgucagccaggacuuggagccucuaaccauucuguacuauauaggaaaaacgcccaagaucgaacaacucuccaacaugauuguuaaaucuugcaaguguagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1750 - RNA, 1456 nt, Artificial Sequence
  mRNA product Design1 comprising derived and/or modified sequence from Homo sapiens__NP_003230.1__HsTGFB3 (opt3)
gggagaaagcuuaccaugaagaugcaucugcagagagcccucgugguccuugcucuguugaacuucgcaaccguuagcuuaucccugucuacaugcacuacgcuagacuuuggccacaucaaaaagaaaaggguggaggccauucgggggcaaauacucucaaagcugcgccuuaccagucccccugaaccaacaguaaugacucacgugccguaccagguccuggcguuguauaauagcacccgagagcuccuggaagagaugcauggagaacgugaggaggguuguacacaggaaaacaccgaguccgaauacuaugcuaaagagauccacaaguucgauaugauucagggccuggccgagcauaaugaacucgcagugugccccaaggggaucacuucuaaaguuuuuagauucaacgugucgucagucgagaagaauaggacaaacuuauuucgggccgaguuccgcgugcugagaguaccuaauccaagcaguaaaaggaacgaacaacggauugaacuuuuucagaucuugcgccccgacgagcacauagcuaagcagcgauacaucggaggcaaaaaucugccuaccagagguacggcagaguggcuauccuucgauguuacugacaccgugagggaauggcuccugcggcgugagucuaaccuugggcuggaaauuagcauccacuguccaugccauacauuucagcccaauggagauauuuuggagaacauccacgaagucauggagauaaaguucaagggcguggacaaugaggaugaccauggccgcggggaucucggaagacugaaaaagcaaaaagaccaccacaacccucauuuaauucugaugaugaucccaccgcacaggcucgauaaucccggucagggcgggcagcggaagaaacgagcccuugacacuaacuauuguuuucgcaaccuggaagagaauugcugugugagaccuuuguacauugauuucaggcaggaccuaggauggaaguggguccaugaaccaaaaggcuauuacgcuaacuuuugcuccggucccuguccuuaccugcggucagccgacaccacacacaguaccguucucgggcuguauaauacgcuuaacccagaggcgagcgcaucucccugcugugugccgcaagaucuggaaccuuugacuauccucuacuauguaggacgcacacccaagguggagcagcuguccaauauggucgugaagucaugcaaaugcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1751 - RNA, 1603 nt, Artificial Sequence
  mRNA product Design1 comprising derived and/or modified sequence from Homo sapiens__NP_001057.1__HsTNFRSF1B (opt3)
gggagaaagcuuaccauggcccccguggcugucugggcagcccuggcgguuggccucgagcuuugggcugccgcacacgcccugccugcucagguggcauucaccccauacgccccggaacccgggagcacaugcagauugagggaguauuacgaccaaacugcucagauguguugcuccaaguguucuccuggacagcaugccaaaguauuuugcacgaagaccucagauacagugugugacaguugcgaagauagcacuuauacccaguuauggaacugggucccagagugucuguccugcgguucucgguguucgucagaccaaguggaaacacaggcgugcacccgcgagcagaaucgaaucuguacuugccgucccggcugguacugcgcacuaagcaaacaggagggguguagacucugcgccccucugaggaagugucggccaggauucggcguugcucgccccgguacagaaaccagugauguggucugcaaaccuugugccccagggacguuuuccaacacuaccucuagcacagacauuugcagaccgcaccaaauauguaaugugguagcaauccccggaaacgcuuccauggaugccguuugcacuucaaccaguccuacaaggagcauggcgccaggcgccgugcaucuuccccagccugucucuacccggucccagcacacgcagccaacucccgagccgucaacagcaccuagcaccaguuuccuguugcccaugggcccaucuccucccgcugaaggguccacuggagacuuugcccucccagugggucugauugugggcgucacagcucuggggcucuuaaucauuggaguugugaauuguguaaucaugacccaagugaagaagaaaccccugugccuucagcgcgaggccaaggucccucauuugccagcagauaaagcccgaggcacgcaggguccggagcaacagcaucugcuaauaaccgcucccagcucgucuuccucaagucucgaaagcuccgcgucugcacuggacagaagggccccuacacggaaccagccacaggcucccgggguggaggccagcggagcaggcgaagcccgugcuucaacuggcaguuccgauagcucuccugggggacacgguacccaaguuaaugugacauguaucgucaacgugugcucaaguagcgaccacuccucucagugcucgagccaggccuccucaacuaugggcgauaccgacaguucuccaagcgagucccccaaggacgaacagguaccguucucaaaagaggagugugcauuucgcagccaacuugaaacaccugagacccuguuggggucuacugaagagaagccacucccccugggaguuccugaugcgggcaugaagcccuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1752 - RNA, 730 nt, Artificial Sequence
  mRNA product Design1 comprising derived and/or modified sequence from Homo sapiens__NP_002623.2__HsPGF (opt3)
gggagaaagcuuaccaugcccgugaugagacuguucccuugcuuucuccagcuucuggccggcuuggcuuuaccagcagucccgccccaacagugggcccugagcgcggggaacggauccucugagguugaagugguaccuuuccaggaggugugggguaggucauacugucgggcucuagaacgccucgucgacgugguuagugaguauccaagcgaaguggagcacauguuuucccccucuugcgucucgcugcuucgauguaccggcugcuguggggaugagaaucugcauugcgugccuguagaaacagccaacguuacuaugcaguugcucaagauccguucaggagacagaccaagcuacguggagcugacguucagucaacacgucaggugugaaugccggccccugcgcgagaaaaugaagccugagagaaggcggccaaaaggccgcgguaagcgaagaagggaaaaacagcggccgaccgauugucaucucugcggggacgcagugccccgucgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1753 - RNA, 1456 nt, Artificial Sequence
  mRNA product Design1 comprising derived and/or modified sequence from Homo sapiens__NP_001020537.2__HsVEGFA (opt3)
gggagaaagcuuaccaugaccgacagacagacagauacugcccccagcccuuccuaccaucugcucccaggcaggcggcgcacgguggacgcugcagccucucgagggcaaggaccggagcccgcgccugguggcggggucgaaggaguuggcgcucgugguguggcccuuaagcuguucguacaguuguuagggugcucaagauuuggaggcgcaguggucagggccggcgaggcugaaccaaguggggcagcccggagcgcuuccucuggacgcgaggaaccccagccugaggagggugaagaggaagaggagaaagaagaggaaagaggcccacaguggaggcugggggcccggaagcccggaucguggaccggcgaggcggcagugugugccgauucagcuccugccgcacgcgcuccacaagcccuagcgcgagccagcgguagagggggaaggguugcacggcguggcgcugaagagaguggcccgccccacuccccuucucgcagagggagcgccuccagggcuggaccaggucgggccucagagacaaugaacuuccuccugaguugggugcacuggagccuugcacuguugcucuaucugcaucacgccaaauggucucaggcugcgcccauggcagaaggcgggggacagaaucaucacgaggucgugaaguuuauggacguauaccagcgauccuauugccacccuaucgaaacucugguugauauuuuccaagaguacccagacgaaauagaguauaucuuuaaacccucaugugugccgcucaugcgcugcggcgguuguugcaacgaugagggguuagaaugugucccuaccgaggaaagcaauauuacaaugcagaucaugagaauuaagccccaucagggccagcacaucggagagaugaguuuccugcaacauaacaagugcgaauguaggccuaaaaaggaccgggcccgccaggagaaaaagucugugagaggcaaagggaagggacagaagaggaaacguaagaaaucccgguacaagagcuggucgguguaugucggugcucgaugcugucuuaugccauggucuuugcccggcccacaccccugcgggccuugcuccgagagaaggaaacaccuguuuguucaagauccacagaccuguaagugcucauguaaaaauacugacagucgcugcaaggcccggcagcuagaacucaacgagagaacauguaggugcgauaagccgcgccgaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1754 - RNA, 916 nt, Artificial Sequence
  mRNA product Design1 comprising derived and/or modified sequence from Homo sapiens__NP_001165094.1__HsVEGFA (opt3)
gggagaaagcuuaccaugaacuuccugcucagcugggugcacuggucccuugcccuguuguuauaccugcaucacgcuaaguggucucaggcagcccccauggcggagggcgggggacaaaaucaucacgaagucguuaaauuuauggacguguaucagagaucauacugccauccuaucgagacccuaguagauauuuuccaggaauauccagacgagauagaauacaucuuuaagccgaguugugugccccucaugaggugcgguggcuguugcaacgaugaggggcuggagugugucccuacagaagagagcaauauuacuaugcagaucaugcggauuaaaccacaccaaggacagcacaucggcgaaauguccuuccuucagcauaacaagugcgagugucgccccaaaaaggaccgagcucgucaggagaagaaaucugugagagguaaggggaaaggacaaaagaggaaacggaagaagucgcgcuauaaaucauggagcguuuacgugggcgccagaugcugucugaugccuuggaguuugccaggcccccacccuugcgggccauguuccgaaaggcggaagcaucucuuuguccaggauccgcagacgugcaaaugcucuuguaagaauaccgacagccgcugcaaagcacgacagcuggagcugaacgaaagaacauguaggugcgauaagccccggcguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1755 - RNA, 841 nt, Artificial Sequence
  mRNA product Design1 comprising derived and/or modified sequence from Homo sapiens__NP_003368.1__HsVEGFB (opt3)
gggagaaagcuuaccaugagcccccugcucagaaggcuucuguuggccgcuuuacugcagcuagccccugcacaagcgccagugucccagccggacgcucccggccaccagcggaaggucguuucuuggaucgauguguacacccgcgccacaugccagccucgagagguaguggucccacucacuguggaacugauggggacgguugcaaaacaacuugugcccucaugugucaccgugcagcguugcggagguuguugcccugacgauggccuggaguguguaccaacagggcagcaucagguuagaaugcaaauuuugaugauaagguaucccaguagccagcucggagaaaugucccuggaggaacacucucagugcgagugucggccuaagaaaaaggacucggccgugaaaccagaucgcgcugcaacuccgcaucacagaccccagccuaggucagucccaggcugggacagcgcccccggugcuccuaguccagccgauaucacccaucccacaccggcgccugggcccuccgcacacgccgcuccaucuaccacuagcgcccugacaccuggacccgcagcugccgcggccgacgcagcugccuccucaguggcuaagggcggcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1756 - RNA, 1477 nt, Artificial Sequence
  mRNA product Design1 comprising derived and/or modified sequence from Homo sapiens__NP_005420.1__HsVEGFC (opt3)
gggagaaagcuuaccaugcaccuucucggcuucuuuagcguggccugcucccuucuggcugcagccuuguuacccgggccuagagaggcgccagcugccgcagccgcuuucgaaucuggacuggaccuaucagaugcagagccggacgccggugaagcuaccgccuacgcgaguaaggaucucgaggaacagcugaggagcgucuccucuguugacgagcuuaugacagugcuguaucccgaguacuggaaaauguauaagugucaauugcggaaaggcggguggcagcauaaccgcgaacaggcaaaucucaacucgcgaacugaggaaacgaucaaguuugccgcugcccacuacaauaccgagauucugaaaucaauagauaacgaguggcguaagacacagugcaugccuagagaaguauguaucgacgugggaaaggaguucggcgucgcaacuaauaccuuuuucaaaccacccugcgugagcguuuauagguguggugggugcuguaacagugaaggacugcaaugcaugaauacauccaccucuuaccucagcaagacuuuauuugagauuacagugccucugucccagggcccaaaacccgucaccaucucauucgcuaaccauacgaguugucggugcaugagcaagcuggauguguaucgccagguacacucuauuaucagaagguccuugccugccacucugccacagugucaagcggccaauaaaaccugcccgacaaacuacauguggaauaaccauauaugccggugucuagcacaggaagacuuuauguucucaagcgaugcuggcgacgauaguacugacggguuucacgauaucugcggacccaauaaggagcucgacgaggaaaccugucagugcguuugucgcgccggucugcgaccugcuucuugcggcccacacaaggagcuugacagaaacuccugucagugcguguguaaaaauaagcuguuccccagccaaugcggggccaacagggaauuugaugagaacacaugucagugcgucugcaaacggaccuguccucguaaucagccauugaaccccggaaagugcgcaugugaaugcacggagucgccgcaaaaaugucuccugaagggcaaaaaguuccaucaccagacuugcucuuguuaccgcagaccuugcacaaauaggcagaaggccugugagcccgguuucuccuauucagaagaggugugccggugugugccaaguuacuggaaacgaccucagaugagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1757 - RNA, 1282 nt, Artificial Sequence
  mRNA product Design1 comprising derived and/or modified sequence from Homo sapiens__NP_004460.1__HsVEGFD (opt3)
gggagaaagcuuaccauguacagagaguggguggucguuaacguguucaugaugcuguauguacagcucgugcaaggcagcuccaaugaacacgggcccgucaagaggucuucacagaguacccuugagcggagcgaacagcagauccgcgccgcuuccucucuggaggaauuguuacgaauuacacauucggaggacuggaaacuguggcguugcagacuaaggcucaagucauuuacuagcauggauagucgguccgcaucucaccgcagcacgagauucgccgcgaccuuuuacgacauagagacacugaaagugaucgaugaagaguggcaaaggacucaguguuccccucgggaaaccugcguugagguggcuucagagcuuggaaagaguacaaacaccuucuuuaaaccaccgugugucaauguguuccgcugcgguggcuguugcaacgaagagagccugauuuguaugaauacuucuacauccuauaucucaaagcaguuguuugaaauuagcguaccccucaccaguguuccugagcuggugccagucaagguggccaaccauacggggugcaaaugucugcccacugcaccucgacacccauacucuaucauaagaagguccauccagauucccgaagaggaccggugcagccauucgaagaaacucuguccuaucgauauguuaugggacucuaauaagugcaaaugcgugcugcaagaggaaaacccacuugccggaaccgaggaucacucccacuugcaggaaccggcucuguguggcccccauaugauguucgacgaggaucguugcgaaugugucugcaagacaccuuguccaaaggaccuaauucagcaccccaaaaauugcucauguuuugagugcaaggagagucucgaaacuuguugccagaaacauaagcuguuccacccugauaccuguagcugcgaggaccgcugcccauuucacacaagacccugugcauccgguaaaaccgccugcgcuaagcauuguagguucccgaaagaaaagcgggccgcgcaagggccucacucucgaaagaaccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1758 - RNA, 847 nt, Artificial Sequence
  mRNA product Design1 comprising derived and/or modified sequence from Homo sapiens__NP_061986.1__HsFGF21 (opt4)
gggagaaagcuuaccauggacagcgacgagaccggcuucgagcacagcggccugugggugagcgugcuggccggccugcugcugggcgccugccaggcccaccccauccccgacagcagcccccugcugcaguucggcggccaggugagacagagauaccuguacaccgacgacgcccagcagaccgaggcccaccuggagaucagagaggacggcaccgugggcggcgccgccgaccagagccccgagagccugcugcagcugaaggcccugaagcccggcgugauccagauccugggcgugaagaccagcagauuccugugccagagacccgacggcgcccuguacggcagccugcacuucgaccccgaggccugcagcuucagagagcugcugcuggaggacggcuacaacguguaccagagcgaggcccacggccugccccugcaccugcccggcaacaagagcccccacagagaccccgcccccagaggccccgccagauuccugccccugcccggccugccccccgcccugcccgagccccccggcauccuggccccccagccccccgacgugggcagcagcgacccccugagcauggugggccccagccagggcagaagccccagcuacgccagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1759 - RNA, 1627 nt, Artificial Sequence
  mRNA product Design1 comprising derived and/or modified sequence from Homo sapiens__NP_002412.1__HsMMP1 (opt4)
gggagaaagcuuaccaugcacagcuuccccccccugcugcugcugcuguucuggggcguggugagccacagcuuccccgccacccuggagacccaggagcaggacguggaccuggugcagaaguaccuggagaaguacuacaaccugaagaacgacggcagacagguggagaagagaagaaacagcggccccgugguggagaagcugaagcagaugcaggaguucuucggccugaaggugaccggcaagcccgacgccgagacccugaaggugaugaagcagcccagaugcggcgugcccgacguggcccaguucgugcugaccgagggcaaccccagaugggagcagacccaccugaccuacagaaucgagaacuacacccccgaccugcccagagccgacguggaccacgccaucgagaaggccuuccagcuguggagcaacgugaccccccugaccuucaccaaggugagcgagggccaggccgacaucaugaucagcuucgugagaggcgaccacagagacaacagccccuucgacggccccggcggcaaccuggcccacgccuuccagcccggccccggcaucggcggcgacgcccacuucgacgaggacgagagauggaccaacaacuucagagaguacaaccugcacagaguggccgcccacgagcugggccacagccugggccugagccacagcaccgacaucggcgcccugauguaccccagcuacaccuucagcggcgacgugcagcuggcccaggacgacaucgacggcauccaggccaucuacggcagaagccagaaccccgugcagcccaucggcccccagacccccaaggccugcgacagcaagcugaccuucgacgccaucaccaccaucagaggcgaggugauguucuucaaggacagauucuacaugagaaccaaccccuucuaccccgagguggagcugaacuucaucagcguguucuggccccagcugcccaacggccuggaggccgccuacgaguucgccgacagagacgaggugagauucuucaagggcaacaaguacugggccgugcagggccagaacgugcugcacggcuaccccaaggacaucuacagcagcuucggcuuccccagaaccgugaagcacaucgacgccgcccugagcgaggagaacaccggcaagaccuacuucuucguggccaacaaguacuggagauacgacgaguacaagagaagcauggaccccggcuaccccaagaugaucgcccacgacuuccccggcaucggccacaagguggacgccguguucaugaaggacggcuucuucuacuucuuccacggcaccagacaguacaaguucgaccccaagaccaagagaauccugacccugcagaaggccaacagcugguucaacugcagaaagaacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1760 - RNA, 1387 nt, Artificial Sequence
  mRNA product Design1 comprising derived and/or modified sequence from Homo sapiens__NP_002412.1__HsMMP1(1-19,100-469) (opt4)
gggagaaagcuuaccaugcacagcuuccccccccugcugcugcugcuguucuggggcguggugagccacagcuucgugcugaccgagggcaaccccagaugggagcagacccaccugaccuacagaaucgagaacuacacccccgaccugcccagagccgacguggaccacgccaucgagaaggccuuccagcuguggagcaacgugaccccccugaccuucaccaaggugagcgagggccaggccgacaucaugaucagcuucgugagaggcgaccacagagacaacagccccuucgacggccccggcggcaaccuggcccacgccuuccagcccggccccggcaucggcggcgacgcccacuucgacgaggacgagagauggaccaacaacuucagagaguacaaccugcacagaguggccgcccacgagcugggccacagccugggccugagccacagcaccgacaucggcgcccugauguaccccagcuacaccuucagcggcgacgugcagcuggcccaggacgacaucgacggcauccaggccaucuacggcagaagccagaaccccgugcagcccaucggcccccagacccccaaggccugcgacagcaagcugaccuucgacgccaucaccaccaucagaggcgaggugauguucuucaaggacagauucuacaugagaaccaaccccuucuaccccgagguggagcugaacuucaucagcguguucuggccccagcugcccaacggccuggaggccgccuacgaguucgccgacagagacgaggugagauucuucaagggcaacaaguacugggccgugcagggccagaacgugcugcacggcuaccccaaggacaucuacagcagcuucggcuuccccagaaccgugaagcacaucgacgccgcccugagcgaggagaacaccggcaagaccuacuucuucguggccaacaaguacuggagauacgacgaguacaagagaagcauggaccccggcuaccccaagaugaucgcccacgacuuccccggcaucggccacaagguggacgccguguucaugaaggacggcuucuucuacuucuuccacggcaccagacaguacaaguucgaccccaagaccaagagaauccugacccugcagaaggccaacagcugguucaacugcagaaagaacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1761 - RNA, 3574 nt, Artificial Sequence
  mRNA product Design1 comprising derived and/or modified sequence from Clostridium histolyticum__BAA77453.1__ColG (opt4)
gggagaaagcuuaccaugaagaagaacauccugaagauccugauggacagcuacagcaaggagagcaagauccagaccgugagaagagugaccagcgugagccugcuggccguguaccugaccaugaacaccagcagccuggugcuggccaagcccaucgagaacaccaacgacaccagcaucaagaacguggagaagcugagaaacgcccccaacgaggagaacagcaagaagguggaggacagcaagaacgacaagguggagcacgugaagaacaucgaggaggccaagguggagcagguggcccccgaggugaagagcaagagcacccugagaagcgccagcaucgccaacaccaacagcgagaaguacgacuucgaguaccugaacggccugagcuacaccgagcugaccaaccugaucaagaacaucaaguggaaccagaucaacggccuguucaacuacagcaccggcagccagaaguucuucggcgacaagaacagagugcaggccaucaucaacgcccugcaggagagcggcagaaccuacaccgccaacgacaugaagggcaucgagaccuucaccgaggugcugagagccggcuucuaccugggcuacuacaacgacggccugagcuaccugaacgacagaaacuuccaggacaagugcauccccgccaugaucgccauccagaagaaccccaacuucaagcugggcaccgccgugcaggacgaggugaucaccagccugggcaagcugaucggcaacgccagcgccaacgccgagguggugaacaacugcgugcccgugcugaagcaguucagagagaaccugaaccaguacgcccccgacuacgugaagggcaccgccgugaacgagcugaucaagggcaucgaguucgacuucagcggcgccgccuacgagaaggacgugaagaccaugcccugguacggcaagaucgaccccuucaucaacgagcugaaggcccugggccuguacggcaacaucaccagcgccaccgagugggccagcgacgugggcaucuacuaccugagcaaguucggccuguacagcaccaacagaaacgacaucgugcagagccuggagaaggccguggacauguacaaguacggcaagaucgccuucguggccauggagagaaucaccugggacuacgacggcaucggcagcaacggcaagaagguggaccacgacaaguuccuggacgacgccgagaagcacuaccugcccaagaccuacaccuucgacaacggcaccuucaucaucagagccggcgacaaggugagcgaggagaagaucaagagacuguacugggccagcagagaggugaagagccaguuccacagaguggugggcaacgacaaggcccuggaggugggcaacgccgacgacgugcugaccaugaagaucuucaacagccccgaggaguacaaguucaacaccaacaucaacggcgugagcaccgacaacggcggccuguacaucgagcccagaggcaccuucuacaccuacgagagaaccccccagcagagcaucuucagccuggaggagcuguucagacacgaguacacccacuaccugcaggccagauaccugguggacggccuguggggccagggccccuucuacgagaagaacagacugaccugguucgacgagggcaccgccgaguucuucgccggcagcaccagaaccagcggcgugcugcccagaaagagcauccugggcuaccuggccaaggacaagguggaccacagauacagccugaagaagacccugaacagcggcuacgacgacagcgacuggauguucuacaacuacggcuucgccguggcccacuaccuguacgagaaggacaugcccaccuucaucaagaugaacaaggccauccugaacaccgacgugaagagcuacgacgagaucaucaagaagcugagcgacgacgccaacaagaacaccgaguaccagaaccacauccaggagcuggccgacaaguaccagggcgccggcaucccccuggugagcgacgacuaccugaaggaccacggcuacaagaaggccagcgagguguacagcgagaucagcaaggccgccagccugaccaacaccagcgugaccgccgagaagagccaguacuucaacaccuucacccugagaggcaccuacaccggcgagaccagcaagggcgaguucaaggacugggacgagaugagcaagaagcuggacggcacccuggagagccuggccaagaacagcuggagcggcuacaagacccugaccgccuacuucaccaacuacagagugaccagcgacaacaaggugcaguacgacgugguguuccacggcgugcugaccgacaacgccgacaucagcaacaacaaggcccccaucgccaaggugaccggccccagcaccggcgccgugggcagaaacaucgaguucagcggcaaggacagcaaggacgaggacggcaagaucgugagcuacgacugggacuucggcgacggcgccaccagcagaggcaagaacagcgugcacgccuacaagaaggccggcaccuacaacgugacccugaaggugaccgacgacaagggcgccaccgccaccgagagcuucaccaucgagaucaagaacgaggacaccaccacccccaucaccaaggagauggagcccaacgacgacaucaaggaggccaacggccccaucguggagggcgugaccgugaagggcgaccugaacggcagcgacgacgccgacaccuucuacuucgacgugaaggaggacggcgacgugaccaucgagcugcccuacagcggcagcagcaacuucaccuggcugguguacaaggagggcgacgaccagaaccacaucgccagcggcaucgacaagaacaacagcaaggugggcaccuucaagagcaccaagggcagacacuacguguucaucuacaagcacgacagcgccagcaacaucagcuacagccugaacaucaagggccugggcaacgagaagcugaaggagaaggagaacaacgacagcagcgacaaggccaccgugauccccaacuucaacaccaccaugcagggcagccugcugggcgacgacagcagagacuacuacagcuucgaggugaaggaggagggcgaggugaacaucgagcuggacaagaaggacgaguucggcgugaccuggacccugcaccccgagagcaacaucaacgacagaaucaccuacggccagguggacggcaacaaggugagcaacaaggugaagcugagacccggcaaguacuaccugcugguguacaaguacagcggcagcggcaacuacgagcugagagugaacaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1762 - RNA, 3298 nt, Artificial Sequence
  mRNA product Design1 comprising derived and/or modified sequence from Clostridium histolyticum__BAA77453.1__HsALB(1-18)_ColG(111-1118) (opt4)
gggagaaagcuuaccaugaagugggugaccuucaucagccugcuguuccuguucagcagcgccuacagcaucgccaacaccaacagcgagaaguacgacuucgaguaccugaacggccugagcuacaccgagcugaccaaccugaucaagaacaucaaguggaaccagaucaacggccuguucaacuacagcaccggcagccagaaguucuucggcgacaagaacagagugcaggccaucaucaacgcccugcaggagagcggcagaaccuacaccgccaacgacaugaagggcaucgagaccuucaccgaggugcugagagccggcuucuaccugggcuacuacaacgacggccugagcuaccugaacgacagaaacuuccaggacaagugcauccccgccaugaucgccauccagaagaaccccaacuucaagcugggcaccgccgugcaggacgaggugaucaccagccugggcaagcugaucggcaacgccagcgccaacgccgagguggugaacaacugcgugcccgugcugaagcaguucagagagaaccugaaccaguacgcccccgacuacgugaagggcaccgccgugaacgagcugaucaagggcaucgaguucgacuucagcggcgccgccuacgagaaggacgugaagaccaugcccugguacggcaagaucgaccccuucaucaacgagcugaaggcccugggccuguacggcaacaucaccagcgccaccgagugggccagcgacgugggcaucuacuaccugagcaaguucggccuguacagcaccaacagaaacgacaucgugcagagccuggagaaggccguggacauguacaaguacggcaagaucgccuucguggccauggagagaaucaccugggacuacgacggcaucggcagcaacggcaagaagguggaccacgacaaguuccuggacgacgccgagaagcacuaccugcccaagaccuacaccuucgacaacggcaccuucaucaucagagccggcgacaaggugagcgaggagaagaucaagagacuguacugggccagcagagaggugaagagccaguuccacagaguggugggcaacgacaaggcccuggaggugggcaacgccgacgacgugcugaccaugaagaucuucaacagccccgaggaguacaaguucaacaccaacaucaacggcgugagcaccgacaacggcggccuguacaucgagcccagaggcaccuucuacaccuacgagagaaccccccagcagagcaucuucagccuggaggagcuguucagacacgaguacacccacuaccugcaggccagauaccugguggacggccuguggggccagggccccuucuacgagaagaacagacugaccugguucgacgagggcaccgccgaguucuucgccggcagcaccagaaccagcggcgugcugcccagaaagagcauccugggcuaccuggccaaggacaagguggaccacagauacagccugaagaagacccugaacagcggcuacgacgacagcgacuggauguucuacaacuacggcuucgccguggcccacuaccuguacgagaaggacaugcccaccuucaucaagaugaacaaggccauccugaacaccgacgugaagagcuacgacgagaucaucaagaagcugagcgacgacgccaacaagaacaccgaguaccagaaccacauccaggagcuggccgacaaguaccagggcgccggcaucccccuggugagcgacgacuaccugaaggaccacggcuacaagaaggccagcgagguguacagcgagaucagcaaggccgccagccugaccaacaccagcgugaccgccgagaagagccaguacuucaacaccuucacccugagaggcaccuacaccggcgagaccagcaagggcgaguucaaggacugggacgagaugagcaagaagcuggacggcacccuggagagccuggccaagaacagcuggagcggcuacaagacccugaccgccuacuucaccaacuacagagugaccagcgacaacaaggugcaguacgacgugguguuccacggcgugcugaccgacaacgccgacaucagcaacaacaaggcccccaucgccaaggugaccggccccagcaccggcgccgugggcagaaacaucgaguucagcggcaaggacagcaaggacgaggacggcaagaucgugagcuacgacugggacuucggcgacggcgccaccagcagaggcaagaacagcgugcacgccuacaagaaggccggcaccuacaacgugacccugaaggugaccgacgacaagggcgccaccgccaccgagagcuucaccaucgagaucaagaacgaggacaccaccacccccaucaccaaggagauggagcccaacgacgacaucaaggaggccaacggccccaucguggagggcgugaccgugaagggcgaccugaacggcagcgacgacgccgacaccuucuacuucgacgugaaggaggacggcgacgugaccaucgagcugcccuacagcggcagcagcaacuucaccuggcugguguacaaggagggcgacgaccagaaccacaucgccagcggcaucgacaagaacaacagcaaggugggcaccuucaagagcaccaagggcagacacuacguguucaucuacaagcacgacagcgccagcaacaucagcuacagccugaacaucaagggccugggcaacgagaagcugaaggagaaggagaacaacgacagcagcgacaaggccaccgugauccccaacuucaacaccaccaugcagggcagccugcugggcgacgacagcagagacuacuacagcuucgaggugaaggaggagggcgaggugaacaucgagcuggacaagaaggacgaguucggcgugaccuggacccugcaccccgagagcaacaucaacgacagaaucaccuacggccagguggacggcaacaaggugagcaacaaggugaagcugagacccggcaaguacuaccugcugguguacaaguacagcggcagcggcaacuacgagcugagagugaacaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1763 - RNA, 3646 nt, Artificial Sequence
  mRNA product Design1 comprising derived and/or modified sequence from Clostridium histolyticum__BAA77453.1__HsALB(1-18)_ColG(1-110)_CS-F_ColG(111-1 118) (opt4)
gggagaaagcuuaccaugaagugggugaccuucaucagccugcuguuccuguucagcagcgccuacagcaugaagaagaacauccugaagauccugauggacagcuacagcaaggagagcaagauccagaccgugagaagagugaccagcgugagccugcuggccguguaccugaccaugaacaccagcagccuggugcuggccaagcccaucgagaacaccaacgacaccagcaucaagaacguggagaagcugagaaacgcccccaacgaggagaacagcaagaagguggaggacagcaagaacgacaagguggagcacgugaagaacaucgaggaggccaagguggagcagguggcccccgaggugaagagcaagagcacccugagaagcgccagcagaagaagaagaaagagaaucgccaacaccaacagcgagaaguacgacuucgaguaccugaacggccugagcuacaccgagcugaccaaccugaucaagaacaucaaguggaaccagaucaacggccuguucaacuacagcaccggcagccagaaguucuucggcgacaagaacagagugcaggccaucaucaacgcccugcaggagagcggcagaaccuacaccgccaacgacaugaagggcaucgagaccuucaccgaggugcugagagccggcuucuaccugggcuacuacaacgacggccugagcuaccugaacgacagaaacuuccaggacaagugcauccccgccaugaucgccauccagaagaaccccaacuucaagcugggcaccgccgugcaggacgaggugaucaccagccugggcaagcugaucggcaacgccagcgccaacgccgagguggugaacaacugcgugcccgugcugaagcaguucagagagaaccugaaccaguacgcccccgacuacgugaagggcaccgccgugaacgagcugaucaagggcaucgaguucgacuucagcggcgccgccuacgagaaggacgugaagaccaugcccugguacggcaagaucgaccccuucaucaacgagcugaaggcccugggccuguacggcaacaucaccagcgccaccgagugggccagcgacgugggcaucuacuaccugagcaaguucggccuguacagcaccaacagaaacgacaucgugcagagccuggagaaggccguggacauguacaaguacggcaagaucgccuucguggccauggagagaaucaccugggacuacgacggcaucggcagcaacggcaagaagguggaccacgacaaguuccuggacgacgccgagaagcacuaccugcccaagaccuacaccuucgacaacggcaccuucaucaucagagccggcgacaaggugagcgaggagaagaucaagagacuguacugggccagcagagaggugaagagccaguuccacagaguggugggcaacgacaaggcccuggaggugggcaacgccgacgacgugcugaccaugaagaucuucaacagccccgaggaguacaaguucaacaccaacaucaacggcgugagcaccgacaacggcggccuguacaucgagcccagaggcaccuucuacaccuacgagagaaccccccagcagagcaucuucagccuggaggagcuguucagacacgaguacacccacuaccugcaggccagauaccugguggacggccuguggggccagggccccuucuacgagaagaacagacugaccugguucgacgagggcaccgccgaguucuucgccggcagcaccagaaccagcggcgugcugcccagaaagagcauccugggcuaccuggccaaggacaagguggaccacagauacagccugaagaagacccugaacagcggcuacgacgacagcgacuggauguucuacaacuacggcuucgccguggcccacuaccuguacgagaaggacaugcccaccuucaucaagaugaacaaggccauccugaacaccgacgugaagagcuacgacgagaucaucaagaagcugagcgacgacgccaacaagaacaccgaguaccagaaccacauccaggagcuggccgacaaguaccagggcgccggcaucccccuggugagcgacgacuaccugaaggaccacggcuacaagaaggccagcgagguguacagcgagaucagcaaggccgccagccugaccaacaccagcgugaccgccgagaagagccaguacuucaacaccuucacccugagaggcaccuacaccggcgagaccagcaagggcgaguucaaggacugggacgagaugagcaagaagcuggacggcacccuggagagccuggccaagaacagcuggagcggcuacaagacccugaccgccuacuucaccaacuacagagugaccagcgacaacaaggugcaguacgacgugguguuccacggcgugcugaccgacaacgccgacaucagcaacaacaaggcccccaucgccaaggugaccggccccagcaccggcgccgugggcagaaacaucgaguucagcggcaaggacagcaaggacgaggacggcaagaucgugagcuacgacugggacuucggcgacggcgccaccagcagaggcaagaacagcgugcacgccuacaagaaggccggcaccuacaacgugacccugaaggugaccgacgacaagggcgccaccgccaccgagagcuucaccaucgagaucaagaacgaggacaccaccacccccaucaccaaggagauggagcccaacgacgacaucaaggaggccaacggccccaucguggagggcgugaccgugaagggcgaccugaacggcagcgacgacgccgacaccuucuacuucgacgugaaggaggacggcgacgugaccaucgagcugcccuacagcggcagcagcaacuucaccuggcugguguacaaggagggcgacgaccagaaccacaucgccagcggcaucgacaagaacaacagcaaggugggcaccuucaagagcaccaagggcagacacuacguguucaucuacaagcacgacagcgccagcaacaucagcuacagccugaacaucaagggccugggcaacgagaagcugaaggagaaggagaacaacgacagcagcgacaaggccaccgugauccccaacuucaacaccaccaugcagggcagccugcugggcgacgacagcagagacuacuacagcuucgaggugaaggaggagggcgaggugaacaucgagcuggacaagaaggacgaguucggcgugaccuggacccugcaccccgagagcaacaucaacgacagaaucaccuacggccagguggacggcaacaaggugagcaacaaggugaagcugagacccggcaaguacuaccugcugguguacaaguacagcggcagcggcaacuacgagcugagagugaacaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1764 - RNA, 3322 nt, Artificial Sequence
  mRNA product Design1 comprising derived and/or modified sequence from Clostridium histolyticum__BAA34542.1__ColH (opt4)
gggagaaagcuuaccaugaacuuccugaagaucauccugaacagaggcaagaccaugaagagaaagugccugagcaagagacugaugcuggccaucaccauggccaccaucuucaccgugaacagcacccugcccaucuacgccgccguggacaagaacaacgccaccgccgccgugcagaacgagagcaagagauacaccgugagcuaccugaagacccugaacuacuacgaccugguggaccugcuggugaagaccgagaucgagaaccugcccgaccuguuccaguacagcagcgacgccaaggaguucuacggcaacaagaccagaaugagcuucaucauggacgagaucggcagaagagccccccaguacaccgagaucgaccacaagggcauccccacccugguggagguggugagagccggcuucuaccugggcuuccacaacaaggagcugaacgagaucaacaagagaagcuucaaggagagagugauccccagcauccuggccauccagaagaaccccaacuucaagcugggcaccgaggugcaggacaagaucgugagcgccaccggccugcuggccggcaacgagaccgccccccccgagguggugaacaacuucacccccauccugcaggacugcaucaagaacaucgacagauacgcccuggacgaccugaagagcaaggcccuguucaacgugcuggccgcccccaccuacgacaucaccgaguaccugagagccaccaaggagaagcccgagaacacccccugguacggcaagaucgacggcuucaucaacgagcugaagaagcuggcccuguacggcaagaucaacgacaacaacagcuggaucaucgacaacggcaucuaccacaucgccccccugggcaagcugcacagcaacaacaagaucggcaucgagacccugaccgaggugaugaagguguaccccuaccugagcaugcagcaccugcagagcgccgaccagaucaagagacacuacgacagcaaggacgccgagggcaacaagaucccccuggacaaguucaagaaggagggcaaggagaaguacugccccaagaccuacaccuucgacgacggcaaggugaucaucaaggccggcgccagaguggaggaggagaaggugaagagacuguacugggccagcaaggaggugaacagccaguucuucagaguguacggcaucgacaagccccuggaggagggcaaccccgacgacauccugaccauggugaucuacaacagccccgaggaguacaagcugaacagcgugcuguacggcuacgacaccaacaacggcggcauguacaucgagcccgagggcaccuucuucaccuacgagagagaggcccaggagagcaccuacacccuggaggagcuguucagacacgaguacacccacuaccugcagggcagauacgccgugcccggccaguggggcagaaccaagcuguacgacaacgacagacugaccugguacgaggagggcggcgccgagcuguucgccggcagcaccagaaccagcggcauccugcccagaaagagcaucgugagcaacauccacaacaccaccagaaacaacagauacaagcugagcgacaccgugcacagcaaguacggcgccagcuucgaguucuacaacuacgccugcauguucauggacuacauguacaacaaggacaugggcauccugaacaagcugaacgaccuggccaagaacaacgacguggacggcuacgacaacuacaucagagaccugagcagcaacuacgcccugaacgacaaguaccaggaccacaugcaggagagaaucgacaacuacgagaaccugaccgugcccuucguggccgacgacuaccuggugagacacgccuacaagaaccccaacgagaucuacagcgagaucagcgagguggccaagcugaaggacgccaagagcgaggugaagaagagccaguacuucagcaccuucacccugagaggcagcuacaccggcggcgccagcaagggcaagcuggaggaccagaaggccaugaacaaguucaucgacgacagccugaagaagcuggacaccuacagcuggagcggcuacaagacccugaccgccuacuucaccaacuacaagguggacagcagcaacagagugaccuacgacgugguguuccacggcuaccugcccaacgagggcgacagcaagaacagccugcccuacggcaagaucaacggcaccuacaagggcaccgagaaggagaagaucaaguucagcagcgagggcagcuucgaccccgacggcaagaucgugagcuacgagugggacuucggcgacggcaacaagagcaacgaggagaaccccgagcacagcuacgacaaggugggcaccuacaccgugaagcugaaggugaccgacgacaagggcgagagcagcgugagcaccaccaccgccgagaucaaggaccugagcgagaacaagcugcccgugaucuacaugcacgugcccaagagcggcgcccugaaccagaaggugguguucuacggcaagggcaccuacgaccccgacggcagcaucgccggcuaccagugggacuucggcgacggcagcgacuucagcagcgagcagaaccccagccacguguacaccaagaagggcgaguacaccgugacccugagagugauggacagcagcggccagaugagcgagaagaccaugaagaucaagaucaccgaccccguguaccccaucggcaccgagaaggagcccaacaacagcaaggagaccgccagcggccccaucgugcccggcauccccgugagcggcaccaucgagaacaccagcgaccaggacuacuucuacuucgacgugaucacccccggcgaggugaagaucgacaucaacaagcugggcuacggcggcgccaccugggugguguacgacgagaacaacaacgccgugagcuacgccaccgacgacggccagaaccugagcggcaaguucaaggccgacaagcccggcagauacuacauccaccuguacauguucaacggcagcuacaugcccuacagaaucaacaucgagggcagcgugggcagaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1765 - RNA, 3283 nt, Artificial Sequence
  mRNA product Design1 comprising derived and/or modified sequence from Clostridium histolyticum__BAA34542.1__ColH (opt4)
gggagaaagcuuaccaugaagagaaagugccugagcaagagacugaugcuggccaucaccauggccaccaucuucaccgugaacagcacccugcccaucuacgccgccguggacaagaacaacgccaccgccgccgugcagaacgagagcaagagauacaccgugagcuaccugaagacccugaacuacuacgaccugguggaccugcuggugaagaccgagaucgagaaccugcccgaccuguuccaguacagcagcgacgccaaggaguucuacggcaacaagaccagaaugagcuucaucauggacgagaucggcagaagagccccccaguacaccgagaucgaccacaagggcauccccacccugguggagguggugagagccggcuucuaccugggcuuccacaacaaggagcugaacgagaucaacaagagaagcuucaaggagagagugauccccagcauccuggccauccagaagaaccccaacuucaagcugggcaccgaggugcaggacaagaucgugagcgccaccggccugcuggccggcaacgagaccgccccccccgagguggugaacaacuucacccccauccugcaggacugcaucaagaacaucgacagauacgcccuggacgaccugaagagcaaggcccuguucaacgugcuggccgcccccaccuacgacaucaccgaguaccugagagccaccaaggagaagcccgagaacacccccugguacggcaagaucgacggcuucaucaacgagcugaagaagcuggcccuguacggcaagaucaacgacaacaacagcuggaucaucgacaacggcaucuaccacaucgccccccugggcaagcugcacagcaacaacaagaucggcaucgagacccugaccgaggugaugaagguguaccccuaccugagcaugcagcaccugcagagcgccgaccagaucaagagacacuacgacagcaaggacgccgagggcaacaagaucccccuggacaaguucaagaaggagggcaaggagaaguacugccccaagaccuacaccuucgacgacggcaaggugaucaucaaggccggcgccagaguggaggaggagaaggugaagagacuguacugggccagcaaggaggugaacagccaguucuucagaguguacggcaucgacaagccccuggaggagggcaaccccgacgacauccugaccauggugaucuacaacagccccgaggaguacaagcugaacagcgugcuguacggcuacgacaccaacaacggcggcauguacaucgagcccgagggcaccuucuucaccuacgagagagaggcccaggagagcaccuacacccuggaggagcuguucagacacgaguacacccacuaccugcagggcagauacgccgugcccggccaguggggcagaaccaagcuguacgacaacgacagacugaccugguacgaggagggcggcgccgagcuguucgccggcagcaccagaaccagcggcauccugcccagaaagagcaucgugagcaacauccacaacaccaccagaaacaacagauacaagcugagcgacaccgugcacagcaaguacggcgccagcuucgaguucuacaacuacgccugcauguucauggacuacauguacaacaaggacaugggcauccugaacaagcugaacgaccuggccaagaacaacgacguggacggcuacgacaacuacaucagagaccugagcagcaacuacgcccugaacgacaaguaccaggaccacaugcaggagagaaucgacaacuacgagaaccugaccgugcccuucguggccgacgacuaccuggugagacacgccuacaagaaccccaacgagaucuacagcgagaucagcgagguggccaagcugaaggacgccaagagcgaggugaagaagagccaguacuucagcaccuucacccugagaggcagcuacaccggcggcgccagcaagggcaagcuggaggaccagaaggccaugaacaaguucaucgacgacagccugaagaagcuggacaccuacagcuggagcggcuacaagacccugaccgccuacuucaccaacuacaagguggacagcagcaacagagugaccuacgacgugguguuccacggcuaccugcccaacgagggcgacagcaagaacagccugcccuacggcaagaucaacggcaccuacaagggcaccgagaaggagaagaucaaguucagcagcgagggcagcuucgaccccgacggcaagaucgugagcuacgagugggacuucggcgacggcaacaagagcaacgaggagaaccccgagcacagcuacgacaaggugggcaccuacaccgugaagcugaaggugaccgacgacaagggcgagagcagcgugagcaccaccaccgccgagaucaaggaccugagcgagaacaagcugcccgugaucuacaugcacgugcccaagagcggcgcccugaaccagaaggugguguucuacggcaagggcaccuacgaccccgacggcagcaucgccggcuaccagugggacuucggcgacggcagcgacuucagcagcgagcagaaccccagccacguguacaccaagaagggcgaguacaccgugacccugagagugauggacagcagcggccagaugagcgagaagaccaugaagaucaagaucaccgaccccguguaccccaucggcaccgagaaggagcccaacaacagcaaggagaccgccagcggccccaucgugcccggcauccccgugagcggcaccaucgagaacaccagcgaccaggacuacuucuacuucgacgugaucacccccggcgaggugaagaucgacaucaacaagcugggcuacggcggcgccaccugggugguguacgacgagaacaacaacgccgugagcuacgccaccgacgacggccagaaccugagcggcaaguucaaggccgacaagcccggcagauacuacauccaccuguacauguucaacggcagcuacaugcccuacagaaucaacaucgagggcagcgugggcagaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1766 - RNA, 3217 nt, Artificial Sequence
  mRNA product Design1 comprising derived and/or modified sequence from Clostridium histolyticum__BAA34542.1__HsALB(1-18)_ColH(41-1021) (opt4)
gggagaaagcuuaccaugaagugggugaccuucaucagccugcuguuccuguucagcagcgccuacagcgugcagaacgagagcaagagauacaccgugagcuaccugaagacccugaacuacuacgaccugguggaccugcuggugaagaccgagaucgagaaccugcccgaccuguuccaguacagcagcgacgccaaggaguucuacggcaacaagaccagaaugagcuucaucauggacgagaucggcagaagagccccccaguacaccgagaucgaccacaagggcauccccacccugguggagguggugagagccggcuucuaccugggcuuccacaacaaggagcugaacgagaucaacaagagaagcuucaaggagagagugauccccagcauccuggccauccagaagaaccccaacuucaagcugggcaccgaggugcaggacaagaucgugagcgccaccggccugcuggccggcaacgagaccgccccccccgagguggugaacaacuucacccccauccugcaggacugcaucaagaacaucgacagauacgcccuggacgaccugaagagcaaggcccuguucaacgugcuggccgcccccaccuacgacaucaccgaguaccugagagccaccaaggagaagcccgagaacacccccugguacggcaagaucgacggcuucaucaacgagcugaagaagcuggcccuguacggcaagaucaacgacaacaacagcuggaucaucgacaacggcaucuaccacaucgccccccugggcaagcugcacagcaacaacaagaucggcaucgagacccugaccgaggugaugaagguguaccccuaccugagcaugcagcaccugcagagcgccgaccagaucaagagacacuacgacagcaaggacgccgagggcaacaagaucccccuggacaaguucaagaaggagggcaaggagaaguacugccccaagaccuacaccuucgacgacggcaaggugaucaucaaggccggcgccagaguggaggaggagaaggugaagagacuguacugggccagcaaggaggugaacagccaguucuucagaguguacggcaucgacaagccccuggaggagggcaaccccgacgacauccugaccauggugaucuacaacagccccgaggaguacaagcugaacagcgugcuguacggcuacgacaccaacaacggcggcauguacaucgagcccgagggcaccuucuucaccuacgagagagaggcccaggagagcaccuacacccuggaggagcuguucagacacgaguacacccacuaccugcagggcagauacgccgugcccggccaguggggcagaaccaagcuguacgacaacgacagacugaccugguacgaggagggcggcgccgagcuguucgccggcagcaccagaaccagcggcauccugcccagaaagagcaucgugagcaacauccacaacaccaccagaaacaacagauacaagcugagcgacaccgugcacagcaaguacggcgccagcuucgaguucuacaacuacgccugcauguucauggacuacauguacaacaaggacaugggcauccugaacaagcugaacgaccuggccaagaacaacgacguggacggcuacgacaacuacaucagagaccugagcagcaacuacgcccugaacgacaaguaccaggaccacaugcaggagagaaucgacaacuacgagaaccugaccgugcccuucguggccgacgacuaccuggugagacacgccuacaagaaccccaacgagaucuacagcgagaucagcgagguggccaagcugaaggacgccaagagcgaggugaagaagagccaguacuucagcaccuucacccugagaggcagcuacaccggcggcgccagcaagggcaagcuggaggaccagaaggccaugaacaaguucaucgacgacagccugaagaagcuggacaccuacagcuggagcggcuacaagacccugaccgccuacuucaccaacuacaagguggacagcagcaacagagugaccuacgacgugguguuccacggcuaccugcccaacgagggcgacagcaagaacagccugcccuacggcaagaucaacggcaccuacaagggcaccgagaaggagaagaucaaguucagcagcgagggcagcuucgaccccgacggcaagaucgugagcuacgagugggacuucggcgacggcaacaagagcaacgaggagaaccccgagcacagcuacgacaaggugggcaccuacaccgugaagcugaaggugaccgacgacaagggcgagagcagcgugagcaccaccaccgccgagaucaaggaccugagcgagaacaagcugcccgugaucuacaugcacgugcccaagagcggcgcccugaaccagaaggugguguucuacggcaagggcaccuacgaccccgacggcagcaucgccggcuaccagugggacuucggcgacggcagcgacuucagcagcgagcagaaccccagccacguguacaccaagaagggcgaguacaccgugacccugagagugauggacagcagcggccagaugagcgagaagaccaugaagaucaagaucaccgaccccguguaccccaucggcaccgagaaggagcccaacaacagcaaggagaccgccagcggccccaucgugcccggcauccccgugagcggcaccaucgagaacaccagcgaccaggacuacuucuacuucgacgugaucacccccggcgaggugaagaucgacaucaacaagcugggcuacggcggcgccaccugggugguguacgacgagaacaacaacgccgugagcuacgccaccgacgacggccagaaccugagcggcaaguucaaggccgacaagcccggcagauacuacauccaccuguacauguucaacggcagcuacaugcccuacagaaucaacaucgagggcagcgugggcagaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1767 - RNA, 3355 nt, Artificial Sequence
  mRNA product Design1 comprising derived and/or modified sequence from Clostridium histolyticum__BAA34542.1__HsALB(1-18)_ColH(1-40)_CS-F_ColH(41-102 1) (opt4)
gggagaaagcuuaccaugaagugggugaccuucaucagccugcuguuccuguucagcagcgccuacagcaugaagagaaagugccugagcaagagacugaugcuggccaucaccauggccaccaucuucaccgugaacagcacccugcccaucuacgccgccguggacaagaacaacgccaccgccgccagaagaagaagaaagagagugcagaacgagagcaagagauacaccgugagcuaccugaagacccugaacuacuacgaccugguggaccugcuggugaagaccgagaucgagaaccugcccgaccuguuccaguacagcagcgacgccaaggaguucuacggcaacaagaccagaaugagcuucaucauggacgagaucggcagaagagccccccaguacaccgagaucgaccacaagggcauccccacccugguggagguggugagagccggcuucuaccugggcuuccacaacaaggagcugaacgagaucaacaagagaagcuucaaggagagagugauccccagcauccuggccauccagaagaaccccaacuucaagcugggcaccgaggugcaggacaagaucgugagcgccaccggccugcuggccggcaacgagaccgccccccccgagguggugaacaacuucacccccauccugcaggacugcaucaagaacaucgacagauacgcccuggacgaccugaagagcaaggcccuguucaacgugcuggccgcccccaccuacgacaucaccgaguaccugagagccaccaaggagaagcccgagaacacccccugguacggcaagaucgacggcuucaucaacgagcugaagaagcuggcccuguacggcaagaucaacgacaacaacagcuggaucaucgacaacggcaucuaccacaucgccccccugggcaagcugcacagcaacaacaagaucggcaucgagacccugaccgaggugaugaagguguaccccuaccugagcaugcagcaccugcagagcgccgaccagaucaagagacacuacgacagcaaggacgccgagggcaacaagaucccccuggacaaguucaagaaggagggcaaggagaaguacugccccaagaccuacaccuucgacgacggcaaggugaucaucaaggccggcgccagaguggaggaggagaaggugaagagacuguacugggccagcaaggaggugaacagccaguucuucagaguguacggcaucgacaagccccuggaggagggcaaccccgacgacauccugaccauggugaucuacaacagccccgaggaguacaagcugaacagcgugcuguacggcuacgacaccaacaacggcggcauguacaucgagcccgagggcaccuucuucaccuacgagagagaggcccaggagagcaccuacacccuggaggagcuguucagacacgaguacacccacuaccugcagggcagauacgccgugcccggccaguggggcagaaccaagcuguacgacaacgacagacugaccugguacgaggagggcggcgccgagcuguucgccggcagcaccagaaccagcggcauccugcccagaaagagcaucgugagcaacauccacaacaccaccagaaacaacagauacaagcugagcgacaccgugcacagcaaguacggcgccagcuucgaguucuacaacuacgccugcauguucauggacuacauguacaacaaggacaugggcauccugaacaagcugaacgaccuggccaagaacaacgacguggacggcuacgacaacuacaucagagaccugagcagcaacuacgcccugaacgacaaguaccaggaccacaugcaggagagaaucgacaacuacgagaaccugaccgugcccuucguggccgacgacuaccuggugagacacgccuacaagaaccccaacgagaucuacagcgagaucagcgagguggccaagcugaaggacgccaagagcgaggugaagaagagccaguacuucagcaccuucacccugagaggcagcuacaccggcggcgccagcaagggcaagcuggaggaccagaaggccaugaacaaguucaucgacgacagccugaagaagcuggacaccuacagcuggagcggcuacaagacccugaccgccuacuucaccaacuacaagguggacagcagcaacagagugaccuacgacgugguguuccacggcuaccugcccaacgagggcgacagcaagaacagccugcccuacggcaagaucaacggcaccuacaagggcaccgagaaggagaagaucaaguucagcagcgagggcagcuucgaccccgacggcaagaucgugagcuacgagugggacuucggcgacggcaacaagagcaacgaggagaaccccgagcacagcuacgacaaggugggcaccuacaccgugaagcugaaggugaccgacgacaagggcgagagcagcgugagcaccaccaccgccgagaucaaggaccugagcgagaacaagcugcccgugaucuacaugcacgugcccaagagcggcgcccugaaccagaaggugguguucuacggcaagggcaccuacgaccccgacggcagcaucgccggcuaccagugggacuucggcgacggcagcgacuucagcagcgagcagaaccccagccacguguacaccaagaagggcgaguacaccgugacccugagagugauggacagcagcggccagaugagcgagaagaccaugaagaucaagaucaccgaccccguguaccccaucggcaccgagaaggagcccaacaacagcaaggagaccgccagcggccccaucgugcccggcauccccgugagcggcaccaucgagaacaccagcgaccaggacuacuucuacuucgacgugaucacccccggcgaggugaagaucgacaucaacaagcugggcuacggcggcgccaccugggugguguacgacgagaacaacaacgccgugagcuacgccaccgacgacggccagaaccugagcggcaaguucaaggccgacaagcccggcagauacuacauccaccuguacauguucaacggcagcuacaugcccuacagaaucaacaucgagggcagcgugggcagaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1768 - RNA, 793 nt, Artificial Sequence
  mRNA product Design1 comprising derived and/or modified sequence from Homo sapiens__NP_001133.1__HsAMELX (opt4)
gggagaaagcuuaccaugggcaccuggauccuguucgccugccugcugggcgccgccuucgccaugccccugcccccccaccccggccaccccggcuacaucaacuucagcuacgaggugcugaccccccugaagugguaccagagcaucagaccccccuaccccagcuacggcuacgagcccaugggcggcuggcugcaccaccagaucauccccgugcugagccagcagcacccccccacccacacccugcagccccaccaccacauccccguggugcccgcccagcagcccgugaucccccagcagcccaugaugcccgugcccggccagcacagcaugacccccauccagcaccaccagcccaaccugcccccccccgcccagcagcccuaccagccccagcccgugcagccccagccccaccagcccaugcagccccagccccccgugcaccccaugcagccccugcccccccagcccccccugccccccauguuccccaugcagccccugccccccaugcugcccgaccugacccuggaggccuggcccagcaccgacaagaccaagagagaggagguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1769 - RNA, 352 nt, Artificial Sequence
  mRNA product Design1 comprising derived and/or modified sequence from Homo sapiens__NP_001133.1__HsAMELX-TRAP (opt4)
gggagaaagcuuaccaugccccugcccccccaccccggccaccccggcuacaucaacuucagcuacgaggugcugaccccccugaagugguaccagagcaucagaccccccuaccccagcuacggcuacgagcccaugggcggcuggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1770 - RNA, 385 nt, Artificial Sequence
  mRNA product Design1 comprising derived and/or modified sequence from Homo sapiens__NP_001133.1__HsAMELX-LRAP (opt4)
gggagaaagcuuaccaugccccugcccccccaccccggccaccccggcuacaucaacuucagcuacgaggugcugaccccccugaagugguaccagagcaucagacccccccccaugcugcccgaccugacccuggaggccuggcccagcaccgacaagaccaagagagaggagguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1771 - RNA, 424 nt, Artificial Sequence
  mRNA product Design1 comprising derived and/or modified sequence from Homo sapiens__NP_001133.1__HLA-A2-SP_HsAMELX(17-60) (opt4)
gggagaaagcuuaccauggccgugauggcccccagaacccuggugcugcugcugagcggcgcccuggcccugacccagaccugggccaugccccugcccccccaccccggccaccccggcuacaucaacuucagcuacgaggugcugaccccccugaagugguaccagagcaucagaccccccuaccccagcuacggcuacgagcccaugggcggcuggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1772 - RNA, 457 nt, Artificial Sequence
  mRNA product Design1 comprising derived and/or modified sequence from Homo sapiens__NP_001133.1__HLA-A2-SP_HsAMELX(17-47,168-191) (opt4)
gggagaaagcuuaccauggccgugauggcccccagaacccuggugcugcugcugagcggcgcccuggcccugacccagaccugggccaugccccugcccccccaccccggccaccccggcuacaucaacuucagcuacgaggugcugaccccccugaagugguaccagagcaucagacccccccccaugcugcccgaccugacccuggaggccuggcccagcaccgacaagaccaagagagaggagguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1773 - RNA, 796 nt, Artificial Sequence
  mRNA product Design1 comprising derived and/or modified sequence from Homo sapiens__NP_001134.1__HsAMELY (opt4)
gggagaaagcuuaccaugggcaccuggauccuguucgccugccuggugggcgccgccuucgccaugccccugcccccccaccccggccaccccggcuacaucaacuucagcuacgaggugcugaccccccugaagugguaccagagcaugaucagaccccccuacagcagcuacggcuacgagcccaugggcggcuggcugcaccaccagaucauccccguggugagccagcagcacccccugacccacacccugcagagccaccaccacauccccguggugcccgcccagcagcccagagugagacagcaggcccugaugcccgugcccggccagcagagcaugacccccacccagcaccaccagcccaaccugccccugcccgcccagcagcccuuccagccccagcccgugcagccccagccccaccagcccaugcagccccagccccccgugcagcccaugcagccccugcugccccagcccccccugccccccauguucccccugagaccccugccccccauccugcccgaccugcaccuggaggccuggcccgccaccgacaagaccaagcaggaggagguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1774 - RNA, 355 nt, Artificial Sequence
  mRNA product Design1 comprising derived and/or modified sequence from Homo sapiens__NP_001134.1__HsAMELY-TRAP (opt4)
gggagaaagcuuaccaugccccugcccccccaccccggccaccccggcuacaucaacuucagcuacgaggugcugaccccccugaagugguaccagagcaugaucagaccccccuacagcagcuacggcuacgagcccaugggcggcuggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1775 - RNA, 388 nt, Artificial Sequence
  mRNA product Design1 comprising derived and/or modified sequence from Homo sapiens__NP_001134.1__HsAMELY-LRAP (opt4)
gggagaaagcuuaccaugccccugcccccccaccccggccaccccggcuacaucaacuucagcuacgaggugcugaccccccugaagugguaccagagcaugaucagacccccccccauccugcccgaccugcaccuggaggccuggcccgccaccgacaagaccaagcaggaggagguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1776 - RNA, 427 nt, Artificial Sequence
  mRNA product Design1 comprising derived and/or modified sequence from Homo sapiens__NP_001134.1__HLA-A2-SP_HsAMELY(17-61) (opt4)
gggagaaagcuuaccauggccgugauggcccccagaacccuggugcugcugcugagcggcgcccuggcccugacccagaccugggccaugccccugcccccccaccccggccaccccggcuacaucaacuucagcuacgaggugcugaccccccugaagugguaccagagcaugaucagaccccccuacagcagcuacggcuacgagcccaugggcggcuggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1777 - RNA, 460 nt, Artificial Sequence
  mRNA product Design1 comprising derived and/or modified sequence from Homo sapiens__NP_001134.1__HLA-A2-SP_HsAMELY(17-48,169-192) (opt4)
gggagaaagcuuaccauggccgugauggcccccagaacccuggugcugcugcugagcggcgcccuggcccugacccagaccugggccaugccccugcccccccaccccggccaccccggcuacaucaacuucagcuacgaggugcugaccccccugaagugguaccagagcaugaucagacccccccccauccugcccgaccugcaccuggaggccuggcccgccaccgacaagaccaagcaggaggagguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1778 - RNA, 787 nt, Artificial Sequence
  mRNA product Design1 comprising derived and/or modified sequence from Sus scrofa__NP_999071.1__SsAMELX-001-1 (opt4)
gggagaaagcuuaccaugggcaccuggauccuguucgccugccugcugggcgccgccuucagcaugccccugcccccccaccccggccaccccggcuacaucaacuucagcuacgaggugcugaccccccugaagugguaccagaacaugaucagacaccccuacaccagcuacggcuacgagcccaugggcggcuggcugcaccaccagaucauccccguggugagccagcagaccccccagagccacgcccugcagccccaccaccacauccccauggugcccgcccagcagcccggcaucccccagcagcccaugaugccccugcccggccagcacagcaugacccccacccagcaccaccagcccaaccugccccugcccgcccagcagcccuuccagccccagcccgugcagccccagccccaccagccccugcagccccagagccccaugcaccccauccagccccugcugccccagcccccccugccccccauguucagcaugcagagccugcugcccgaccugccccuggaggccuggcccgccaccgacaagaccaagagagaggagguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1779 - RNA, 355 nt, Artificial Sequence
  mRNA product Design1 comprising derived and/or modified sequence from Sus scrofa__NP_999071.1__SsAMELX-TRAP (opt4)
gggagaaagcuuaccaugccccugcccccccaccccggccaccccggcuacaucaacuucagcuacgaggugcugaccccccugaagugguaccagaacaugaucagacaccccuacaccagcuacggcuacgagcccaugggcggcuggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1780 - RNA, 388 nt, Artificial Sequence
  mRNA product Design1 comprising derived and/or modified sequence from Sus scrofa__NP_999071.1__SsAMELX-LRAP (opt4)
gggagaaagcuuaccaugccccugcccccccaccccggccaccccggcuacaucaacuucagcuacgaggugcugaccccccugaagugguaccagaacaugaucagacaccccagccugcugcccgaccugccccuggaggccuggcccgccaccgacaagaccaagagagaggagguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1781 - RNA, 427 nt, Artificial Sequence
  mRNA product Design1 comprising derived and/or modified sequence from Sus scrofa__NP_999071.1__HLA-A2-SP_SsAMEL(17-61) (opt4)
gggagaaagcuuaccauggccgugauggcccccagaacccuggugcugcugcugagcggcgcccuggcccugacccagaccugggccaugccccugcccccccaccccggccaccccggcuacaucaacuucagcuacgaggugcugaccccccugaagugguaccagaacaugaucagacaccccuacaccagcuacggcuacgagcccaugggcggcuggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1782 - RNA, 460 nt, Artificial Sequence
  mRNA product Design1 comprising derived and/or modified sequence from Sus scrofa__NP_999071.1__HLA-A2-SP_SsAMEL(17-49,167-189) (opt4)
gggagaaagcuuaccauggccgugauggcccccagaacccuggugcugcugcugagcggcgcccuggcccugacccagaccugggccaugccccugcccccccaccccggccaccccggcuacaucaacuucagcuacgaggugcugaccccccugaagugguaccagaacaugaucagacaccccagccugcugcccgaccugccccuggaggccuggcccgccaccgacaagaccaagagagaggagguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1783 - RNA, 751 nt, Artificial Sequence
  mRNA product Design1 comprising derived and/or modified sequence from Sus scrofa__P45561-2__SsAMELX-001-2 (opt4)
gggagaaagcuuaccaugggcaccuggauccuguucgccugccugcugggcgccgccuucagcaugccccugcccccccaccccggccaccccggcuacaucaacuucagcuacaucagacaccccuacaccagcuacggcuacgagcccaugggcggcuggcugcaccaccagaucauccccguggugagccagcagaccccccagagccacgcccugcagccccaccaccacauccccauggugcccgcccagcagcccggcaucccccagcagcccaugaugccccugcccggccagcacagcaugacccccacccagcaccaccagcccaaccugccccugcccgcccagcagcccuuccagccccagcccgugcagccccagccccaccagccccugcagccccagagccccaugcaccccauccagccccugcugccccagcccccccugccccccauguucagcaugcagagccugcugcccgaccugccccuggaggccuggcccgccaccgacaagaccaagagagaggagguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1784 - RNA, 787 nt, Artificial Sequence
  mRNA product Design1 comprising derived and/or modified sequence from Sus scrofa__NP_998965.1__SsAMELX-001-3 (opt4)
gggagaaagcuuaccaugggcaccuggaucuucuucgccugccugcugggcgccagccuggccaugccccugcccccccaccccggccaccccggcuacaucaacuucagcuacgaggugcugaccccccugaagugguaccagaacaugaucagacaccccuacaccagcuacggcuacgagcccaugggcggcuggcugcaccaccagaucauccccguggugagccagcagaccccccagagccacgcccugcagccccaccaccacauccccauggugcccgcccagcagcccggcaucccccagcagcccaugaugccccugcccggccagcacagcaugacccccacccagcaccaccagcccaaccugccccugcccgcccagcagcccuuccagccccagcccgugcagccccagccccaccagccccugcagccccagagccccaugcaccccauccagccccugcugccccagcccccccugccccccauguucagcaugcagagccugcugcccgaccugccccuggaggccuggcccgccaccgacaagaccaagagagaggagguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1785 - RNA, 436 nt, Artificial Sequence
  mRNA product Design1 comprising derived and/or modified sequence from Sus scrofa__K7GPB2__SsAMELX-002 (opt4)
gggagaaagcuuaccaugggcaccuggauccuguucgccugccugcugggcgccgccuucagcaugccccugcccccccaccccggccaccccggcuacaucaacuucagcuacgaggugcugaccccccugaagugguaccagaacaugaucagacaccccagccugcugcccgaccugccccuggaggccuggcccgccaccgacaagaccaagagagaggagguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1786 - RNA, 829 nt, Artificial Sequence
  mRNA product Design1 comprising derived and/or modified sequence from Sus scrofa__K7GLD0__SsAMELX-003 (opt4)
gggagaaagcuuaccaugggcaccuggauccuguucgccugccugcugggcgccgccuucagcaugccccugcccccccaccccggccaccccggcuacaucaacuucagcuacgaggaccuguaccuggaggccaucagaaucgacagaaccgccuucgugcugaccccccugaagugguaccagaacaugaucagacaccccuacaccagcuacggcuacgagcccaugggcggcuggcugcaccaccagaucauccccguggugagccagcagaccccccagagccacgcccugcagccccaccaccacauccccauggugcccgcccagcagcccggcaucccccagcagcccaugaugccccugcccggccagcacagcaugacccccacccagcaccaccagcccaaccugccccugcccgcccagcagcccuuccagccccagcccgugcagccccagccccaccagccccugcagccccagagccccaugcaccccauccagccccugcugccccagcccccccugccccccauguucagcaugcagagccugcugcccgaccugccccuggaggccuggcccgccaccgacaagaccaagagagaggagguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1787 - RNA, 715 nt, Artificial Sequence
  mRNA product Design1 comprising derived and/or modified sequence from Sus scrofa__K7GPE9__SsAMELX-004 (opt4)
gggagaaagcuuaccaugggcaccuggauccuguucgccugccugcugggcgccgccuucagcaugccccugcccccccaccccggccaccccggcuacaucaacuucagcuacgaggugcugaccccccugaagugguaccagaacaugaucagacaccccaccccccagagccacgcccugcagccccaccaccacauccccauggugcccgcccagcagcccggcaucccccagcagcccaugaugccccugcccggccagcacagcaugacccccacccagcaccaccagcccaaccugccccugcccgcccagcagcccuuccagccccagcccgugcagccccagccccaccagccccugcagccccagagccccaugcaccccauccagccccugcugccccagcccccccugccccccauguucagcaugcagagccugcugcccgaccugccccuggaggccuggcccgccaccgacaagaccaagagagaggagguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1788 - RNA, 739 nt, Artificial Sequence
  mRNA product Design1 comprising derived and/or modified sequence from Sus scrofa__J9JIM4__SsAMELX-201 (opt4)
gggagaaagcuuaccaugccccugcccccccaccccggccaccccggcuacaucaacuucagcuacgaggugcugaccccccugaagugguaccagaacaugaucagacaccccuacaccagcuacggcuacgagcccaugggcggcuggcugcaccaccagaucauccccguggugagccagcagaccccccagagccacgcccugcagccccaccaccacauccccauggugcccgcccagcagcccggcaucccccagcagcccaugaugccccugcccggccagcacagcaugacccccacccagcaccaccagcccaaccugccccugcccgcccagcagcccuuccagccccagcccgugcagccccagccccaccagccccugcagccccagagccccaugcaccccauccagccccugcugccccagcccccccugccccccauguucagcaugcagagccugcugcccgaccugccccuggaggccuggcccgccaccgacaagaccaagagagaggagguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1789 - RNA, 3178 nt, Artificial Sequence
  mRNA product Design1 comprising derived and/or modified sequence from Homo sapiens__NP_006120.1__HsBMP1 (opt4)
gggagaaagcuuaccaugcccggcguggccagacugccccugcugcugggccugcugcugcugcccagacccggcagaccccuggaccuggccgacuacaccuacgaccuggccgaggaggacgacagcgagccccugaacuacaaggaccccugcaaggccgccgccuuccugggcgacaucgcccuggacgaggaggaccugagagccuuccaggugcagcaggccguggaccugagaagacacaccgccagaaagagcagcaucaaggccgccgugcccggcaacaccagcacccccagcugccagagcaccaacggccagccccagagaggcgccugcggcagauggagaggcagaagcagaagcagaagagccgccaccagcagacccgagagaguguggcccgacggcgugauccccuucgugaucggcggcaacuucaccggcagccagagagccguguucagacaggccaugagacacugggagaagcacaccugcgugaccuuccuggagagaaccgacgaggacagcuacaucguguucaccuacagacccugcggcugcugcagcuacgugggcagaagaggcggcggcccccaggccaucagcaucggcaagaacugcgacaaguucggcaucguggugcacgagcugggccacguggugggcuucuggcacgagcacaccagacccgacagagacagacacgugagcaucgugagagagaacauccagcccggccaggaguacaacuuccugaagauggagccccaggagguggagagccugggcgagaccuacgacuucgacagcaucaugcacuacgccagaaacaccuucagcagaggcaucuuccuggacaccaucgugcccaaguacgaggugaacggcgugaagccccccaucggccagagaaccagacugagcaagggcgacaucgcccaggccagaaagcuguacaagugccccgccugcggcgagacccugcaggacagcaccggcaacuucagcagccccgaguaccccaacggcuacagcgcccacaugcacugcguguggagaaucagcgugacccccggcgagaagaucauccugaacuucaccagccuggaccuguacagaagcagacugugcugguacgacuacguggaggugagagacggcuucuggagaaaggccccccugagaggcagauucugcggcagcaagcugcccgagcccaucgugagcaccgacagcagacuguggguggaguucagaagcagcagcaacugggugggcaagggcuucuucgccguguacgaggccaucugcggcggcgacgugaagaaggacuacggccacauccagagccccaacuaccccgacgacuacagacccagcaaggugugcaucuggagaauccaggugagcgagggcuuccacgugggccugaccuuccagagcuucgagaucgagagacacgacagcugcgccuacgacuaccuggaggugagagacggccacagcgagagcagcacccugaucggcagauacugcggcuacgagaagcccgacgacaucaagagcaccagcagcagacuguggcugaaguucgugagcgacggcagcaucaacaaggccggcuucgccgugaacuucuucaaggagguggacgagugcagcagacccaacagaggcggcugcgagcagagaugccugaacacccugggcagcuacaagugcagcugcgaccccggcuacgagcuggcccccgacaagagaagaugcgaggccgccugcggcggcuuccugaccaagcugaacggcagcaucaccagccccggcuggcccaaggaguacccccccaacaagaacugcaucuggcagcugguggcccccacccaguacagaaucagccugcaguucgacuucuucgagaccgagggcaacgacgugugcaaguacgacuucguggaggugagaagcggccugaccgccgacagcaagcugcacggcaaguucugcggcagcgagaagcccgaggugaucaccagccaguacaacaacaugagaguggaguucaagagcgacaacaccgugagcaagaagggcuucaaggcccacuucuucagcgacaaggacgagugcagcaaggacaacggcggcugccagcaggacugcgugaacaccuucggcagcuacgagugccagugcagaagcggcuucgugcugcacgacaacaagcacgacugcaaggaggccggcugcgaccacaaggugaccagcaccagcggcaccaucaccagccccaacuggcccgacaaguaccccagcaagaaggagugcaccugggccaucagcagcacccccggccacagagugaagcugaccuucauggagauggacaucgagagccagcccgagugcgccuacgaccaccuggagguguucgacggcagagacgccaaggcccccgugcugggcagauucugcggcagcaagaagcccgagcccgugcuggccaccggcagcagaauguuccugagauucuacagcgacaacagcgugcagagaaagggcuuccaggccagccacgccaccgagugcggcggccaggugagagccgacgugaagaccaaggaccuguacagccacgcccaguucggcgacaacaacuaccccggcggcguggacugcgagugggugaucguggccgaggagggcuacggcguggagcugguguuccagaccuucgagguggaggaggagaccgacugcggcuacgacuacauggagcuguucgacggcuacgacagcaccgcccccagacugggcagauacugcggcagcggcccccccgaggagguguacagcgccggcgacagcgugcuggugaaguuccacagcgacgacaccaucaccaagaagggcuuccaccugagauacaccagcaccaaguuccaggacacccugcacagcagaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1790 - RNA, 1408 nt, Artificial Sequence
  mRNA product Design1 comprising derived and/or modified sequence from Homo sapiens__NP_001191.1__HsBMP2 (opt4)
gggagaaagcuuaccaugguggccggcaccagaugccugcuggcccugcugcugccccaggugcugcugggcggcgccgccggccuggugcccgagcugggcagaagaaaguucgccgccgccagcagcggcagacccagcagccagcccagcgacgaggugcugagcgaguucgagcugagacugcugagcauguucggccugaagcagagacccacccccagcagagacgccguggugccccccuacaugcuggaccuguacagaagacacagcggccagcccggcagccccgcccccgaccacagacuggagagagccgccagcagagccaacaccgugagaagcuuccaccacgaggagagccuggaggagcugcccgagaccagcggcaagaccaccagaagauucuucuucaaccugagcagcauccccaccgaggaguucaucaccagcgccgagcugcagguguucagagagcagaugcaggacgcccugggcaacaacagcagcuuccaccacagaaucaacaucuacgagaucaucaagcccgccaccgccaacagcaaguuccccgugaccagacugcuggacaccagacuggugaaccagaacgccagcagaugggagagcuucgacgugacccccgccgugaugagauggaccgcccagggccacgccaaccacggcuucgugguggagguggcccaccuggaggagaagcagggcgugagcaagagacacgugagaaucagcagaagccugcaccaggacgagcacagcuggagccagaucagaccccugcuggugaccuucggccacgacggcaagggccacccccugcacaagagagagaagagacaggccaagcacaagcagagaaagagacugaagagcagcugcaagagacacccccuguacguggacuucagcgacgugggcuggaacgacuggaucguggccccccccggcuaccacgccuucuacugccacggcgagugccccuucccccuggccgaccaccugaacagcaccaaccacgccaucgugcagacccuggugaacagcgugaacagcaagauccccaaggccugcugcgugcccaccgagcugagcgccaucagcaugcuguaccuggacgagaacgagaagguggugcugaagaacuaccaggacauggugguggagggcugcggcugcagaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1791 - RNA, 1444 nt, Artificial Sequence
  mRNA product Design1 comprising derived and/or modified sequence from Homo sapiens__NP_001193.2__HsBMP4 (opt4)
gggagaaagcuuaccaugauccccggcaacagaaugcugaugguggugcugcugugccaggugcugcugggcggcgccagccacgccagccugauccccgagaccggcaagaagaagguggccgagauccagggccacgccggcggcagaagaagcggccagagccacgagcugcugagagacuucgaggccacccugcugcagauguucggccugagaagaagaccccagcccagcaagagcgccgugauccccgacuacaugagagaccuguacagacugcagagcggcgaggaggaggaggagcagauccacagcaccggccuggaguaccccgagagacccgccagcagagccaacaccgugagaagcuuccaccacgaggagcaccuggagaacauccccggcaccagcgagaacagcgccuucagauuccuguucaaccugagcagcauccccgagaacgaggugaucagcagcgccgagcugagacuguucagagagcagguggaccagggccccgacugggagagaggcuuccacagaaucaacaucuacgaggugaugaagccccccgccgagguggugcccggccaccugaucaccagacugcuggacaccagacuggugcaccacaacgugaccagaugggagaccuucgacgugagccccgccgugcugagauggaccagagagaagcagcccaacuacggccuggccaucgaggugacccaccugcaccagaccagaacccaccagggccagcacgugagaaucagcagaagccugccccagggcagcggcaacugggcccagcugagaccccugcuggugaccuucggccacgacggcagaggccacgcccugaccagaagaagaagagccaagagaagccccaagcaccacagccagagagccagaaagaagaacaagaacugcagaagacacagccuguacguggacuucagcgacgugggcuggaacgacuggaucguggccccccccggcuaccaggccuucuacugccacggcgacugccccuucccccuggccgaccaccugaacagcaccaaccacgccaucgugcagacccuggugaacagcgugaacagcagcauccccaaggccugcugcgugcccaccgagcugagcgccaucagcaugcuguaccuggacgaguacgacaagguggugcugaagaacuaccaggagauggugguggagggcugcggcugcagaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1792 - RNA, 1759 nt, Artificial Sequence
  mRNA product Design1 comprising derived and/or modified sequence from Homo sapiens__NP_001709.1__HsBMP6 (opt4)
gggagaaagcuuaccaugcccggccugggcagaagagcccaguggcugugcuggugguggggccugcugugcagcugcugcggcccccccccccugagacccccccugcccgccgccgccgccgccgccgccggcggccagcugcugggcgacggcggcagccccggcagaaccgagcagcccccccccagcccccagagcagcagcggcuuccuguacagaagacugaagacccaggagaagagagagaugcagaaggagauccugagcgugcugggccugccccacagacccagaccccugcacggccugcagcagccccagccccccgcccugagacagcaggaggagcagcagcagcagcagcagcugcccagaggcgagcccccccccggcagacugaagagcgccccccuguucaugcuggaccuguacaacgcccugagcgccgacaacgacgaggacggcgccagcgagggcgagagacagcagagcuggccccacgaggccgccagcagcagccagagaagacagcccccccccggcgccgcccacccccugaacagaaagagccugcuggcccccggcagcggcagcggcggcgccagcccccugaccagcgcccaggacagcgccuuccugaacgacgccgacauggugaugagcuucgugaaccugguggaguacgacaaggaguucagccccagacagagacaccacaaggaguucaaguucaaccugagccagauccccgagggcgagguggugaccgccgccgaguucagaaucuacaaggacugcgugaugggcagcuucaagaaccagaccuuccugaucagcaucuaccaggugcugcaggagcaccagcacagagacagcgaccuguuccugcuggacaccagaguggugugggccagcgaggagggcuggcuggaguucgacaucaccgccaccagcaaccuguggguggugaccccccagcacaacaugggccugcagcugagcguggugaccagagacggcgugcacgugcaccccagagccgccggccuggugggcagagacggccccuacgacaagcagcccuucaugguggccuucuucaaggugagcgaggugcacgugagaaccaccagaagcgccagcagcagaagaagacagcagagcagaaacagaagcacccagagccaggacguggccagagugagcagcgccagcgacuacaacagcagcgagcugaagaccgccugcagaaagcacgagcuguacgugagcuuccaggaccugggcuggcaggacuggaucaucgcccccaagggcuacgccgccaacuacugcgacggcgagugcagcuucccccugaacgcccacaugaacgccaccaaccacgccaucgugcagacccuggugcaccugaugaaccccgaguacgugcccaagcccugcugcgcccccaccaagcugaacgccaucagcgugcuguacuucgacgacaacagcaacgugauccugaagaaguacagaaacaugguggugagagccugcggcugccacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1793 - RNA, 1513 nt, Artificial Sequence
  mRNA product Design1 comprising derived and/or modified sequence from Homo sapiens__NP_001710.1__HsBMP7 (opt4)
gggagaaagcuuaccaugcacgugagaagccugagagccgccgccccccacagcuucguggcccugugggccccccuguuccugcugagaagcgcccuggccgacuucagccuggacaacgaggugcacagcagcuucauccacagaagacugagaagccaggagagaagagagaugcagagagagauccugagcauccugggccugccccacagacccagaccccaccugcagggcaagcacaacagcgcccccauguucaugcuggaccuguacaacgccauggccguggaggagggcggcggccccggcggccagggcuucagcuaccccuacaaggccguguucagcacccagggccccccccuggccagccugcaggacagccacuuccugaccgacgccgacauggugaugagcuucgugaaccugguggagcacgacaaggaguucuuccaccccagauaccaccacagagaguucagauucgaccugagcaagauccccgagggcgaggccgugaccgccgccgaguucagaaucuacaaggacuacaucagagagagauucgacaacgagaccuucagaaucagcguguaccaggugcugcaggagcaccugggcagagagagcgaccuguuccugcuggacagcagaacccugugggccagcgaggagggcuggcugguguucgacaucaccgccaccagcaaccacuggguggugaaccccagacacaaccugggccugcagcugagcguggagacccuggacggccagagcaucaaccccaagcuggccggccugaucggcagacacggcccccagaacaagcagcccuucaugguggccuucuucaaggccaccgaggugcacuucagaagcaucagaagcaccggcagcaagcagagaagccagaacagaagcaagacccccaagaaccaggaggcccugagaauggccaacguggccgagaacagcagcagcgaccagagacaggccugcaagaagcacgagcuguacgugagcuucagagaccugggcuggcaggacuggaucaucgcccccgagggcuacgccgccuacuacugcgagggcgagugcgccuucccccugaacagcuacaugaacgccaccaaccacgccaucgugcagacccuggugcacuucaucaaccccgagaccgugcccaagcccugcugcgcccccacccagcugaacgccaucagcgugcuguacuucgacgacagcagcaacgugauccugaagaaguacagaaacaugguggugagagccugcggcugccacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1794 - RNA, 517 nt, Artificial Sequence
  mRNA product Design1 comprising derived and/or modified sequence from Homo sapiens__NP_006264.2__HsCCL7 (opt4)
gggagaaagcuuaccaugaaggccagcgccgcccugcugugccugcugcugaccgccgccgccuucagcccccagggccuggcccagcccgugggcaucaacaccagcaccaccugcugcuacagauucaucaacaagaagauccccaagcagagacuggagagcuacagaagaaccaccagcagccacugccccagagaggccgugaucuucaagaccaagcuggacaaggagaucugcgccgaccccacccagaagugggugcaggacuucaugaagcaccuggacaagaagacccagacccccaagcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1795 - RNA, 3841 nt, Artificial Sequence
  mRNA product Design1 comprising derived and/or modified sequence from Homo sapiens__NP_001954.2__HsEGF (opt4)
gggagaaagcuuaccaugcugcugacccugaucauccugcugcccguggugagcaaguucagcuucgugagccugagcgccccccagcacuggagcugccccgagggcacccuggccggcaacggcaacagcaccugcgugggccccgcccccuuccugaucuucagccacggcaacagcaucuucagaaucgacaccgagggcaccaacuacgagcagcuggugguggacgccggcgugagcgugaucauggacuuccacuacaacgagaagagaaucuacuggguggaccuggagagacagcugcugcagagaguguuccugaacggcagcagacaggagagagugugcaacaucgagaagaacgugagcggcauggccaucaacuggaucaacgaggaggugaucuggagcaaccagcaggagggcaucaucaccgugaccgacaugaagggcaacaacagccacauccugcugagcgcccugaaguaccccgccaacguggccguggaccccguggagagauucaucuucuggagcagcgagguggccggcagccuguacagagccgaccuggacggcgugggcgugaaggcccugcuggagaccagcgagaagaucaccgccgugagccuggacgugcuggacaagagacuguucuggauccaguacaacagagagggcagcaacagccugaucugcagcugcgacuacgacggcggcagcgugcacaucagcaagcaccccacccagcacaaccuguucgccaugagccuguucggcgacagaaucuucuacagcaccuggaagaugaagaccaucuggaucgccaacaagcacaccggcaaggacauggugagaaucaaccugcacagcagcuucgugccccugggcgagcugaagguggugcacccccuggcccagcccaaggccgaggacgacaccugggagcccgagcagaagcugugcaagcugagaaagggcaacugcagcagcaccgugugcggccaggaccugcagagccaccugugcaugugcgccgagggcuacgcccugagcagagacagaaaguacugcgaggacgugaacgagugcgccuucuggaaccacggcugcacccugggcugcaagaacacccccggcagcuacuacugcaccugccccgugggcuucgugcugcugcccgacggcaagagaugccaccagcuggugagcugccccagaaacgugagcgagugcagccacgacugcgugcugaccagcgagggcccccugugcuucugccccgagggcagcgugcuggagagagacggcaagaccugcagcggcugcagcagccccgacaacggcggcugcagccagcugugcgugccccugagccccgugagcugggagugcgacugcuuccccggcuacgaccugcagcuggacgagaagagcugcgccgccagcggcccccagcccuuccugcuguucgccaacagccaggacaucagacacaugcacuucgacggcaccgacuacggcacccugcugagccagcagaugggcaugguguacgcccuggaccacgaccccguggagaacaagaucuacuucgcccacaccgcccugaaguggaucgagagagccaacauggacggcagccagagagagagacugaucgaggagggcguggacgugcccgagggccuggccguggacuggaucggcagaagauucuacuggaccgacagaggcaagagccugaucggcagaagcgaccugaacggcaagagaagcaagaucaucaccaaggagaacaucagccagcccagaggcaucgccgugcaccccauggccaagagacuguucuggaccgacaccggcaucaaccccagaaucgagagcagcagccugcagggccugggcagacuggugaucgccagcagcgaccugaucuggcccagcggcaucaccaucgacuuccugaccgacaagcuguacuggugcgacgccaagcagagcgugaucgagauggccaaccuggacggcagcaagagaagaagacugacccagaacgacgugggccaccccuucgccguggccguguucgaggacuacgugugguucagcgacugggccaugcccagcgugaugagagugaacaagagaaccggcaaggacagagugagacugcagggcagcaugcugaagcccagcagccuggugguggugcacccccuggccaagcccggcgccgaccccugccuguaccagaacggcggcugcgagcacaucugcaagaagagacugggcaccgccuggugcagcugcagagagggcuucaugaaggccagcgacggcaagaccugccuggcccuggacggccaccagcugcuggccggcggcgagguggaccugaagaaccaggugaccccccuggacauccugagcaagaccagagugagcgaggacaacaucaccgagagccagcacaugcugguggccgagaucauggugagcgaccaggacgacugcgcccccgugggcugcagcauguacgccagaugcaucagcgagggcgaggacgccaccugccagugccugaagggcuucgccggcgacggcaagcugugcagcgacaucgacgagugcgagaugggcgugcccgugugcccccccgccagcagcaagugcaucaacaccgagggcggcuacgugugcagaugcagcgagggcuaccagggcgacggcauccacugccuggacaucgacgagugccagcugggcgagcacagcugcggcgagaacgccagcugcaccaacaccgagggcggcuacaccugcaugugcgccggcagacugagcgagcccggccugaucugccccgacagcaccccccccccccaccugagagaggacgaccaccacuacagcgugagaaacagcgacagcgagugcccccugagccacgacggcuacugccugcacgacggcgugugcauguacaucgaggcccuggacaaguacgccugcaacugcguggugggcuacaucggcgagagaugccaguacagagaccugaaguggugggagcugagacacgccggccacggccagcagcagaaggugaucgugguggccgugugcgugguggugcuggugaugcugcugcugcugagccuguggggcgcccacuacuacagaacccagaagcugcugagcaagaaccccaagaaccccuacgaggagagcagcagagacgugagaagcagaagacccgccgacaccgaggacggcaugagcagcugcccccagcccugguucguggugaucaaggagcaccaggaccugaagaacggcggccagcccguggccggcgaggacggccaggccgccgacggcagcaugcagcccaccagcuggagacaggagccccagcugugcggcaugggcaccgagcagggcugcuggauccccgugagcagcgacaagggcagcugcccccaggugauggagagaagcuuccacaugcccagcuacggcacccagacccuggagggcggcguggagaagccccacagccugcugagcgccaacccccuguggcagcagagagcccuggaccccccccaccagauggagcugacccagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1796 - RNA, 727 nt, Artificial Sequence
  mRNA product Design1 comprising derived and/or modified sequence from Homo sapiens__NP_001423.1__HsEREG (opt4)
gggagaaagcuuaccaugaccgccggcagaagaauggagaugcugugcgccggcagagugcccgcccugcugcugugccugggcuuccaccugcugcaggccgugcugagcaccaccgugauccccagcugcauccccggcgagagcagcgacaacugcaccgcccuggugcagaccgaggacaaccccagaguggcccaggugagcaucaccaagugcagcagcgacaugaacggcuacugccugcacggccagugcaucuaccugguggacaugagccagaacuacugcagaugcgaggugggcuacaccggcgugagaugcgagcacuucuuccugaccgugcaccagccccugagcaaggaguacguggcccugaccgugauccugaucauccuguuccugaucaccguggugggcagcaccuacuacuucugcagaugguacagaaacagaaagagcaaggagcccaagaaggaguacgagagagugaccagcggcgaccccgagcugccccaggugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1797 - RNA, 685 nt, Artificial Sequence
  mRNA product Design1 comprising derived and/or modified sequence from Homo sapiens__NP_000791.1__HsFGF1 (opt4)
gggagaaagcuuaccauggccgagggcgagaucaccaccuucaccgcccugaccgagaaguucaaccugccccccggcaacuacaagaagcccaagcugcuguacugcagcaacggcggccacuuccugagaauccugcccgacggcaccguggacggcaccagagacagaagcgaccagcacauccagcugcagcugagcgccgagagcgugggcgagguguacaucaagagcaccgagaccggccaguaccuggccauggacaccgacggccugcuguacggcagccagacccccaacgaggagugccuguuccuggagagacuggaggagaaccacuacaacaccuacaucagcaagaagcacgccgagaagaacugguucgugggccugaagaagaacggcagcugcaagagaggccccagaacccacuacggccagaaggccauccuguuccugccccugcccgugagcagcgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1798 - RNA, 1084 nt, Artificial Sequence
  mRNA product Design1 comprising derived and/or modified sequence from Homo sapiens__NP_001997.5__HsFGF2 (opt4)
gggagaaagcuuaccauggugggcgugggcggcggcgacguggaggacgugacccccagacccggcggcugccagaucagcggcagaggcgccagaggcugcaacggcauccccggcgccgccgccugggaggccgcccugcccagaagaagacccagaagacaccccagcgugaaccccagaagcagagccgccggcagccccagaaccagaggcagaagaaccgaggagagacccagcggcagcagacugggcgacagaggcagaggcagagcccugcccggcggcagacugggcggcagaggcagaggcagagcccccgagagagugggcggcagaggcagaggcagaggcaccgccgcccccagagccgcccccgccgccagaggcagcagacccggccccgccggcaccauggccgccggcagcaucaccacccugcccgcccugcccgaggacggcggcagcggcgccuucccccccggccacuucaaggaccccaagagacuguacugcaagaacggcggcuucuuccugagaauccaccccgacggcagaguggacggcgugagagagaagagcgacccccacaucaagcugcagcugcaggccgaggagagaggcguggugagcaucaagggcgugugcgccaacagauaccuggccaugaaggaggacggcagacugcuggccagcaagugcgugaccgacgagugcuucuucuucgagagacuggagagcaacaacuacaacaccuacagaagcagaaaguacaccagcugguacguggcccugaagagaaccggccaguacaagcugggcagcaagaccggccccggccagaaggccauccuguuccugcccaugagcgccaagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1799 - RNA, 802 nt, Artificial Sequence
  mRNA product Design1 comprising derived and/or modified sequence from Homo sapiens__NP_002000.1__HsFGF7 (opt4)
gggagaaagcuuaccaugcacaaguggauccugaccuggauccugcccacccugcuguacagaagcugcuuccacaucaucugccuggugggcaccaucagccuggccugcaacgacaugacccccgagcagauggccaccaacgugaacugcagcagccccgagagacacaccagaagcuacgacuacauggagggcggcgacaucagagugagaagacuguucugcagaacccagugguaccugagaaucgacaagagaggcaaggugaagggcacccaggagaugaagaacaacuacaacaucauggagaucagaaccguggccgugggcaucguggccaucaagggcguggagagcgaguucuaccuggccaugaacaaggagggcaagcuguacgccaagaaggagugcaacgaggacugcaacuucaaggagcugauccuggagaaccacuacaacaccuacgccagcgccaaguggacccacaacggcggcgagauguucguggcccugaaccagaagggcauccccgugagaggcaagaagaccaagaaggagcagaagaccgcccacuuccugcccauggccaucaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1800 - RNA, 844 nt, Artificial Sequence
  mRNA product Design1 comprising derived and/or modified sequence from Homo sapiens__NP_001936.1__HsHBEGF (opt4)
gggagaaagcuuaccaugaagcugcugcccagcguggugcugaagcuguuccuggccgccgugcugagcgcccuggugaccggcgagagccuggagagacugagaagaggccuggccgccggcaccagcaaccccgacccccccaccgugagcaccgaccagcugcugccccugggcggcggcagagacagaaaggugagagaccugcaggaggccgaccuggaccugcugagagugacccugagcagcaagccccaggcccuggccacccccaacaaggaggagcacggcaagagaaagaagaagggcaagggccugggcaagaagagagaccccugccugagaaaguacaaggacuucugcauccacggcgagugcaaguacgugaaggagcugagagcccccagcugcaucugccaccccggcuaccacggcgagagaugccacggccugagccugcccguggagaacagacuguacaccuacgaccacaccaccauccuggccgugguggccguggugcugagcagcgugugccugcuggugaucgugggccugcugauguucagauaccacagaagaggcggcuacgacguggagaacgaggagaaggugaagcugggcaugaccaacagccacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1801 - RNA, 2404 nt, Artificial Sequence
  mRNA product Design1 comprising derived and/or modified sequence from Homo sapiens__NP_000592.3__HsHGF (opt4)
gggagaaagcuuaccaugugggugaccaagcugcugcccgcccugcugcugcagcacgugcugcugcaccugcugcugcugcccaucgccauccccuacgccgagggccagagaaagagaagaaacaccauccacgaguucaagaagagcgccaagaccacccugaucaagaucgaccccgcccugaagaucaagaccaagaaggugaacaccgccgaccagugcgccaacagaugcaccagaaacaagggccugcccuucaccugcaaggccuucguguucgacaaggccagaaagcagugccugugguuccccuucaacagcaugagcagcggcgugaagaaggaguucggccacgaguucgaccuguacgagaacaaggacuacaucagaaacugcaucaucggcaagggcagaagcuacaagggcaccgugagcaucaccaagagcggcaucaagugccagcccuggagcagcaugaucccccacgagcacagcuuccugcccagcagcuacagaggcaaggaccugcaggagaacuacugcagaaaccccagaggcgaggagggcggccccuggugcuucaccagcaaccccgaggugagauacgaggugugcgacaucccccagugcagcgagguggagugcaugaccugcaacggcgagagcuacagaggccugauggaccacaccgagagcggcaagaucugccagagaugggaccaccagaccccccacagacacaaguuccugcccgagagauaccccgacaagggcuucgacgacaacuacugcagaaaccccgacggccagcccagacccuggugcuacacccuggacccccacaccagaugggaguacugcgccaucaagaccugcgccgacaacaccaugaacgacaccgacgugccccuggagaccaccgagugcauccagggccagggcgagggcuacagaggcaccgugaacaccaucuggaacggcauccccugccagagaugggacagccaguacccccacgagcacgacaugacccccgagaacuucaagugcaaggaccugagagagaacuacugcagaaaccccgacggcagcgagagccccuggugcuucaccaccgaccccaacaucagagugggcuacugcagccagauccccaacugcgacaugagccacggccaggacugcuacagaggcaacggcaagaacuacaugggcaaccugagccagaccagaagcggccugaccugcagcaugugggacaagaacauggaggaccugcacagacacaucuucugggagcccgacgccagcaagcugaacgagaacuacugcagaaaccccgacgacgacgcccacggccccuggugcuacaccggcaacccccugauccccugggacuacugccccaucagcagaugcgagggcgacaccacccccaccaucgugaaccuggaccaccccgugaucagcugcgccaagaccaagcagcugagaguggugaacggcauccccaccagaaccaacaucggcuggauggugagccugagauacagaaacaagcacaucugcggcggcagccugaucaaggagagcugggugcugaccgccagacagugcuuccccagcagagaccugaaggacuacgaggccuggcugggcauccacgacgugcacggcagaggcgacgagaagugcaagcaggugcugaacgugagccagcugguguacggccccgagggcagcgaccuggugcugaugaagcuggccagacccgccgugcuggacgacuucgugagcaccaucgaccugcccaacuacggcugcaccauccccgagaagaccagcugcagcguguacggcuggggcuacaccggccugaucaacuacgacggccugcugagaguggcccaccuguacaucaugggcaacgagaagugcagccagcaccacagaggcaaggugacccugaacgagagcgagaucugcgccggcgccgagaagaucggcagcggccccugcgagggcgacuacggcggcccccuggugugcgagcagcacaagaugagaauggugcugggcgugaucgugcccggcagaggcugcgccauccccaacagacccggcaucuucgugagaguggccuacuacgccaaguggauccacaagaucauccugaccuacaaggugccccagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1802 - RNA, 2143 nt, Artificial Sequence
  mRNA product Design1 comprising derived and/or modified sequence from Homo sapiens__NP_005336.3 __HsHSPA1A (opt4)
gggagaaagcuuaccauggccaaggccgccgccaucggcaucgaccugggcaccaccuacagcugcgugggcguguuccagcacggcaagguggagaucaucgccaacgaccagggcaacagaaccacccccagcuacguggccuucaccgacaccgagagacugaucggcgacgccgccaagaaccagguggcccugaacccccagaacaccguguucgacgccaagagacugaucggcagaaaguucggcgaccccguggugcagagcgacaugaagcacuggcccuuccaggugaucaacgacggcgacaagcccaaggugcaggugagcuacaagggcgagaccaaggccuucuaccccgaggagaucagcagcauggugcugaccaagaugaaggagaucgccgaggccuaccugggcuaccccgugaccaacgccgugaucaccgugcccgccuacuucaacgacagccagagacaggccaccaaggacgccggcgugaucgccggccugaacgugcugagaaucaucaacgagcccaccgccgccgccaucgccuacggccuggacagaaccggcaagggcgagagaaacgugcugaucuucgaccugggcggcggcaccuucgacgugagcauccugaccaucgacgacggcaucuucgaggugaaggccaccgccggcgacacccaccugggcggcgaggacuucgacaacagacuggugaaccacuucguggaggaguucaagagaaagcacaagaaggacaucagccagaacaagagagccgugagaagacugagaaccgccugcgagagagccaagagaacccugagcagcagcacccaggccagccuggagaucgacagccuguucgagggcaucgacuucuacaccagcaucaccagagccagauucgaggagcugugcagcgaccuguucagaagcacccuggagcccguggagaaggcccugagagacgccaagcuggacaaggcccagauccacgaccuggugcuggugggcggcagcaccagaauccccaaggugcagaagcugcugcaggacuucuucaacggcagagaccugaacaagagcaucaaccccgacgaggccguggccuacggcgccgccgugcaggccgccauccugaugggcgacaagagcgagaacgugcaggaccugcugcugcuggacguggccccccugagccugggccuggagaccgccggcggcgugaugaccgcccugaucaagagaaacagcaccauccccaccaagcagacccagaucuucaccaccuacagcgacaaccagcccggcgugcugauccagguguacgagggcgagagagccaugaccaaggacaacaaccugcugggcagauucgagcugagcggcaucccccccgcccccagaggcgugccccagaucgaggugaccuucgacaucgacgccaacggcauccugaacgugaccgccaccgacaagagcaccggcaaggccaacaagaucaccaucaccaacgacaagggcagacugagcaaggaggagaucgagagaauggugcaggaggccgagaaguacaaggccgaggacgaggugcagagagagagagugagcgccaagaacgcccuggagagcuacgccuucaacaugaagagcgccguggaggacgagggccugaagggcaagaucagcgaggccgacaagaagaaggugcuggacaagugccaggaggugaucagcuggcuggacgccaacacccuggccgagaaggacgaguucgagcacaagagaaaggagcuggagcaggugugcaaccccaucaucagcggccuguaccagggcgccggcggccccggccccggcggcuucggcgcccagggccccaagggcggcagcggcagcggccccaccaucgaggagguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1803 - RNA, 2143 nt, Artificial Sequence; identical to SEQ ID NO: 1802
  mRNA product Design1 comprising derived and/or modified sequence from Homo sapiens__NP_005337.2 __HsHSPA1B (opt4)

SEQ ID NO: 1804 - RNA, 2143 nt, Artificial Sequence
  mRNA product Design1 comprising derived and/or modified sequence from Homo sapiens__NP_005518.3 __HsHSPA1L (opt4)
gggagaaagcuuaccauggccaccgccaagggcaucgccaucggcaucgaccugggcaccaccuacagcugcgugggcguguuccagcacggcaagguggagaucaucgccaacgaccagggcaacagaaccacccccagcuacguggccuucaccgacaccgagagacugaucggcgacgccgccaagaaccagguggccaugaacccccagaacaccguguucgacgccaagagacugaucggcagaaaguucaacgaccccguggugcaggccgacaugaagcuguggcccuuccaggugaucaacgagggcggcaagcccaaggugcuggugagcuacaagggcgagaacaaggccuucuaccccgaggagaucagcagcauggugcugaccaagcugaaggagaccgccgaggccuuccugggccaccccgugaccaacgccgugaucaccgugcccgccuacuucaacgacagccagagacaggccaccaaggacgccggcgugaucgccggccugaacgugcugagaaucaucaacgagcccaccgccgccgccaucgccuacggccuggacaagggcggccagggcgagagacacgugcugaucuucgaccugggcggcggcaccuucgacgugagcauccugaccaucgacgacggcaucuucgaggugaaggccaccgccggcgacacccaccugggcggcgaggacuucgacaacagacuggugagccacuucguggaggaguucaagagaaagcacaagaaggacaucagccagaacaagagagccgugagaagacugagaaccgccugcgagagagccaagagaacccugagcagcagcacccaggccaaccuggagaucgacagccuguacgagggcaucgacuucuacaccagcaucaccagagccagauucgaggagcugugcgccgaccuguucagaggcacccuggagcccguggagaaggcccugagagacgccaagauggacaaggccaagauccacgacaucgugcuggugggcggcagcaccagaauccccaaggugcagagacugcugcaggacuacuucaacggcagagaccugaacaagagcaucaaccccgacgaggccguggccuacggcgccgccgugcaggccgccauccugaugggcgacaagagcgagaaggugcaggaccugcugcugcuggacguggccccccugagccugggccuggagaccgccggcggcgugaugaccgcccugaucaagagaaacagcaccauccccaccaagcagacccagaucuucaccaccuacagcgacaaccagcccggcgugcugauccagguguacgagggcgagagagccaugaccaaggacaacaaccugcugggcagauucgaccugaccggcaucccccccgcccccagaggcgugccccagaucgaggugaccuucgacaucgacgccaacggcauccugaacgugaccgccaccgacaagagcaccggcaaggugaacaagaucaccaucaccaacgacaagggcagacugagcaaggaggagaucgagagaauggugcuggacgccgagaaguacaaggccgaggacgaggugcagagagagaagaucgccgccaagaacgcccuggagagcuacgccuucaacaugaagagcguggugagcgacgagggccugaagggcaagaucagcgagagcgacaagaacaagauccuggacaagugcaacgagcugcugagcuggcuggaggugaaccagcuggccgagaaggacgaguucgaccacaagagaaaggagcuggagcagaugugcaaccccaucaucaccaagcuguaccagggcggcugcaccggccccgccugcggcaccggcuacgugcccggcagacccgccaccggccccaccaucgaggagguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1805 - RNA, 2137 nt, Artificial Sequence
  mRNA product Design1 comprising derived and/or modified sequence from Homo sapiens__NP_068814.2 __HsHSPA2 (opt4)
gggagaaagcuuaccaugagcgccagaggccccgccaucggcaucgaccugggcaccaccuacagcugcgugggcguguuccagcacggcaagguggagaucaucgccaacgaccagggcaacagaaccacccccagcuacguggccuucaccgacaccgagagacugaucggcgacgccgccaagaaccagguggccaugaaccccaccaacaccaucuucgacgccaagagacugaucggcagaaaguucgaggacgccaccgugcagagcgacaugaagcacuggcccuucagaguggugagcgagggcggcaagcccaaggugcagguggaguacaagggcgagaccaagaccuucuuccccgaggagaucagcagcauggugcugaccaagaugaaggagaucgccgaggccuaccugggcggcaaggugcacagcgccgugaucaccgugcccgccuacuucaacgacagccagagacaggccaccaaggacgccggcaccaucaccggccugaacgugcugagaaucaucaacgagcccaccgccgccgccaucgccuacggccuggacaagaagggcugcgccggcggcgagaagaacgugcugaucuucgaccugggcggcggcaccuucgacgugagcauccugaccaucgaggacggcaucuucgaggugaagagcaccgccggcgacacccaccugggcggcgaggacuucgacaacagaauggugagccaccuggccgaggaguucaagagaaagcacaagaaggacaucggccccaacaagagagccgugagaagacugagaaccgccugcgagagagccaagagaacccugagcagcagcacccaggccagcaucgagaucgacagccuguacgagggcguggacuucuacaccagcaucaccagagccagauucgaggagcugaacgccgaccuguucagaggcacccuggagcccguggagaaggcccugagagacgccaagcuggacaagggccagauccaggagaucgugcuggugggcggcagcaccagaauccccaagauccagaagcugcugcaggacuucuucaacggcaaggagcugaacaagagcaucaaccccgacgaggccguggccuacggcgccgccgugcaggccgccauccugaucggcgacaagagcgagaacgugcaggaccugcugcugcuggacgugaccccccugagccugggcaucgagaccgccggcggcgugaugaccccccugaucaagagaaacaccaccauccccaccaagcagacccagaccuucaccaccuacagcgacaaccagagcagcgugcuggugcagguguacgagggcgagagagccaugaccaaggacaacaaccugcugggcaaguucgaccugaccggcaucccccccgcccccagaggcgugccccagaucgaggugaccuucgacaucgacgccaacggcauccugaacgugaccgccgccgacaagagcaccggcaaggagaacaagaucaccaucaccaacgacaagggcagacugagcaaggacgacaucgacagaauggugcaggaggccgagagauacaagagcgaggacgaggccaacagagacagaguggccgccaagaacgcccuggagagcuacaccuacaacaucaagcagaccguggaggacgagaagcugagaggcaagaucagcgagcaggacaagaacaagauccuggacaagugccaggaggugaucaacuggcuggacagaaaccagauggccgagaaggacgaguacgagcacaagcagaaggagcuggagagagugugcaaccccaucaucagcaagcuguaccagggcggccccggcggcggcagcggcggcggcggcagcggcgccagcggcggccccaccaucgaggagguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1806 - RNA, 2740 nt, Artificial Sequence
  mRNA product Design1 comprising derived and/or modified sequence from Homo sapiens__NP_002145.3 __HsHSPA4 (opt4)
gggagaaagcuuaccaugagcguggugggcaucgaccugggcuuccagagcugcuacguggccguggccagagccggcggcaucgagaccaucgccaacgaguacagcgacagaugcacccccgccugcaucagcuucggccccaagaacagaagcaucggcgccgccgccaagagccaggugaucagcaacgccaagaacaccgugcagggcuucaagagauuccacggcagagccuucagcgaccccuucguggaggccgagaagagcaaccuggccuacgacaucgugcagcugcccaccggccugaccggcaucaaggugaccuacauggaggaggagagaaacuucaccaccgagcaggugaccgccaugcugcugagcaagcugaaggagaccgccgagagcgugcugaagaagcccgugguggacugcguggugagcgugcccugcuucuacaccgacgccgagagaagaagcgugauggacgccacccagaucgccggccugaacugccugagacugaugaacgagaccaccgccguggcccuggccuacggcaucuacaagcaggaccugcccgcccuggaggagaagcccagaaacgugguguucguggacaugggccacagcgccuaccaggugagcgugugcgccuucaacagaggcaagcugaaggugcuggccaccgccuucgacaccacccugggcggcagaaaguucgacgaggugcuggugaaccacuucugcgaggaguucggcaagaaguacaagcuggacaucaagagcaagaucagagcccugcugagacugagccaggagugcgagaagcugaagaagcugaugagcgccaacgccagcgaccugccccugagcaucgagugcuucaugaacgacguggacgugagcggcaccaugaacagaggcaaguuccuggagaugugcaacgaccugcuggccagaguggagcccccccugagaagcgugcuggagcagaccaagcugaagaaggaggacaucuacgccguggagaucgugggcggcgccaccagaauccccgccgugaaggagaagaucagcaaguucuucggcaaggagcugagcaccacccugaacgccgacgaggccgugaccagaggcugcgcccugcagugcgccauccugagccccgccuucaaggugagagaguucagcaucaccgacguggugcccuaccccaucagccugagauggaacagccccgccgaggagggcagcagcgacugcgagguguucagcaagaaccacgccgcccccuucagcaaggugcugaccuucuacagaaaggagcccuucacccuggaggccuacuacagcagcccccaggaccugcccuaccccgaccccgccaucgcccaguucagcgugcagaaggugaccccccagagcgacggcagcagcagcaaggugaaggugaaggugagagugaacgugcacggcaucuucagcgugagcagcgccagccugguggaggugcacaagagcgaggagaacgaggagcccauggagaccgaccagaacgccaaggaggaggagaagaugcagguggaccaggaggagccccacguggaggagcagcagcagcagacccccgccgagaacaaggccgagagcgaggagauggagaccagccaggccggcagcaaggacaagaagauggaccagcccccccaggccaagaaggccaaggugaagaccagcaccguggaccugcccaucgagaaccagcugcuguggcagaucgacagagagaugcugaaccuguacaucgagaacgagggcaagaugaucaugcaggacaagcuggagaaggagagaaacgacgccaagaacgccguggaggaguacguguacgagaugagagacaagcugagcggcgaguacgagaaguucgugagcgaggacgacagaaacagcuucacccugaagcuggaggacaccgagaacuggcuguacgaggacggcgaggaccagcccaagcagguguacguggacaagcuggccgagcugaagaaccugggccagcccaucaagaucagauuccaggagagcgaggagagacccaagcuguucgaggagcugggcaagcagauccagcaguacaugaagaucaucagcagcuucaagaacaaggaggaccaguacgaccaccuggacgccgccgacaugaccaagguggagaagagcaccaacgaggccauggaguggaugaacaacaagcugaaccugcagaacaagcagagccugaccauggaccccguggugaagagcaaggagaucgaggccaagaucaaggagcugaccagcaccugcagccccaucaucagcaagcccaagcccaagguggagccccccaaggaggagcagaagaacgccgagcagaacggccccguggacggccagggcgacaaccccggcccccaggccgccgagcagggcaccgacaccgccgugcccagcgacagcgacaagaagcugcccgagauggacaucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1807 - RNA, 2737 nt, Artificial Sequence
  mRNA product Design1 comprising derived and/or modified sequence from Homo sapiens__NP_055093.2 __HsHSPA4L (opt4)
gggagaaagcuuaccaugagcguggugggcaucgaccugggcuuccugaacugcuacaucgccguggccagaagcggcggcaucgagaccaucgccaacgaguacagcgacagaugcacccccgccugcaucagccugggcagcagaaccagagccaucggcaacgccgccaagagccagaucgugaccaacgugagaaacaccauccacggcuucaagaagcugcacggcagaagcuucgacgaccccaucgugcagaccgagagaaucagacugcccuacgagcugcagaagaugcccaacggcagcgccggcgugaaggugagauaccuggaggaggagagacccuucgccaucgagcaggugaccggcaugcugcuggccaagcugaaggagaccagcgagaacgcccugaagaagcccguggccgacugcgugaucagcauccccagcuucuucaccgacgccgagagaagaagcgugauggccgccgcccagguggccggccugaacugccugagacugaugaacgagaccaccgccguggcccuggccuacggcaucuacaagcaggaccugcccccccuggacgagaagcccagaaacgugguguucaucgacaugggccacagcgccuaccaggugcuggugugcgccuucaacaagggcaagcugaaggugcuggccaccaccuucgaccccuaccugggcggcagaaacuucgacgaggcccugguggacuacuucugcgacgaguucaagaccaaguacaagaucaacgugaaggagaacagcagagcccugcugagacuguaccaggagugcgagaagcugaagaagcugaugagcgccaacgccagcgaccugccccugaacaucgagugcuucaugaacgaccuggacgugagcagcaagaugaacagagcccaguucgagcagcugugcgccagccugcuggccagaguggagcccccccugaaggccgugauggagcaggccaaccugcagagagaggacaucagcagcaucgagaucgugggcggcgccaccagaauccccgccgugaaggagcagaucaccaaguucuuccugaaggacaucagcaccacccugaacgccgacgaggccguggccagaggcugcgcccugcagugcgccauccugagccccgccuucaaggugagagaguucagcaucaccgaccuggugcccuacagcaucacccugagauggaagaccagcuucgaggacggcagcggcgagugcgagguguucugcaagaaccaccccgcccccuucagcaaggugaucaccuuccacaagaaggagcccuucgagcuggaggccuucuacaccaaccugcacgaggugcccuaccccgacgccagaaucggcagcuucaccauccagaacguguucccccagagcgacggcgacagcagcaaggugaaggugaaggugagagugaacauccacggcaucuucagcguggccagcgccagcgugaucgagaagcagaaccuggagggcgaccacagcgacgcccccauggagaccgagaccagcuucaagaacgagaacaaggacaacauggacaagaugcagguggaccaggaggagggccaccagaagugccacgccgagcacacccccgaggaggagaucgaccacaccggcgccaagaccaagagcgccgugagcgacaagcaggacagacugaaccagacccugaagaagggcaaggugaagagcaucgaccugcccauccagagcagccugugcagacagcugggccaggaccugcugaacagcuacaucgagaacgagggcaagaugaucaugcaggacaagcuggagaaggagagaaacgacgccaagaacgccguggaggaguacguguacgacuucagagacagacugggcaccguguacgagaaguucaucacccccgaggaccugagcaagcugagcgccgugcuggaggacaccgagaacuggcuguacgaggacggcgaggaccagcccaagcagguguacguggacaagcugcaggagcugaagaaguacggccagcccauccagaugaaguacauggagcacgaggagagacccaaggcccugaacgaccugggcaagaagauccagcuggugaugaaggugaucgaggccuacagaaacaaggacgagagauacgaccaccuggaccccaccgagauggagaagguggagaagugcaucagcgacgccaugagcuggcugaacagcaagaugaacgcccagaacaagcugagccugacccaggaccccguggugaaggugagcgagaucguggccaagagcaaggagcuggacaacuucugcaaccccaucaucuacaagcccaagcccaaggccgaggugcccgaggacaagcccaaggccaacagcgagcacaacggccccauggacggccagagcggcaccgagaccaagagcgacagcaccaaggacagcagccagcacaccaagagcagcggcgagauggagguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1808 - RNA, 2182 nt, Artificial Sequence
  mRNA product Design1 comprising derived and/or modified sequence from Homo sapiens__NP_005338.1__HsHSPA5 (opt4)
gggagaaagcuuaccaugaagcugagccugguggccgccaugcugcugcugcugagcgccgccagagccgaggaggaggacaagaaggaggacgugggcaccguggugggcaucgaccugggcaccaccuacagcugcgugggcguguucaagaacggcagaguggagaucaucgccaacgaccagggcaacagaaucacccccagcuacguggccuucacccccgagggcgagagacugaucggcgacgccgccaagaaccagcugaccagcaaccccgagaacaccguguucgacgccaagagacugaucggcagaaccuggaacgaccccagcgugcagcaggacaucaaguuccugcccuucaaggugguggagaagaagaccaagcccuacauccagguggacaucggcggcggccagaccaagaccuucgcccccgaggagaucagcgccauggugcugaccaagaugaaggagaccgccgaggccuaccugggcaagaaggugacccacgccguggugaccgugcccgccuacuucaacgacgcccagagacaggccaccaaggacgccggcaccaucgccggccugaacgugaugagaaucaucaacgagcccaccgccgccgccaucgccuacggccuggacaagagagagggcgagaagaacauccugguguucgaccugggcggcggcaccuucgacgugagccugcugaccaucgacaacggcguguucgaggugguggccaccaacggcgacacccaccugggcggcgaggacuucgaccagagagugauggagcacuucaucaagcuguacaagaagaagaccggcaaggacgugagaaaggacaacagagccgugcagaagcugagaagagagguggagaaggccaagagagcccugagcagccagcaccaggccagaaucgagaucgagagcuucuacgagggcgaggacuucagcgagacccugaccagagccaaguucgaggagcugaacauggaccuguucagaagcaccaugaagcccgugcagaaggugcuggaggacagcgaccugaagaagagcgacaucgacgagaucgugcuggugggcggcagcaccagaauccccaagauccagcagcuggugaaggaguucuucaacggcaaggagcccagcagaggcaucaaccccgacgaggccguggccuacggcgccgccgugcaggccggcgugcugagcggcgaccaggacaccggcgaccuggugcugcuggacgugugcccccugacccugggcaucgagaccgugggcggcgugaugaccaagcugauccccagaaacaccguggugcccaccaagaagagccagaucuucagcaccgccagcgacaaccagcccaccgugaccaucaagguguacgagggcgagagaccccugaccaaggacaaccaccugcugggcaccuucgaccugaccggcaucccccccgcccccagaggcgugccccagaucgaggugaccuucgagaucgacgugaacggcauccugagagugaccgccgaggacaagggcaccggcaacaagaacaagaucaccaucaccaacgaccagaacagacugacccccgaggagaucgagagaauggugaacgacgccgagaaguucgccgaggaggacaagaagcugaaggagagaaucgacaccagaaacgagcuggagagcuacgccuacagccugaagaaccagaucggcgacaaggagaagcugggcggcaagcugagcagcgaggacaaggagaccauggagaaggccguggaggagaagaucgaguggcuggagagccaccaggacgccgacaucgaggacuucaaggccaagaagaaggagcuggaggagaucgugcagcccaucaucagcaagcuguacggcagcgccggccccccccccaccggcgaggaggacaccgccgagaaggacgagcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1809 - RNA, 2149 nt, Artificial Sequence
  mRNA product Design1 comprising derived and/or modified sequence from Homo sapiens__NP_002146.2__HsHSPA6 (opt4)
gggagaaagcuuaccaugcaggcccccagagagcuggccgugggcaucgaccugggcaccaccuacagcugcgugggcguguuccagcagggcagaguggagauccuggccaacgaccagggcaacagaaccacccccagcuacguggccuucaccgacaccgagagacuggugggcgacgccgccaagagccaggccgcccugaacccccacaacaccguguucgacgccaagagacugaucggcagaaaguucgccgacaccaccgugcagagcgacaugaagcacuggcccuucagaguggugagcgagggcggcaagcccaaggugagagugugcuacagaggcgaggacaagaccuucuaccccgaggagaucagcagcauggugcugagcaagaugaaggagaccgccgaggccuaccugggccagcccgugaagcacgccgugaucaccgugcccgccuacuucaacgacagccagagacaggccaccaaggacgccggcgccaucgccggccugaacgugcugagaaucaucaacgagcccaccgccgccgccaucgccuacggccuggacagaagaggcgccggcgagagaaacgugcugaucuucgaccugggcggcggcaccuucgacgugagcgugcugagcaucgacgccggcguguucgaggugaaggccaccgccggcgacacccaccugggcggcgaggacuucgacaacagacuggugaaccacuucauggaggaguucagaagaaagcacggcaaggaccugagcggcaacaagagagcccugagaagacugagaaccgccugcgagagagccaagagaacccugagcagcagcacccaggccacccuggagaucgacagccuguucgagggcguggacuucuacaccagcaucaccagagccagauucgaggagcugugcagcgaccuguucagaagcacccuggagcccguggagaaggcccugagagacgccaagcuggacaaggcccagauccacgacguggugcuggugggcggcagcaccagaauccccaaggugcagaagcugcugcaggacuucuucaacggcaaggagcugaacaagagcaucaaccccgacgaggccguggccuacggcgccgccgugcaggccgccgugcugaugggcgacaagugcgagaaggugcaggaccugcugcugcuggacguggccccccugagccugggccuggagaccgccggcggcgugaugaccacccugauccagagaaacgccaccauccccaccaagcagacccagaccuucaccaccuacagcgacaaccagcccggcguguucauccagguguacgagggcgagagagccaugaccaaggacaacaaccugcugggcagauucgagcugagcggcaucccccccgcccccagaggcgugccccagaucgaggugaccuucgacaucgacgccaacggcauccugagcgugaccgccaccgacagaagcaccggcaaggccaacaagaucaccaucaccaacgacaagggcagacugagcaaggaggagguggagagaauggugcacgaggccgagcaguacaaggccgaggacgaggcccagagagacagaguggccgccaagaacagccuggaggcccacguguuccacgugaagggcagccugcaggaggagagccugagagacaagauccccgaggaggacagaagaaagaugcaggacaagugcagagaggugcuggccuggcuggagcacaaccagcuggccgagaaggaggaguacgagcaccagaagagagagcuggagcagaucugcagacccaucuucagcagacuguacggcggccccggcgugcccggcggcagcagcugcggcacccaggccagacagggcgaccccagcaccggccccaucaucgaggagguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1810 - RNA, 1321 nt, Artificial Sequence
  mRNA product Design1 comprising derived and/or modified sequence from Homo sapiens__P48741__HsHSPA7 (opt4)
gggagaaagcuuaccaugcaggcccccagagagcuggccgugggcaucgaccugggcaccaccuacagcugcgugggcguguuccagcagggcagaguggagauccuggccaacgaccagggcaacagaaccacccccagcuacguggccuucaccgacaccgagagacuggugggcgacgccgccaagagccaggccgcccugaacccccacaacaccguguucgacgccaagagacugaucggcagaaaguucgccgacaccaccgugcagagcgacaugaagcacuggcccuuccagguggugagcgagggcggcaagcccaaggugagagugugcuacagaggcgaggacaagaccuucuaccccgaggagaucagcagcauggugcugagcaagaugaaggagaccgccgaggccuaccugggccagcccgugaagcacgccgugaucaccgugcccaccuacuucagcaacagccagagacaggccaccaaggacgccggcgccaucgccggccugaaggugcugcccaucaucaacgaggccaccgccgccgccaucgccuacggccuggacagaagaggcgccggcaagagaaacgugcugaucuucgaccugggcggcggcaccuucgacgugagcgugcugagcaucgacgccggcguguucgaggugaaggccaccgccggcgacacccaccugggcggcgaggacuucgacaacagacuggugaaccacuucauggaggaguucagaagaaagcacggcaaggaccugagcggcaacaagagagcccugagaagacugagaaccgccugcgagagagccaagagaacccccagcagcagcacccaggccacccuggagaucgacagccuguucgagggcguggacuucuacaagagcaucaccagagccagauucgaggagcugugcagcgaccuguucagaagcacccuggagcccguggagaaggcccugagagacgccaagcuggacaaggcccagauccacgacuucgugcugggcggcggccugcacagccacccccagggcgccgagguggccgccggccugcugcagagacagggcgccgagcaggagcaccagcccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1811 - RNA, 2158 nt, Artificial Sequence
  mRNA product Design1 comprising derived and/or modified sequence from Homo sapiens__NP_006588.1 __HsHSPA8 (opt4)
gggagaaagcuuaccaugagcaagggccccgccgugggcaucgaccugggcaccaccuacagcugcgugggcguguuccagcacggcaagguggagaucaucgccaacgaccagggcaacagaaccacccccagcuacguggccuucaccgacaccgagagacugaucggcgacgccgccaagaaccagguggccaugaaccccaccaacaccguguucgacgccaagagacugaucggcagaagauucgacgacgccguggugcagagcgacaugaagcacuggcccuucaugguggugaacgacgccggcagacccaaggugcagguggaguacaagggcgagaccaagagcuucuaccccgaggaggugagcagcauggugcugaccaagaugaaggagaucgccgaggccuaccugggcaagaccgugaccaacgccguggugaccgugcccgccuacuucaacgacagccagagacaggccaccaaggacgccggcaccaucgccggccugaacgugcugagaaucaucaacgagcccaccgccgccgccaucgccuacggccuggacaagaaggugggcgccgagagaaacgugcugaucuucgaccugggcggcggcaccuucgacgugagcauccugaccaucgaggacggcaucuucgaggugaagagcaccgccggcgacacccaccugggcggcgaggacuucgacaacagaauggugaaccacuucaucgccgaguucaagagaaagcacaagaaggacaucagcgagaacaagagagccgugagaagacugagaaccgccugcgagagagccaagagaacccugagcagcagcacccaggccagcaucgagaucgacagccuguacgagggcaucgacuucuacaccagcaucaccagagccagauucgaggagcugaacgccgaccuguucagaggcacccuggaccccguggagaaggcccugagagacgccaagcuggacaagagccagauccacgacaucgugcuggugggcggcagcaccagaauccccaagauccagaagcugcugcaggacuucuucaacggcaaggagcugaacaagagcaucaaccccgacgaggccguggccuacggcgccgccgugcaggccgccauccugagcggcgacaagagcgagaacgugcaggaccugcugcugcuggacgugaccccccugagccugggcaucgagaccgccggcggcgugaugaccgugcugaucaagagaaacaccaccauccccaccaagcagacccagaccuucaccaccuacagcgacaaccagcccggcgugcugauccagguguacgagggcgagagagccaugaccaaggacaacaaccugcugggcaaguucgagcugaccggcaucccccccgcccccagaggcgugccccagaucgaggugaccuucgacaucgacgccaacggcauccugaacgugagcgccguggacaagagcaccggcaaggagaacaagaucaccaucaccaacgacaagggcagacugagcaaggaggacaucgagagaauggugcaggaggccgagaaguacaaggccgaggacgagaagcagagagacaaggugagcagcaagaacagccuggagagcuacgccuucaacaugaaggccaccguggaggacgagaagcugcagggcaagaucaacgacgaggacaagcagaagauccuggacaagugcaacgagaucaucaacuggcuggacaagaaccagaccgccgagaaggaggaguucgagcaccagcagaaggagcuggagaaggugugcaaccccaucaucaccaagcuguaccagagcgccggcggcaugcccggcggcaugcccggcggcuuccccggcggcggcgccccccccagcggcggcgccagcagcggccccaccaucgaggagguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1812 - RNA, 2257 nt, Artificial Sequence
  mRNA product Design1 comprising derived and/or modified sequence from Homo sapiens__NP_004125.3 __HsHSPA9 (opt4)
gggagaaagcuuaccaugaucagcgccagcagagccgccgccgccagacuggugggcgccgccgccagcagaggccccaccgccgccagacaccaggacagcuggaacggccugagccacgaggccuucagacuggugagcagaagagacuacgccagcgaggccaucaagggcgccguggugggcaucgaccugggcaccaccaacagcugcguggccgugauggagggcaagcaggccaaggugcuggagaacgccgagggcgccagaaccacccccagcgugguggccuucaccgccgacggcgagagacuggugggcaugcccgccaagagacaggccgugaccaaccccaacaacaccuucuacgccaccaagagacugaucggcagaagauacgacgaccccgaggugcagaaggacaucaagaacgugcccuucaagaucgugagagccagcaacggcgacgccuggguggaggcccacggcaagcuguacagccccagccagaucggcgccuucgugcugaugaagaugaaggagaccgccgagaacuaccugggccacaccgccaagaacgccgugaucaccgugcccgccuacuucaacgacagccagagacaggccaccaaggacgccggccagaucagcggccugaacgugcugagagugaucaacgagcccaccgccgccgcccuggccuacggccuggacaagagcgaggacaaggugaucgccguguacgaccugggcggcggcaccuucgacaucagcauccuggagauccagaagggcguguucgaggugaagagcaccaacggcgacaccuuccugggcggcgaggacuucgaccaggcccugcugagacacaucgugaaggaguucaagagagagaccggcguggaccugaccaaggacaacauggcccugcagagagugagagaggccgccgagaaggccaagugcgagcugagcagcagcgugcagaccgacaucaaccugcccuaccugaccauggacagcagcggccccaagcaccugaacaugaagcugaccagagcccaguucgagggcaucgugaccgaccugaucagaagaaccaucgcccccugccagaaggccaugcaggacgccgaggugagcaagagcgacaucggcgaggugauccuggugggcggcaugaccagaaugcccaaggugcagcagaccgugcaggaccuguucggcagagcccccagcaaggccgugaaccccgacgaggccguggccaucggcgccgccauccagggcggcgugcuggccggcgacgugaccgacgugcugcugcuggacgugaccccccugagccugggcaucgagacccugggcggcguguucaccaagcugaucaacagaaacaccaccauccccaccaagaagagccagguguucagcaccgccgccgacggccagacccagguggagaucaaggugugccagggcgagagagagauggccggcgacaacaagcugcugggccaguucacccugaucggcaucccccccgcccccagaggcgugccccagaucgaggugaccuucgacaucgacgccaacggcaucgugcacgugagcgccaaggacaagggcaccggcagagagcagcagaucgugauccagagcagcggcggccugagcaaggacgacaucgagaacauggugaagaacgccgagaaguacgccgaggaggacagaagaaagaaggagagaguggaggccgugaacauggccgagggcaucauccacgacaccgagaccaagauggaggaguucaaggaccagcugcccgccgacgagugcaacaagcugaaggaggagaucagcaagaugagagagcugcuggccagaaaggacagcgagaccggcgagaacaucagacaggccgccagcagccugcagcaggccagccugaagcuguucgagauggccuacaagaagauggccagcgagagagagggcagcggcagcagcggcaccggcgagcagaaggaggaccagaaggaggagaagcagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1813 - RNA, 2245 nt, Artificial Sequence
  mRNA product Design1 comprising derived and/or modified sequence from Homo sapiens__NP_079291.2__HsHSPA12A (opt4)
gggagaaagcuuaccauggccgacaaggaggccggcggcagcgacggccccagagagaccgcccccaccagcgccuacagcagccccgccagaagccugggcgacaccggcaucaccccccugagccccagccacaucgugaacgacaccgacagcaacgugagcgagcagcagagcuuccugguggugguggccguggacuucggcaccaccagcagcggcuacgccuacagcuucaccaaggagcccgagugcauccacgugaugagaagaugggagggcggcgaccccggcgugagcaaccagaagacccccaccaccauccugcugacccccgagagaaaguuccacagcuucggcuacgccgccagagacuucuaccacgaccuggaccccaacgaggccaagcaguggcuguaccuggagaaguucaagaugaagcugcacaccaccggcgaccugaccauggacaccgaccugaccgccgccaacggcaagaaggugaaggcccuggagaucuucgccuacgcccugcaguacuucaaggagcaggcccugaaggagcugagcgaccaggccggcagcgaguucgagaacagcgacgugagaugggugaucaccgugcccgccaucuggaagcagcccgccaagcaguucaugagacaggccgccuaccaggccggccuggccagccccgagaacagcgagcagcugaucaucgcccuggagcccgaggccgccagcaucuacugcagaaagcugagacugcaccagaugaucgagcugagcagcaaggccgccgugaacggcuacagcggcagcgacaccgugggcgccggcuucacccaggccaaggagcacaucagaagaaacagacagagcagaaccuuccugguggagaacgugaucggcgagaucuggagcgagcuggaggagggcgacaaguacguggugguggacagcggcggcggcaccguggaccugaccgugcaccagaucagacugcccgagggccaccugaaggagcuguacaaggccaccggcggccccuacggcagccugggcguggacuacgaguucgagaagcugcuguacaagaucuucggcgaggacuucaucgagcaguucaagaucaagagacccgccgccuggguggaccugaugaucgccuucgagagcagaaagagagccgccgcccccgacagaaccaacccccugaacaucacccugcccuucagcuucaucgacuacuacaagaaguucagaggccacagcguggagcacgcccugagaaagagcaacguggacuucgugaaguggagcagccagggcaugcugagaaugagccccgacgccaugaacgcccuguucaagcccaccaucgacagcaucaucgagcaccugagagaccuguuccagaagcccgaggugagcaccgugaaguuccuguuccuggugggcggcuucgccgaggccccccugcugcagcaggccgugcaggccgccuucggcgaccagugcagaaucaucaucccccaggacgugggccugaccauccugaagggcgccgugcuguucggccuggaccccgccgugaucaaggugagaagaagcccccugaccuacggcgugggcgugcugaacagauacguggagggcaagcacccccccgagaagcugcuggugaaggacggcaccagauggugcaccgacguguucgacaaguucaucagcgccgaccagagcguggcccugggcgagcuggugaagagaagcuacacccccgccaagcccagccagcuggugaucgugaucaacaucuacagcagcgagcacgacaacgugagcuucaucaccgaccccggcgugaagaagugcggcacccugagacuggaccugaccggcaccagcggcaccgccgugcccgccagaagagagauccagacccugaugcaguucggcgacaccgagaucaaggccaccgccaucgacaucgccaccagcaagagcgugaaggugggcaucgacuuccugaacuacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1814 - RNA, 2278 nt, Artificial Sequence
  mRNA product Design1 comprising derived and/or modified sequence from Homo sapiens__NP_443202.3 __HsHSPA12B (opt4)
gggagaaagcuuaccaugcuggccgugcccgagaugggccugcagggccuguacaucggcagcagccccgagagaagccccgugcccagcccccccggcagccccagaacccaggagagcugcggcaucgccccccugacccccagccagagccccaagcccgaggugagagccccccagcaggccagcuucagcguggugguggccaucgacuucggcaccaccagcagcggcuacgccuucagcuucgccagcgaccccgaggccauccacaugaugagaaagugggagggcggcgaccccggcguggcccaccagaagacccccaccugccugcugcugacccccgagggcgccuuccacagcuucggcuacaccgccagagacuacuaccacgaccuggaccccgaggaggccagagacuggcuguacuucgagaaguucaagaugaagauccacagcgccaccgaccugacccugaagacccagcuggaggccgugaacggcaagaccaugcccgcccuggagguguucgcccacgcccugagauucuucagagagcacgcccugcaggagcugagagagcagagccccagccugcccgagaaggacaccgugagaugggugcugaccgugcccgccaucuggaagcagcccgccaagcaguucaugagagaggccgccuaccuggccggccuggugagcagagagaacgccgagcagcugcugaucgcccuggagcccgaggccgccagcguguacugcagaaagcugagacugcaccagcugcuggaccugagcggcagagcccccggcggcggcagacugggcgagagaagaagcaucgacagcagcuucagacaggccagagagcagcugagaagaagcagacacagcagaaccuuccugguggagagcggcgugggcgagcugugggccgagaugcaggccggcgacagauacgugguggccgacugcggcggcggcaccguggaccugaccgugcaccagcuggagcagccccacggcacccugaaggagcuguacaaggccagcggcggccccuacggcgccgugggcguggaccuggccuucgagcagcugcugugcagaaucuucggcgaggacuucaucgccaccuucaagagacagagacccgccgccuggguggaccugaccaucgccuucgaggccagaaagagaaccgccggcccccacagagccggcgcccugaacaucagccugcccuucagcuucaucgacuucuacagaaagcagagaggccacaacguggagaccgcccugagaagaagcagcgugaacuucgugaaguggagcagccagggcaugcugagaaugagcugcgaggccaugaacgagcuguuccagcccaccgugagcggcaucauccagcacaucgaggcccugcuggccagacccgaggugcagggcgugaagcugcuguuccuggugggcggcuucgccgagagcgccgugcugcagcacgccgugcaggccgcccugggcgccagaggccugagagugguggugccccacgacgugggccugaccauccugaagggcgccgugcuguucggccaggcccccggcguggugagagugagaagaagcccccugaccuacggcgugggcgugcugaacagauucgugcccggcagacacccccccgagaagcugcuggugagagacggcagaagauggugcaccgacguguucgagagauucguggccgccgagcagagcguggcccugggcgaggaggugagaagaagcuacugccccgccagacccggccagagaagagugcugaucaaccuguacugcugcgccgccgaggacgccagauucaucaccgaccccggcgugagaaagugcggcgcccugagccuggagcuggagcccgccgacugcggccaggacaccgccggcgccccccccggcagaagagagaucagagccgccaugcaguucggcgacaccgagaucaaggugaccgccguggacgugagcaccaacagaagcgugagagccagcaucgacuuccugagcaacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1815 - RNA, 1633 nt, Artificial Sequence
  mRNA product Design1 comprising derived and/or modified sequence from Homo sapiens__NP_008879.3__HsHSPA13 (opt4)
gggagaaagcuuaccauggccagagagaugaccauccugggcagcgccgugcugacccugcugcuggccggcuaccuggcccagcaguaccugccccugcccacccccaaggugaucggcaucgaccugggcaccaccuacugcagcgugggcguguucuuccccggcaccggcaaggugaaggugauccccgacgagaacggccacaucagcauccccagcauggugagcuucaccgacaacgacguguacgugggcuacgagagcguggagcuggccgacagcaacccccagaacaccaucuacgacgccaagagauucaucggcaagaucuucaccgccgaggagcuggaggccgagaucggcagauaccccuucaaggugcugaacaagaacggcaugguggaguucagcgugaccagcaacgagaccaucaccgugagccccgaguacgugggcagcagacugcugcugaagcugaaggagauggccgaggccuaccugggcaugcccguggccaacgccgugaucagcgugcccgccgaguucgaccugaagcagagaaacagcaccaucgaggccgccaaccuggccggccugaagauccugagagugaucaacgagcccaccgccgccgccauggccuacggccugcacaaggccgacguguuccacgugcuggugaucgaccugggcggcggcacccuggacgugagccugcugaacaagcagggcggcauguuccugaccagagccaugagcggcaacaacaagcugggcggccaggacuucaaccagagacugcugcaguaccuguacaagcagaucuaccagaccuacggcuucgugcccagcagaaaggaggagauccacagacugagacaggccguggagauggugaagcugaaccugacccugcaccagagcgcccagcugagcgugcugcugaccguggaggagcaggacagaaaggagccccacagcagcgacaccgagcugcccaaggacaagcugagcagcgccgacgaccacagagugaacagcggcuucggcagaggccugagcgacaagaagagcggcgagagccaggugcuguucgagaccgagaucagcagaaagcuguucgacacccugaacgaggaccuguuccagaagauccuggugcccauccagcaggugcugaaggagggccaccuggagaagaccgagaucgacgagguggugcuggugggcggcagcaccagaauccccagaaucagacaggugauccaggaguucuucggcaaggaccccaacaccagcguggaccccgaccuggccguggugaccggcguggccauccaggccggcaucgacggcggcagcuggccccugcaggugagcgcccuggagauccccaacaagcaccugcagaagaccaacuucaacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1816 - RNA, 1747 nt, Artificial Sequence
  mRNA product Design1 comprising derived and/or modified sequence from Homo sapiens__NP_057383.2__HsHSPA14 (opt4)
gggagaaagcuuaccauggccgccaucggcgugcaccugggcugcaccagcgccugcguggccguguacaaggacggcagagccggcgugguggccaacgacgccggcgacagagugacccccgccgugguggccuacagcgagaacgaggagaucgugggccuggccgccaagcagagcagaaucagaaacaucagcaacaccgugaugaaggugaagcagauccugggcagaagcagcagcgacccccaggcccagaaguacaucgccgagagcaagugccuggugaucgagaagaacggcaagcugagauacgagaucgacaccggcgaggagaccaaguucgugaaccccgaggacguggccagacugaucuucagcaagaugaaggagaccgcccacagcgugcugggcagcgacgccaacgacguggugaucaccgugcccuucgacuucggcgagaagcagaagaacgcccugggcgaggccgccagagccgccggcuucaacgugcugagacugauccacgagcccagcgccgcccugcuggccuacggcaucggccaggacagccccaccggcaagagcaacauccugguguucaagcugggcggcaccagccugagccugagcgugauggaggugaacagcggcaucuacagagugcugagcaccaacaccgacgacaacaucggcggcgcccacuucaccgagacccuggcccaguaccuggccagcgaguuccagagaagcuucaagcacgacgugagaggcaacgccagagccaugaugaagcugaccaacagcgccgagguggccaagcacagccugagcacccugggcagcgccaacugcuuccuggacagccuguacgagggccaggacuucgacugcaacgugagcagagccagauucgagcugcugugcagcccccuguucaacaagugcaucgaggccaucagaggccugcuggaccagaacggcuucaccgccgacgacaucaacaagguggugcugugcggcggcagcagcagaauccccaagcugcagcagcugaucaaggaccuguuccccgccguggagcugcugaacagcaucccccccgacgaggugauccccaucggcgccgccaucgaggccggcauccugaucggcaaggagaaccugcugguggaggacagccugaugaucgagugcagcgccagagacauccuggugaagggcguggacgagagcggcgccagcagauucaccgugcuguuccccagcggcaccccccugcccgccagaagacagcacacccugcaggcccccggcagcaucagcagcgugugccuggagcuguacgagagcgacggcaagaacagcgccaaggaggagaccaaguucgcccagguggugcugcaggaccuggacaagaaggagaacggccugagagacauccuggccgugcugaccaugaagagagacggcagccugcacgugaccugcaccgaccaggagaccggcaagugcgaggccaucagcaucgagaucgccagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1817 - RNA, 2794 nt, Artificial Sequence
  mRNA product Design1 comprising derived and/or modified sequence from Homo sapiens__NP_006635.2 __HsHSPH1 (opt4)
gggagaaagcuuaccaugagcguggugggccuggacgugggcagccagagcugcuacaucgccguggccagagccggcggcaucgagaccaucgccaacgaguucagcgacagaugcacccccagcgugaucagcuucggcagcaagaacagaaccaucggcguggccgccaagaaccagcagaucacccacgccaacaacaccgugagcaacuucaagagauuccacggcagagccuucaacgaccccuucauccagaaggagaaggagaaccugagcuacgaccuggugccccugaagaacggcggcgugggcaucaaggugauguacaugggcgaggagcaccuguucagcguggagcagaucaccgccaugcugcugaccaagcugaaggagaccgccgagaacagccugaagaagcccgugaccgacugcgugaucagcgugcccagcuucuucaccgacgccgagagaagaagcgugcuggacgccgcccagaucgugggccugaacugccugagacugaugaacgacaugaccgccguggcccugaacuacggcaucuacaagcaggaccugcccagccuggacgagaagcccagaaucgugguguucguggacaugggccacagcgccuuccaggugagcgccugcgccuucaacaagggcaagcugaaggugcugggcaccgccuucgaccccuuccugggcggcaagaacuucgacgagaagcugguggagcacuucugcgccgaguucaagaccaaguacaagcuggacgccaagagcaagaucagagcccugcugagacuguaccaggagugcgagaagcugaagaagcugaugagcagcaacagcaccgaccugccccugaacaucgagugcuucaugaacgacaaggacgugagcggcaagaugaacagaagccaguucgaggagcugugcgccgagcugcugcagaagaucgaggugccccuguacagccugcuggagcagacccaccugaagguggaggacgugagcgccguggagaucgugggcggcgccaccagaauccccgccgugaaggagagaaucgccaaguucuucggcaaggacaucagcaccacccugaacgccgacgaggccguggccagaggcugcgcccugcagugcgccauccugagccccgccuucaaggugagagaguucagcgugaccgacgccgugcccuuccccaucagccugaucuggaaccacgacagcgaggacaccgagggcgugcacgagguguucagcagaaaccacgccgcccccuucagcaaggugcugaccuuccugagaagaggccccuucgagcuggaggccuucuacagcgacccccagggcgugcccuaccccgaggccaagaucggcagauucguggugcagaacgugagcgcccagaaggacggcgagaagagcagagugaaggugaaggugagagugaacacccacggcaucuucaccaucagcaccgccagcaugguggagaaggugcccaccgaggagaacgagaugagcagcgaggccgacauggagugccugaaccagagaccccccgagaaccccgacaccgacaagaacgugcagcaggacaacagcgaggccggcacccagccccaggugcagaccgacgcccagcagaccagccagagcccccccagccccgagcugaccagcgaggagaacaagauccccgacgccgacaaggccaacgagaagaagguggaccagccccccgaggccaagaagcccaagaucaagguggugaacguggagcugcccaucgaggccaaccugguguggcagcugggcaaggaccugcugaacauguacaucgagaccgagggcaagaugaucaugcaggacaagcuggagaaggagagaaacgacgccaagaacgccguggaggaguacguguacgaguucagagacaagcugugcggccccuacgagaaguucaucugcgagcaggaccaccagaacuuccugagacugcugaccgagaccgaggacuggcuguacgaggagggcgaggaccaggccaagcaggccuacguggacaagcuggaggagcugaugaagaucggcacccccgugaaggugagauuccaggaggccgaggagagacccaagauguucgaggagcugggccagagacugcagcacuacgccaagaucgccgccgacuucagaaacaaggacgagaaguacaaccacaucgacgagagcgagaugaagaagguggagaagagcgugaacgaggugauggaguggaugaacaacgugaugaacgcccaggccaagaagagccuggaccaggaccccguggugagagcccaggagaucaagaccaagaucaaggagcugaacaacaccugcgagcccguggugacccagcccaagcccaagaucgagagccccaagcuggagagaacccccaacggccccaacaucgacaagaaggaggaggaccuggaggacaagaacaacuucggcgccgagcccccccaccagaacggcgagugcuaccccaacgagaagaacagcgugaacauggaccuggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1818 - RNA, 3217 nt, Artificial Sequence
  mRNA product Design1 comprising derived and/or modified sequence from Homo sapiens__NP_006380.1 __HsHYOU1 (opt4)
gggagaaagcuuaccauggccgacaaggugagaagacagagacccagaagaagagugugcugggcccugguggccgugcugcuggccgaccugcuggcccugagcgacacccuggccgugaugagcguggaccugggcagcgagagcaugaagguggccaucgugaagcccggcgugcccauggagaucgugcugaacaaggagagcagaagaaagacccccgugaucgugacccugaaggagaacgagagauucuucggcgacagcgccgccagcauggccaucaagaaccccaaggccacccugagauacuuccagcaccugcugggcaagcaggccgacaacccccacguggcccuguaccaggccagauuccccgagcacgagcugaccuucgacccccagagacagaccgugcacuuccagaucagcagccagcugcaguucagccccgaggaggugcugggcauggugcugaacuacagcagaagccuggccgaggacuucgccgagcagcccaucaaggacgccgugaucaccgugcccguguucuucaaccaggccgagagaagagccgugcugcaggccgccagaauggccggccugaaggugcugcagcugaucaacgacaacaccgccaccgcccugagcuacggcguguucagaagaaaggacaucaacaccaccgcccagaacaucauguucuacgacaugggcagcggcagcaccgugugcaccaucgugaccuaccagauggugaagaccaaggaggccggcaugcagccccagcugcagaucagaggcgugggcuucgacagaacccugggcggccuggagauggagcugagacugagagagagacuggccggccuguucaacgagcagagaaagggccagagagccaaggacgugagagagaaccccagagccauggccaagcugcugagagaggccaacagacugaagaccgugcugagcgccaacgccgaccacauggcccagaucgagggccugauggacgacguggacuucaaggccaaggugaccagaguggaguucgaggagcugugcgccgaccuguucgagagagugcccggccccgugcagcaggcccugcagagcgccgagaugagccuggacgagaucgagcaggugauccuggugggcggcgccaccagagugcccagagugcaggaggugcugcugaaggccgugggcaaggaggagcugggcaagaacaucaacgccgacgaggccgccgccaugggcgccguguaccaggccgccgcccugagcaaggccuucaaggugaagcccuucguggugagagacgccgugguguaccccauccugguggaguucaccagagagguggaggaggagcccggcauccacagccugaagcacaacaagagagugcuguucagcagaaugggccccuacccccagagaaaggugaucaccuucaacagauacagccacgacuucaacuuccacaucaacuacggcgaccugggcuuccugggccccgaggaccugagaguguucggcagccagaaccugaccaccgugaagcugaagggcgugggcgacagcuucaagaaguaccccgacuacgagagcaagggcaucaaggcccacuucaaccuggacgagagcggcgugcugagccuggacagaguggagagcguguucgagacccugguggaggacagcgccgaggaggagagcacccugaccaagcugggcaacaccaucagcagccuguucggcggcggcaccacccccgacgccaaggagaacggcaccgacaccgugcaggaggaggaggagagccccgccgagggcagcaaggacgagcccggcgagcagguggagcugaaggaggaggccgaggcccccguggaggacggcagccagccccccccccccgagcccaagggcgacgccacccccgagggcgagaaggccaccgagaaggagaacggcgacaagagcgaggcccagaagcccagcgagaaggccgaggccggccccgagggcguggcccccgcccccgagggcgagaagaagcagaagcccgccagaaagagaagaaugguggaggagaucggcguggagcugguggugcuggaccugcccgaccugcccgaggacaagcuggcccagagcgugcagaagcugcaggaccugacccugagagaccuggagaagcaggagagagagaaggccgccaacagccuggaggccuucaucuucgagacccaggacaagcuguaccagcccgaguaccaggaggugagcaccgaggagcagagagaggagaucagcggcaagcugagcgccgccagcaccuggcuggaggacgagggcgugggcgccaccaccgugaugcugaaggagaagcuggccgagcugagaaagcugugccagggccuguucuucagaguggaggagagaaagaaguggcccgagagacugagcgcccuggacaaccugcugaaccacagcagcauguuccugaagggcgccagacugauccccgagauggaccagaucuucaccgagguggagaugaccacccuggagaaggugaucaacgagaccugggccuggaagaacgccacccuggccgagcaggccaagcugcccgccaccgagaagcccgugcugcugagcaaggacaucgaggccaagaugauggcccuggacagagaggugcaguaccugcugaacaaggccaaguucaccaagcccagacccagacccaaggacaagaacggcaccagagccgagcccccccugaacgccagcgccagcgaccagggcgagaaggugaucccccccgccggccagaccgaggacgccgagcccaucagcgagcccgagaagguggagaccggcagcgagcccggcgacaccgagccccuggagcugggcggccccggcgccgagcccgagcagaaggagcagagcaccggccagaagagaccccugaagaacgacgagcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1819 - RNA, 2416 nt, Artificial Sequence
  mRNA product Design1 comprising derived and/or modified sequence from Homo sapiens__NP_005339.3 __HsHSP90AA1 (opt4)
gggagaaagcuuaccaugcccgaggagacccagacccaggaccagcccauggaggaggaggagguggagaccuucgccuuccaggccgagaucgcccagcugaugagccugaucaucaacaccuucuacagcaacaaggagaucuuccugagagagcugaucagcaacagcagcgacgcccuggacaagaucagauacgagagccugaccgaccccagcaagcuggacagcggcaaggagcugcacaucaaccugauccccaacaagcaggacagaacccugaccaucguggacaccggcaucggcaugaccaaggccgaccugaucaacaaccugggcaccaucgccaagagcggcaccaaggccuucauggaggcccugcaggccggcgccgacaucagcaugaucggccaguucggcgugggcuucuacagcgccuaccugguggccgagaaggugaccgugaucaccaagcacaacgacgacgagcaguacgccugggagagcagcgccggcggcagcuucaccgugagaaccgacaccggcgagcccaugggcagaggcaccaaggugauccugcaccugaaggaggaccagaccgaguaccuggaggagagaagaaucaaggagaucgugaagaagcacagccaguucaucggcuaccccaucacccuguucguggagaaggagagagacaaggaggugagcgacgacgaggccgaggagaaggaggacaaggaggaggagaaggagaaggaggagaaggagagcgaggacaagcccgagaucgaggacgugggcagcgacgaggaggaggagaagaaggacggcgacaagaagaagaagaagaagaucaaggagaaguacaucgaccaggaggagcugaacaagaccaagcccaucuggaccagaaaccccgacgacaucaccaacgaggaguacggcgaguucuacaagagccugaccaacgacugggaggaccaccuggccgugaagcacuucagcguggagggccagcuggaguucagagcccugcuguucgugcccagaagagcccccuucgaccuguucgagaacagaaagaagaagaacaacaucaagcuguacgugagaagaguguucaucauggacaacugcgaggagcugauccccgaguaccugaacuucaucagaggcgugguggacagcgaggaccugccccugaacaucagcagagagaugcugcagcagagcaagauccugaaggugaucagaaagaaccuggugaagaagugccuggagcuguucaccgagcuggccgaggacaaggagaacuacaagaaguucuacgagcaguucagcaagaacaucaagcugggcauccacgaggacagccagaacagaaagaagcugagcgagcugcugagauacuacaccagcgccagcggcgacgagauggugagccugaaggacuacugcaccagaaugaaggagaaccagaagcacaucuacuacaucaccggcgagaccaaggaccagguggccaacagcgccuucguggagagacugagaaagcacggccuggaggugaucuacaugaucgagcccaucgacgaguacugcgugcagcagcugaaggaguucgagggcaagacccuggugagcgugaccaaggagggccuggagcugcccgaggacgaggaggagaagaagaagcaggaggagaagaagaccaaguucgagaaccugugcaagaucaugaaggacauccuggagaagaagguggagaaggugguggugagcaacagacuggugaccagccccugcugcaucgugaccagcaccuacggcuggaccgccaacauggagagaaucaugaaggcccaggcccugagagacaacagcaccaugggcuacauggccgccaagaagcaccuggagaucaaccccgaccacagcaucaucgagacccugagacagaaggccgaggccgacaagaacgacaagagcgugaaggaccuggugauccugcuguacgagaccgcccugcugagcagcggcuucagccuggaggacccccagacccacgccaacagaaucuacagaaugaucaagcugggccugggcaucgacgaggacgaccccaccgccgacgacaccagcgccgccgugaccgaggagaugcccccccuggagggcgacgacgacaccagcagaauggaggagguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1820 - RNA, 556 nt, Artificial Sequence
  mRNA product Design1 comprising derived and/or modified sequence from Homo sapiens__NG_005218__HsHSP90AA3P (opt4)
gggagaaagcuuaccauggacagcagcaagcuggacagcggcaagggccugcacaucaaccuggugcccaacaagcagaaccagacccugaccaucguggacaccagaaucggcaugaccaagaccgaccugaucaacaaccugggcaccgugaccaagagcggcaccaaggccuucauggaggcccugcaggccgacgccgacaucagcaugaucggccacuucggcgugggcuucuacagcgccuaccugguggccaagaaggugaccgugaucagcaagcacaacaacgacgagcaguacaccugggagagcagcgccggcggcagcuucaccgugagaaccgacgagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1821 - RNA, 2392 nt, Artificial Sequence
  mRNA product Design1 comprising derived and/or modified sequence from Homo sapiens__NP_031381.2__HsHSP90AB1 (opt4)
gggagaaagcuuaccaugcccgaggaggugcaccacggcgaggaggagguggagaccuucgccuuccaggccgagaucgcccagcugaugagccugaucaucaacaccuucuacagcaacaaggagaucuuccugagagagcugaucagcaacgccagcgacgcccuggacaagaucagauacgagagccugaccgaccccagcaagcuggacagcggcaaggagcugaagaucgacaucauccccaacccccaggagagaacccugacccugguggacaccggcaucggcaugaccaaggccgaccugaucaacaaccugggcaccaucgccaagagcggcaccaaggccuucauggaggcccugcaggccggcgccgacaucagcaugaucggccaguucggcgugggcuucuacagcgccuaccugguggccgagaaggugguggugaucaccaagcacaacgacgacgagcaguacgccugggagagcagcgccggcggcagcuucaccgugagagccgaccacggcgagcccaucggcagaggcaccaaggugauccugcaccugaaggaggaccagaccgaguaccuggaggagagaagagugaaggagguggugaagaagcacagccaguucaucggcuaccccaucacccuguaccuggagaaggagagagagaaggagaucagcgacgacgaggccgaggaggagaagggcgagaaggaggaggaggacaaggacgacgaggagaagcccaagaucgaggacgugggcagcgacgaggaggacgacagcggcaaggacaagaagaagaagaccaagaagaucaaggagaaguacaucgaccaggaggagcugaacaagaccaagcccaucuggaccagaaaccccgacgacaucacccaggaggaguacggcgaguucuacaagagccugaccaacgacugggaggaccaccuggccgugaagcacuucagcguggagggccagcuggaguucagagcccugcuguucauccccagaagagcccccuucgaccuguucgagaacaagaagaagaagaacaacaucaagcuguacgugagaagaguguucaucauggacagcugcgacgagcugauccccgaguaccugaacuucaucagaggcgugguggacagcgaggaccugccccugaacaucagcagagagaugcugcagcagagcaagauccugaaggugaucagaaagaacaucgugaagaagugccuggagcuguucagcgagcuggccgaggacaaggagaacuacaagaaguucuacgaggccuucagcaagaaccugaagcugggcauccacgaggacagcaccaacagaagaagacugagcgagcugcugagauaccacaccagccagagcggcgacgagaugaccagccugagcgaguacgugagcagaaugaaggagacccagaagagcaucuacuacaucaccggcgagagcaaggagcagguggccaacagcgccuucguggagagagugagaaagagaggcuucgaggugguguacaugaccgagcccaucgacgaguacugcgugcagcagcugaaggaguucgacggcaagagccuggugagcgugaccaaggagggccuggagcugcccgaggacgaggaggagaagaagaagauggaggagagcaaggccaaguucgagaaccugugcaagcugaugaaggagauccuggacaagaagguggagaaggugaccaucagcaacagacuggugagcagccccugcugcaucgugaccagcaccuacggcuggaccgccaacauggagagaaucaugaaggcccaggcccugagagacaacagcaccaugggcuacaugauggccaagaagcaccuggagaucaaccccgaccaccccaucguggagacccugagacagaaggccgaggccgacaagaacgacaaggccgugaaggaccugguggugcugcuguucgagaccgcccugcugagcagcggcuucagccuggaggacccccagacccacagcaacagaaucuacagaaugaucaagcugggccugggcaucgacgaggacgagguggccgccgaggagcccaacgccgccgugcccgacgagauccccccccuggagggcgacgaggacgccagcagaauggaggagguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1822 - RNA, 2629 nt, Artificial Sequence
  mRNA product Design1 comprising derived and/or modified sequence from Homo sapiens__NP_003290.1__HsHSP90B1 (opt4)
gggagaaagcuuaccaugagagcccugugggugcugggccugugcugcgugcugcugaccuucggcagcgugagagccgacgacgagguggacguggacggcaccguggaggaggaccugggcaagagcagagagggcagcagaaccgacgacgagguggugcagagagaggaggaggccauccagcuggacggccugaacgccagccagaucagagagcugagagagaagagcgagaaguucgccuuccaggccgaggugaacagaaugaugaagcugaucaucaacagccuguacaagaacaaggagaucuuccugagagagcugaucagcaacgccagcgacgcccuggacaagaucagacugaucagccugaccgacgagaacgcccugagcggcaacgaggagcugaccgugaagaucaagugcgacaaggagaagaaccugcugcacgugaccgacaccggcgugggcaugaccagagaggagcuggugaagaaccugggcaccaucgccaagagcggcaccagcgaguuccugaacaagaugaccgaggcccaggaggacggccagagcaccagcgagcugaucggccaguucggcgugggcuucuacagcgccuuccugguggccgacaaggugaucgugaccagcaagcacaacaacgacacccagcacaucugggagagcgacagcaacgaguucagcgugaucgccgaccccagaggcaacacccugggcagaggcaccaccaucacccuggugcugaaggaggaggccagcgacuaccuggagcuggacaccaucaagaaccuggugaagaaguacagccaguucaucaacuuccccaucuacguguggagcagcaagaccgagaccguggaggagcccauggaggaggaggaggccgccaaggaggagaaggaggagagcgacgacgaggccgccguggaggaggaggaggaggagaagaagcccaagaccaagaagguggagaagaccgugugggacugggagcugaugaacgacaucaagcccaucuggcagagacccagcaaggagguggaggaggacgaguacaaggccuucuacaagagcuucagcaaggagagcgacgaccccauggccuacauccacuucaccgccgagggcgaggugaccuucaagagcauccuguucgugcccaccagcgcccccagaggccuguucgacgaguacggcagcaagaagagcgacuacaucaagcuguacgugagaagaguguucaucaccgacgacuuccacgacaugaugcccaaguaccugaacuucgugaagggcgugguggacagcgacgaccugccccugaacgugagcagagagacccugcagcagcacaagcugcugaaggugaucagaaagaagcuggugagaaagacccuggacaugaucaagaagaucgccgacgacaaguacaacgacaccuucuggaaggaguucggcaccaacaucaagcugggcgugaucgaggaccacagcaacagaaccagacuggccaagcugcugagauuccagagcagccaccaccccaccgacaucaccagccuggaccaguacguggagagaaugaaggagaagcaggacaagaucuacuucauggccggcagcagcagaaaggaggccgagagcagccccuucguggagagacugcugaagaagggcuacgaggugaucuaccugaccgagcccguggacgaguacugcauccaggcccugcccgaguucgacggcaagagauuccagaacguggccaaggagggcgugaaguucgacgagagcgagaagaccaaggagagcagagaggccguggagaaggaguucgagccccugcugaacuggaugaaggacaaggcccugaaggacaagaucgagaaggccguggugagccagagacugaccgagagccccugcgcccugguggccagccaguacggcuggagcggcaacauggagagaaucaugaaggcccaggccuaccagaccggcaaggacaucagcaccaacuacuacgccagccagaagaagaccuucgagaucaaccccagacacccccugaucagagacaugcugagaagaaucaaggaggacgaggacgacaagaccgugcuggaccuggccguggugcuguucgagaccgccacccugagaagcggcuaccugcugcccgacaccaaggccuacggcgacagaaucgagagaaugcugagacugagccugaacaucgaccccgacgccaagguggaggaggagcccgaggaggagcccgaggagaccgccgaggacaccaccgaggacaccgagcaggacgaggacgaggagauggacgugggcaccgacgaggaggaggagaccgccaaggagagcaccgccgagaaggacgagcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1823 - RNA, 2332 nt, Artificial Sequence
  mRNA product Design1 comprising derived and/or modified sequence from Homo sapiens__NP_057376.2__HsTRAP1 (opt4)
gggagaaagcuuaccauggccagagagcugagagcccugcugcuguggggcagaagacugagaccccugcugagagcccccgcccuggccgccgugcccggcggcaagcccauccugugccccagaagaaccaccgcccagcugggccccagaagaaaccccgccuggagccugcaggccggcagacuguucagcacccagaccgccgaggacaaggaggagccccugcacagcaucaucagcagcaccgagagcgugcagggcagcaccagcaagcacgaguuccaggccgagaccaagaagcugcuggacaucguggccagaagccuguacagcgagaaggagguguucaucagagagcugaucagcaacgccagcgacgcccuggagaagcugagacacaagcuggugagcgacggccaggcccugcccgagauggagauccaccugcagaccaacgccgagaagggcaccaucaccauccaggacaccggcaucggcaugacccaggaggagcuggugagcaaccugggcaccaucgccagaagcggcagcaaggccuuccuggacgcccugcagaaccaggccgaggccagcagcaagaucaucggccaguucggcgugggcuucuacagcgccuucaugguggccgacagaguggagguguacagcagaagcgccgcccccggcagccugggcuaccaguggcugagcgacggcagcggcguguucgagaucgccgaggccagcggcgugagaaccggcaccaagaucaucauccaccugaagagcgacugcaaggaguucagcagcgaggccagagugagagacguggugaccaaguacagcaacuucgugagcuucccccuguaccugaacggcagaagaaugaacacccugcaggccaucuggaugauggaccccaaggacgugagagaguggcagcacgaggaguucuacagauacguggcccaggcccacgacaagcccagauacacccugcacuacaagaccgacgccccccugaacaucagaagcaucuucuacgugcccgacaugaagcccagcauguucgacgugagcagagagcugggcagcagcguggcccuguacagcagaaaggugcugauccagaccaaggccaccgacauccugcccaaguggcugagauucaucagaggcgugguggacagcgaggacaucccccugaaccugagcagagagcugcugcaggagagcgcccugaucagaaagcugagagacgugcugcagcagagacugaucaaguucuucaucgaccagagcaagaaggacgccgagaaguacgccaaguucuucgaggacuacggccuguucaugagagagggcaucgugaccgccaccgagcaggaggugaaggaggacaucgccaagcugcugagauacgagagcagcgcccugcccagcggccagcugaccagccugagcgaguacgccagcagaaugagagccggcaccagaaacaucuacuaccugugcgcccccaacagacaccuggccgagcacagccccuacuacgaggccaugaagaagaaggacaccgaggugcuguucugcuucgagcaguucgacgagcugacccugcugcaccugagagaguucgacaagaagaagcugaucagcguggagaccgacaucgugguggaccacuacaaggaggagaaguucgaggacagaagccccgccgccgagugccugagcgagaaggagaccgaggagcugauggccuggaugagaaacgugcugggcagcagagugaccaacgugaaggugacccugagacuggacacccaccccgccauggugaccgugcuggagaugggcgccgccagacacuuccugagaaugcagcagcuggccaagacccaggaggagagagcccagcugcugcagcccacccuggagaucaaccccagacacgcccugaucaagaagcugaaccagcugagagccagcgagcccggccuggcccagcugcugguggaccagaucuacgagaacgccaugaucgccgccggccugguggacgaccccagagccauggugggcagacugaacgagcugcuggugaaggcccuggagagacacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1824 - RNA, 679 nt, Artificial Sequence
  mRNA product Design1 comprising derived and/or modified sequence from Homo sapiens__NP_000609.1__HsIGF1 (opt4)
gggagaaagcuuaccaugggcaagaucagcagccugcccacccagcuguucaagugcugcuucugcgacuuccugaaggugaagaugcacaccaugagcagcagccaccuguucuaccuggcccugugccugcugaccuucaccagcagcgccaccgccggccccgagacccugugcggcgccgagcugguggacgcccugcaguucgugugcggcgacagaggcuucuacuucaacaagcccaccggcuacggcagcagcagcagaagagccccccagaccggcaucguggacgagugcugcuucagaagcugcgaccugagaagacuggagauguacugcgccccccugaagcccgccaagagcgccagaagcgugagagcccagagacacaccgacaugcccaagacccagaaggaggugcaccugaagaacgccagcagaggcagcgccggcaacaagaacuacagaaugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1825 - RNA, 760 nt, Artificial Sequence
  mRNA product Design1 comprising derived and/or modified sequence from Homo sapiens__NP_000603.1__HsIGF2 (opt4)
gggagaaagcuuaccaugggcauccccaugggcaagagcaugcuggugcugcugaccuuccuggccuucgccagcugcugcaucgccgccuacagacccagcgagacccugugcggcggcgagcugguggacacccugcaguucgugugcggcgacagaggcuucuacuucagcagacccgccagcagagugagcagaagaagcagaggcaucguggaggagugcugcuucagaagcugcgaccuggcccugcuggagaccuacugcgccacccccgccaagagcgagagagacgugagcaccccccccaccgugcugcccgacaacuuccccagauaccccgugggcaaguucuuccaguacgacaccuggaagcagagcacccagagacugagaagaggccugcccgcccugcugagagccagaagaggccacgugcuggccaaggagcuggaggccuucagagaggccaagagacacagaccccugaucgcccugcccacccaggaccccgcccacggcggcgccccccccgagauggccagcaacagaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1826 - RNA, 856 nt, Artificial Sequence
  mRNA product Design1 comprising derived and/or modified sequence from Homo sapiens__NP_000591.1__HsIL6 (opt4)
gggagaaagcuuaccaugaacagcuucagcaccagcgccuucggccccguggccuucagccugggccugcugcuggugcugcccgccgccuuccccgcccccgugccccccggcgaggacagcaaggacguggccgccccccacagacagccccugaccagcagcgagagaaucgacaagcagaucagauacauccuggacggcaucagcgcccugagaaaggagaccugcaacaagagcaacaugugcgagagcagcaaggaggcccuggccgagaacaaccugaaccugcccaagauggccgagaaggacggcugcuuccagagcggcuucaacgaggagaccugccuggugaagaucaucaccggccugcuggaguucgagguguaccuggaguaccugcagaacagauucgagagcagcgaggagcaggccagagccgugcagaugagcaccaaggugcugauccaguuccugcagaagaaggccaagaaccuggacgccaucaccacccccgaccccaccaccaacgccagccugcugaccaagcugcaggcccagaaccaguggcugcaggacaugaccacccaccugauccugagaagcuucaaggaguuccugcagagcagccugagagcccugagacagaugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1827 - RNA, 1498 nt, Artificial Sequence
  mRNA product Design1 comprising derived and/or modified sequence from Homo sapiens__NP_002183.1__HsINHBA (opt4)
gggagaaagcuuaccaugccccugcuguggcugagaggcuuccugcuggccagcugcuggaucaucgugagaagcagccccacccccggcagcgagggccacagcgccgcccccgacugccccagcugcgcccuggccgcccugcccaaggacgugcccaacagccagcccgagaugguggaggccgugaagaagcacauccugaacaugcugcaccugaagaagagacccgacgugacccagcccgugcccaaggccgcccugcugaacgccaucagaaagcugcacgugggcaaggugggcgagaacggcuacguggagaucgaggacgacaucggcagaagagccgagaugaacgagcugauggagcagaccagcgagaucaucaccuucgccgagagcggcaccgccagaaagacccugcacuucgagaucagcaaggagggcagcgaccugagcgugguggagagagccgagguguggcuguuccugaaggugcccaaggccaacagaaccagaaccaaggugaccaucagacuguuccagcagcagaagcacccccagggcagccuggacaccggcgaggaggccgaggaggugggccugaagggcgagagaagcgagcugcugcugagcgagaaggugguggacgccagaaagagcaccuggcacguguuccccgugagcagcagcauccagagacugcuggaccagggcaagagcagccuggacgugagaaucgccugcgagcagugccaggagagcggcgccagccuggugcugcugggcaagaagaagaagaaggaggaggagggcgagggcaagaagaagggcggcggcgagggcggcgccggcgccgacgaggagaaggagcagagccacagacccuuccugaugcugcaggccagacagagcgaggaccacccccacagaagaagaagaagaggccuggagugcgacggcaaggugaacaucugcugcaagaagcaguucuucgugagcuucaaggacaucggcuggaacgacuggaucaucgcccccagcggcuaccacgccaacuacugcgagggcgagugccccagccacaucgccggcaccagcggcagcagccugagcuuccacagcaccgugaucaaccacuacagaaugagaggccacagccccuucgccaaccugaagagcugcugcgugcccaccaagcugagacccaugagcaugcuguacuacgacgacggccagaacaucaucaagaaggacauccagaacaugaucguggaggagugcggcugcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1828 - RNA, 1441 nt, Artificial Sequence
  mRNA product Design1 comprising derived and/or modified sequence from Homo sapiens__NP_002184.2__HsINHBB (opt4)
gggagaaagcuuaccauggacggccugcccggcagagcccugggcgccgccugccugcugcugcuggccgccggcuggcugggccccgaggccuggggcagccccacccccccccccacccccgccgcccccccccccccccccccccccggcagccccggcggcagccaggacaccugcaccagcugcggcggcuucagaagacccgaggagcugggcagaguggacggcgacuuccuggaggccgugaagagacacauccugagcagacugcagaugagaggcagacccaacaucacccacgccgugcccaaggccgccauggugaccgcccugagaaagcugcacgccggcaaggugagagaggacggcagaguggagaucccccaccuggacggccacgccagccccggcgccgacggccaggagagagugagcgagaucaucagcuucgccgagaccgacggccuggccagcagcagagugagacuguacuucuucaucagcaacgagggcaaccagaaccuguucguggugcaggccagccuguggcuguaccugaagcugcugcccuacgugcuggagaagggcagcagaagaaaggugagagugaagguguacuuccaggagcagggccacggcgacagauggaacaugguggagaagagaguggaccugaagagaagcggcuggcacaccuucccccugaccgaggccauccaggcccuguucgagagaggcgagagaagacugaaccuggacgugcagugcgacagcugccaggagcuggccguggugcccguguucguggaccccggcgaggagagccacagacccuucgugguggugcaggccagacugggcgacagcagacacagaaucagaaagagaggccuggagugcgacggcagaaccaaccugugcugcagacagcaguucuucaucgacuucagacugaucggcuggaacgacuggaucaucgcccccaccggcuacuacggcaacuacugcgagggcagcugccccgccuaccuggccggcgugcccggcagcgccagcagcuuccacaccgccguggugaaccaguacagaaugagaggccugaaccccggcaccgugaacagcugcugcauccccaccaagcugagcaccaugagcaugcuguacuucgacgacgaguacaacaucgugaagagagacgugcccaacaugaucguggaggagugcggcugcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1829 - RNA, 3676 nt, Artificial Sequence
  mRNA product Design1 comprising derived and/or modified sequence from Homo sapiens__NP_000623.2__HsITGAM (opt4)
gggagaaagcuuaccauggcccugagagugcugcugcugaccgcccugacccugugccacggcuucaaccuggacaccgagaacgccaugaccuuccaggagaacgccagaggcuucggccagagcguggugcagcugcagggcagcagagugguggugggcgccccccaggagaucguggccgccaaccagagaggcagccuguaccagugcgacuacagcaccggcagcugcgagcccaucagacugcaggugcccguggaggccgugaacaugagccugggccugagccuggccgccaccaccagccccccccagcugcuggccugcggccccaccgugcaccagaccugcagcgagaacaccuacgugaagggccugugcuuccuguucggcagcaaccugagacagcagccccagaaguuccccgaggcccugagaggcugcccccaggaggacagcgacaucgccuuccugaucgacggcagcggcagcaucaucccccacgacuucagaagaaugaaggaguucgugagcaccgugauggagcagcugaagaagagcaagacccuguucagccugaugcaguacagcgaggaguucagaauccacuucaccuucaaggaguuccagaacaaccccaaccccagaagccuggugaagcccaucacccagcugcugggcagaacccacaccgccaccggcaucagaaagguggugagagagcuguucaacaucaccaacggcgccagaaagaacgccuucaagauccugguggugaucaccgacggcgagaaguucggcgacccccugggcuacgaggacgugauccccgaggccgacagagagggcgugaucagauacgugaucggcgugggcgacgccuucagaagcgagaagagcagacaggagcugaacaccaucgccagcaagccccccagagaccacguguuccaggugaacaacuucgaggcccugaagaccauccagaaccagcugagagagaagaucuucgccaucgagggcacccagaccggcagcagcagcagcuucgagcacgagaugagccaggagggcuucagcgccgccaucaccagcaacggcccccugcugagcaccgugggcagcuacgacugggccggcggcguguuccuguacaccagcaaggagaagagcaccuucaucaacaugaccagaguggacagcgacaugaacgacgccuaccugggcuacgccgccgccaucauccugagaaacagagugcagagccuggugcugggcgcccccagauaccagcacaucggccugguggccauguucagacagaacaccggcaugugggagagcaacgccaacgugaagggcacccagaucggcgccuacuucggcgccagccugugcagcguggacguggacagcaacggcagcaccgaccuggugcugaucggcgccccccacuacuacgagcagaccagaggcggccaggugagcgugugcccccugcccagaggcagagccagauggcagugcgacgccgugcuguacggcgagcagggccagcccuggggcagauucggcgccgcccugaccgugcugggcgacgugaacggcgacaagcugaccgacguggccaucggcgcccccggcgaggaggacaacagaggcgccguguaccuguuccacggcaccagcggcagcggcaucagccccagccacagccagagaaucgccggcagcaagcugagccccagacugcaguacuucggccagagccugagcggcggccaggaccugaccauggacggccugguggaccugaccgugggcgcccagggccacgugcugcugcugagaagccagcccgugcugagagugaaggccaucauggaguucaaccccagagagguggccagaaacguguucgagugcaacgaccagguggugaagggcaaggaggccggcgaggugagagugugccugcacgugcagaagagcaccagagacagacugagagagggccagauccagagcguggugaccuacgaccuggcccuggacagcggcagaccccacagcagagccguguucaacgagaccaagaacagcaccagaagacagacccaggugcugggccugacccagaccugcgagacccugaagcugcagcugcccaacugcaucgaggaccccgugagccccaucgugcugagacugaacuucagccuggugggcaccccccugagcgccuucggcaaccugagacccgugcuggccgaggacgcccagagacuguucaccgcccuguuccccuucgagaagaacugcggcaacgacaacaucugccaggacgaccugagcaucaccuucagcuucaugagccuggacugccugguggugggcggccccagagaguucaacgugaccgugaccgugagaaacgacggcgaggacagcuacagaacccaggugaccuucuucuucccccuggaccugagcuacagaaaggugagcacccugcagaaccagagaagccagagaagcuggagacuggccugcgagagcgccagcagcaccgaggugagcggcgcccugaagagcaccagcugcagcaucaaccaccccaucuuccccgagaacagcgaggugaccuucaacaucaccuucgacguggacagcaaggccagccugggcaacaagcugcugcugaaggccaacgugaccagcgagaacaacaugcccagaaccaacaagaccgaguuccagcuggagcugcccgugaaguacgccguguacaugguggugaccagccacggcgugagcaccaaguaccugaacuucaccgccagcgagaacaccagcagagugaugcagcaccaguaccaggugagcaaccugggccagagaagccugcccaucagccugguguuccuggugcccgugagacugaaccagaccgugaucugggacagaccccaggugaccuucagcgagaaccugagcagcaccugccacaccaaggagagacugcccagccacagcgacuuccuggccgagcugagaaaggcccccguggugaacugcagcaucgccgugugccagagaauccagugcgacauccccuucuucggcauccaggaggaguucaacgccacccugaagggcaaccugagcuucgacugguacaucaagaccagccacaaccaccugcugaucgugagcaccgccgagauccuguucaacgacagcguguucacccugcugcccggccagggcgccuucgugagaagccagaccgagaccaagguggagcccuucgaggugcccaacccccugccccugaucgugggcagcagcgugggcggccugcugcugcuggcccugaucaccgccgcccuguacaagcugggcuucuucaagagacaguacaaggacaugaugagcgagggcggcccccccggcgccgagccccagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1830 - RNA, 1621 nt, Artificial Sequence
  mRNA product Design1 comprising derived and/or modified sequence from Homo sapiens__NP_002415.1__HsMMP8 (opt4)
gggagaaagcuuaccauguucagccugaagacccugcccuuccugcugcugcugcacgugcagaucagcaaggccuuccccgugagcagcaaggagaagaacaccaagaccgugcaggacuaccuggagaaguucuaccagcugcccagcaaccaguaccagagcaccagaaagaacggcaccaacgugaucguggagaagcugaaggagaugcagagauucuucggccugaacgugaccggcaagcccaacgaggagacccuggacaugaugaagaagcccagaugcggcgugcccgacagcggcggcuucaugcugacccccggcaaccccaagugggagagaaccaaccugaccuacagaaucagaaacuacaccccccagcugagcgaggccgagguggagagagccaucaaggacgccuucgagcuguggagcguggccagcccccugaucuucaccagaaucagccagggcgaggccgacaucaacaucgccuucuaccagagagaccacggcgacaacagccccuucgacggccccaacggcauccuggcccacgccuuccagcccggccagggcaucggcggcgacgcccacuucgacgccgaggagaccuggaccaacaccagcgccaacuacaaccuguuccugguggccgcccacgaguucggccacagccugggccuggcccacagcagcgaccccggcgcccugauguaccccaacuacgccuucagagagaccagcaacuacagccugccccaggacgacaucgacggcauccaggccaucuacggccugagcagcaaccccauccagcccaccggccccagcacccccaagcccugcgaccccagccugaccuucgacgccaucaccacccugagaggcgagauccuguucuucaaggacagauacuucuggagaagacacccccagcugcagagaguggagaugaacuucaucagccuguucuggcccagccugcccaccggcauccaggccgccuacgaggacuucgacagagaccugaucuuccuguucaagggcaaccaguacugggcccugagcggcuacgacauccugcagggcuaccccaaggacaucagcaacuacggcuuccccagcagcgugcaggccaucgacgccgccguguucuacagaagcaagaccuacuucuucgugaacgaccaguucuggagauacgacaaccagagacaguucauggagcccggcuaccccaagagcaucagcggcgccuuccccggcaucgagagcaagguggacgccguguuccagcaggagcacuucuuccacguguucagcggccccagauacuacgccuucgaccugaucgcccagagagugaccagaguggccagaggcaacaaguggcugaacugcagauacggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1831 - RNA, 2341 nt, Artificial Sequence
  mRNA product Design1 comprising derived and/or modified sequence from Homo sapiens__NP_004985.2__HsMMP9 (opt4)
gggagaaagcuuaccaugagccuguggcagccccuggugcuggugcugcuggugcugggcugcugcuucgccgcccccagacagagacagagcacccuggugcuguuccccggcgaccugagaaccaaccugaccgacagacagcuggccgaggaguaccuguacagauacggcuacaccagaguggccgagaugagaggcgagagcaagagccugggccccgcccugcugcugcugcagaagcagcugagccugcccgagaccggcgagcuggacagcgccacccugaaggccaugagaacccccagaugcggcgugcccgaccugggcagauuccagaccuucgagggcgaccugaaguggcaccaccacaacaucaccuacuggauccagaacuacagcgaggaccugcccagagccgugaucgacgacgccuucgccagagccuucgcccuguggagcgccgugaccccccugaccuucaccagaguguacagcagagacgccgacaucgugauccaguucggcguggccgagcacggcgacggcuaccccuucgacggcaaggacggccugcuggcccacgccuucccccccggccccggcauccagggcgacgcccacuucgacgacgacgagcuguggagccugggcaagggcgugguggugcccaccagauucggcaacgccgacggcgccgccugccacuuccccuucaucuucgagggcagaagcuacagcgccugcaccaccgacggcagaagcgacggccugcccuggugcagcaccaccgccaacuacgacaccgacgacagauucggcuucugccccagcgagagacuguacacccaggacggcaacgccgacggcaagcccugccaguuccccuucaucuuccagggccagagcuacagcgccugcaccaccgacggcagaagcgacggcuacagauggugcgccaccaccgccaacuacgacagagacaagcuguucggcuucugccccaccagagccgacagcaccgugaugggcggcaacagcgccggcgagcugugcguguuccccuucaccuuccugggcaaggaguacagcaccugcaccagcgagggcagaggcgacggcagacuguggugcgccaccaccagcaacuucgacagcgacaagaaguggggcuucugccccgaccagggcuacagccuguuccugguggccgcccacgaguucggccacgcccugggccuggaccacagcagcgugcccgaggcccugauguaccccauguacagauucaccgagggccccccccugcacaaggacgacgugaacggcaucagacaccuguacggccccagacccgagcccgagcccagaccccccaccaccaccaccccccagcccaccgccccccccaccgugugccccaccggcccccccaccgugcaccccagcgagagacccaccgccggccccaccggcccccccagcgccggccccaccggcccccccaccgccggccccagcaccgccaccaccgugccccugagccccguggacgacgccugcaacgugaacaucuucgacgccaucgccgagaucggcaaccagcuguaccuguucaaggacggcaaguacuggagauucagcgagggcagaggcagcagaccccagggccccuuccugaucgccgacaaguggcccgcccugcccagaaagcuggacagcguguucgaggagagacugagcaagaagcuguucuucuucagcggcagacagguguggguguacaccggcgccagcgugcugggccccagaagacuggacaagcugggccugggcgccgacguggcccaggugaccggcgcccugagaagcggcagaggcaagaugcugcuguucagcggcagaagacuguggagauucgacgugaaggcccagaugguggaccccagaagcgccagcgagguggacagaauguuccccggcgugccccuggacacccacgacguguuccaguacagagagaaggccuacuucugccaggacagauucuacuggagagugagcagcagaagcgagcugaaccagguggaccaggugggcuacgugaccuacgacauccugcagugccccgaggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1832 - RNA, 1633 nt, Artificial Sequence
  mRNA product Design1 comprising derived and/or modified sequence from Homo sapiens__NP_002418.1__HsMMP13 (opt4)
gggagaaagcuuaccaugcaccccggcgugcuggccgccuuccuguuccugagcuggacccacugcagagcccugccccugcccagcggcggcgacgaggacgaccugagcgaggaggaccugcaguucgccgagagauaccugagaagcuacuaccaccccaccaaccuggccggcauccugaaggagaacgccgccagcagcaugaccgagagacugagagagaugcagagcuucuucggccuggaggugaccggcaagcuggacgacaacacccuggacgugaugaagaagcccagaugcggcgugcccgacgugggcgaguacaacguguuccccagaacccugaaguggagcaagaugaaccugaccuacagaaucgugaacuacacccccgacaugacccacagcgagguggagaaggccuucaagaaggccuucaagguguggagcgacgugaccccccugaacuucaccagacugcacgacggcaucgccgacaucaugaucagcuucggcaucaaggagcacggcgacuucuaccccuucgacggccccagcggccugcuggcccacgccuucccccccggccccaacuacggcggcgacgcccacuucgacgacgacgagaccuggaccagcagcagcaagggcuacaaccuguuccugguggccgcccacgaguucggccacagccugggccuggaccacagcaaggaccccggcgcccugauguuccccaucuacaccuacaccggcaagagccacuucaugcugcccgacgacgacgugcagggcauccagagccuguacggccccggcgacgaggaccccaaccccaagcaccccaagacccccgacaagugcgaccccagccugagccuggacgccaucaccagccugagaggcgagaccaugaucuucaaggacagauucuucuggagacugcacccccagcagguggacgccgagcuguuccugaccaagagcuucuggcccgagcugcccaacagaaucgacgccgccuacgagcaccccagccacgaccugaucuucaucuucagaggcagaaaguucugggcccugaacggcuacgacauccuggagggcuaccccaagaagaucagcgagcugggccugcccaaggaggugaagaagaucagcgccgccgugcacuucgaggacaccggcaagacccugcuguucagcggcaaccagguguggagauacgacgacaccaaccacaucauggacaaggacuaccccagacugaucgaggaggacuuccccggcaucggcgacaagguggacgccguguacgagaagaacggcuacaucuacuucuucaacggccccauccaguucgaguacagcaucuggagcaacagaaucgugagagugaugcccgccaacagcauccuguggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1833 - RNA, 1285 nt, Artificial Sequence
  mRNA product Design1 comprising derived and/or modified sequence from Homo sapiens__NP_001286.1__HsCCR1 (opt4)
gggagaaagcuuaccauggagacccccaacaccaccgaggacuacgacaccaccaccgaguucgacuacggcgacgccacccccugccagaaggugaacgagagagccuucggcgcccagcugcugcccccccuguacagccugguguucgugaucggccuggugggcaacauccugguggugcuggugcuggugcaguacaagagacugaagaacaugaccagcaucuaccugcugaaccuggccaucagcgaccugcuguuccuguucacccugcccuucuggaucgacuacaagcugaaggacgacuggguguucggcgacgccaugugcaagauccugagcggcuucuacuacaccggccuguacagcgagaucuucuucaucauccugcugaccaucgacagauaccuggccaucgugcacgccguguucgcccugagagccagaaccgugaccuucggcgugaucaccagcaucaucaucugggcccuggccauccuggccagcaugcccggccuguacuucagcaagacccagugggaguucacccaccacaccugcagccugcacuucccccacgagagccugagagaguggaagcuguuccaggcccugaagcugaaccuguucggccuggugcugccccugcuggugaugaucaucugcuacaccggcaucaucaagauccugcugagaagacccaacgagaagaagagcaaggccgugagacugaucuucgugaucaugaucaucuucuuccuguucuggacccccuacaaccugaccauccugaucagcguguuccaggacuuccuguucacccacgagugcgagcagagcagacaccuggaccuggccgugcaggugaccgaggugaucgccuacacccacugcugcgugaaccccgugaucuacgccuucgugggcgagagauucagaaaguaccugagacagcuguuccacagaagaguggccgugcaccuggugaaguggcugcccuuccugagcguggacagacuggagagagugagcagcaccagccccagcaccggcgagcacgagcugagcgccggcuucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1834 - RNA, 853 nt, Artificial Sequence
  mRNA product Design1 comprising derived and/or modified sequence from Homo sapiens__NP_002598.4__HsPDGFA (opt4)
gggagaaagcuuaccaugagaacccuggccugccugcugcugcugggcugcggcuaccuggcccacgugcuggccgaggaggccgagauccccagagaggugaucgagagacuggccagaagccagauccacagcaucagagaccugcagagacugcuggagaucgacagcgugggcagcgaggacagccuggacaccagccugagagcccacggcgugcacgccaccaagcacgugcccgagaagagaccccugcccaucagaagaaagagaagcaucgaggaggccgugcccgccgugugcaagaccagaaccgugaucuacgagauccccagaagccagguggaccccaccagcgccaacuuccugaucuggccccccugcguggaggugaagagaugcaccggcugcugcaacaccagcagcgugaagugccagcccagcagagugcaccacagaagcgugaagguggccaagguggaguacgugagaaagaagcccaagcugaaggaggugcaggugagacuggaggagcaccuggagugcgccugcgccaccaccagccugaaccccgacuacagagaggaggacaccggcagacccagagagagcggcaagaagagaaagagaaagagacugaagcccaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1835 - RNA, 943 nt, Artificial Sequence
  mRNA product Design1 comprising derived and/or modified sequence from Homo sapiens__NP_002599.1__HsPDGFB (opt4)
gggagaaagcuuaccaugaacagaugcugggcccuguuccugagccugugcugcuaccugagacuggugagcgccgagggcgaccccauccccgaggagcuguacgagaugcugagcgaccacagcaucagaagcuucgacgaccugcagagacugcugcacggcgaccccggcgaggaggacggcgccgagcuggaccugaacaugaccagaagccacagcggcggcgagcuggagagccuggccagaggcagaagaagccugggcagccugaccaucgccgagcccgccaugaucgccgagugcaagaccagaaccgagguguucgagaucagcagaagacugaucgacagaaccaacgccaacuuccugguguggccccccugcguggaggugcagagaugcagcggcugcugcaacaacagaaacgugcagugcagacccacccaggugcagcugagacccgugcaggugagaaagaucgagaucgugagaaagaagcccaucuucaagaaggccaccgugacccuggaggaccaccuggccugcaagugcgagaccguggccgccgccagacccgugaccagaagccccggcggcagccaggagcagagagccaagaccccccagaccagagugaccaucagaaccgugagagugagaagaccccccaagggcaagcacagaaaguucaagcacacccacgacaagaccgcccugaaggagacccugggcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1836 - RNA, 1255 nt, Artificial Sequence
  mRNA product Design1 comprising derived and/or modified sequence from Homo sapiens__NP_057289.1__HsPDGFC (opt4)
gggagaaagcuuaccaugagccuguucggccugcugcugcugaccagcgcccuggccggccagagacagggcacccaggccgagagcaaccugagcagcaaguuccaguucagcagcaacaaggagcagaacggcgugcaggacccccagcacgagagaaucaucaccgugagcaccaacggcagcauccacagccccagauucccccacaccuaccccagaaacaccgugcugguguggagacugguggccguggaggagaacguguggauccagcugaccuucgacgagagauucggccuggaggaccccgaggacgacaucugcaaguacgacuucguggagguggaggagcccagcgacggcaccauccugggcagauggugcggcagcggcaccgugcccggcaagcagaucagcaagggcaaccagaucagaaucagauucgugagcgacgaguacuuccccagcgagcccggcuucugcauccacuacaacaucgugaugccccaguucaccgaggccgugagccccagcgugcugccccccagcgcccugccccuggaccugcugaacaacgccaucaccgccuucagcacccuggaggaccugaucagauaccuggagcccgagagauggcagcuggaccuggaggaccuguacagacccaccuggcagcugcugggcaaggccuucguguucggcagaaagagcagagugguggaccugaaccugcugaccgaggaggugagacuguacagcugcacccccagaaacuucagcgugagcaucagagaggagcugaagagaaccgacaccaucuucuggcccggcugccugcuggugaagagaugcggcggcaacugcgccugcugccugcacaacugcaacgagugccagugcgugcccagcaaggugaccaagaaguaccacgaggugcugcagcugagacccaagaccggcgugagaggccugcacaagagccugaccgacguggcccuggagcaccacgaggagugcgacugcgugugcagaggcagcaccggcggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1837 - RNA, 1312 nt, Artificial Sequence
  mRNA product Design1 comprising derived and/or modified sequence from Homo sapiens__NP_149126.1__HsPDGFD (opt4)
gggagaaagcuuaccaugcacagacugaucuucguguacacccugaucugcgccaacuucugcagcugcagagacaccagcgccaccccccagagcgccagcaucaaggcccugagaaacgccaaccugagaagagacgaccuguacagaagagacgagaccauccaggugaagggcaacggcuacgugcagagccccagauuccccaacagcuaccccagaaaccugcugcugaccuggagacugcacagccaggagaacaccagaauccagcugguguucgacaaccaguucggccuggaggaggccgagaacgacaucugcagauacgacuucguggagguggaggacaucagcgagaccagcaccaucaucagaggcagauggugcggccacaaggaggugccccccagaaucaagagcagaaccaaccagaucaagaucaccuucaagagcgacgacuacuucguggccaagcccggcuucaagaucuacuacagccugcuggaggacuuccagcccgccgccgccagcgagaccaacugggagagcgugaccagcagcaucagcggcgugagcuacaacagccccagcgugaccgaccccacccugaucgccgacgcccuggacaagaagaucgccgaguucgacaccguggaggaccugcugaaguacuucaaccccgagagcuggcaggaggaccuggagaacauguaccuggacacccccagauacagaggcagaagcuaccacgacagaaagagcaagguggaccuggacagacugaacgacgacgccaagagauacagcugcacccccagaaacuacagcgugaacaucagagaggagcugaagcuggccaacgugguguucuuccccagaugccugcuggugcagagaugcggcggcaacugcggcugcggcaccgugaacuggagaagcugcaccugcaacagcggcaagaccgugaagaaguaccacgaggugcugcaguucgagcccggccacaucaagagaagaggcagagccaagaccauggcccugguggacauccagcuggaccaccacgagagaugcgacugcaucugcagcagcagaccccccagaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1838 - RNA, 895 nt, Artificial Sequence
  mRNA product Design1 comprising derived and/or modified sequence from Homo sapiens__NP_003946.3__HsSOCS3 (opt4)
gggagaaagcuuaccauggugacccacagcaaguuccccgccgccggcaugagcagaccccuggacaccagccugagacugaagaccuucagcagcaagagcgaguaccagcugguggugaacgccgugagaaagcugcaggagagcggcuucuacuggagcgccgugaccggcggcgaggccaaccugcugcugagcgccgagcccgccggcaccuuccugaucagagacagcagcgaccagagacacuucuucacccugagcgugaagacccagagcggcaccaagaaccugagaauccagugcgagggcggcagcuucagccugcagagcgaccccagaagcacccagcccgugcccagauucgacugcgugcugaagcuggugcaccacuacaugcccccccccggcgcccccagcuuccccagcccccccaccgagcccagcagcgaggugcccgagcagcccagcgcccagccccugcccggcagcccccccagaagagccuacuacaucuacagcggcggcgagaagaucccccuggugcugagcagaccccugagcagcaacguggccacccugcagcaccugugcagaaagaccgugaacggccaccuggacagcuacgagaaggugacccagcugcccggccccaucagagaguuccuggaccaguacgacgccccccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1839 - RNA, 700 nt, Artificial Sequence
  mRNA product Design1 comprising derived and/or modified sequence from Homo sapiens__NP_003227.1__HsTGFA (opt4)
gggagaaagcuuaccauggugcccagcgccggccagcuggcccuguucgcccugggcaucgugcuggccgccugccaggcccuggagaacagcaccagcccccugagcgccgacccccccguggccgccgccguggugagccacuucaacgacugccccgacagccacacccaguucugcuuccacggcaccugcagauuccuggugcaggaggacaagcccgccugcgugugccacagcggcuacgugggcgccagaugcgagcacgccgaccugcuggccgugguggccgccagccagaagaagcaggccaucaccgcccuggugguggugagcaucguggcccuggccgugcugaucaucaccugcgugcugauccacugcugccaggugagaaagcacugcgaguggugcagagcccugaucugcagacacgagaagcccagcgcccugcugaagggcagaaccgccugcugccacagcgagaccguggugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1840 - RNA, 1390 nt, Artificial Sequence
  mRNA product Design1 comprising derived and/or modified sequence from Homo sapiens__NP_000651.3__HsTGFB1 (opt4)
gggagaaagcuuaccaugccccccagcggccugagacugcugccccugcugcugccccugcuguggcugcuggugcugacccccggcagacccgccgccggccugagcaccugcaagaccaucgacauggagcuggugaagagaaagagaaucgaggccaucagaggccagauccugagcaagcugagacuggccagcccccccagccagggcgaggugccccccggcccccugcccgaggccgugcuggcccuguacaacagcaccagagacagaguggccggcgagagcgccgagcccgagcccgagcccgaggccgacuacuacgccaaggaggugaccagagugcugaugguggagacccacaacgagaucuacgacaaguucaagcagagcacccacagcaucuacauguucuucaacaccagcgagcugagagaggccgugcccgagcccgugcugcugagcagagccgagcugagacugcugagacugaagcugaagguggagcagcacguggagcuguaccagaaguacagcaacaacagcuggagauaccugagcaacagacugcuggcccccagcgacagccccgaguggcugagcuucgacgugaccggcguggugagacaguggcugagcagaggcggcgagaucgagggcuucagacugagcgcccacugcagcugcgacagcagagacaacacccugcagguggacaucaacggcuucaccaccggcagaagaggcgaccuggccaccauccacggcaugaacagacccuuccugcugcugauggccaccccccuggagagagcccagcaccugcagagcagcagacacagaagagcccuggacaccaacuacugcuucagcagcaccgagaagaacugcugcgugagacagcuguacaucgacuucagaaaggaccugggcuggaaguggauccacgagcccaagggcuaccacgccaacuucugccugggccccugccccuacaucuggagccuggacacccaguacagcaaggugcuggcccuguacaaccagcacaaccccggcgccagcgccgcccccugcugcgugccccaggcccuggagccccugcccaucguguacuacgugggcagaaagcccaagguggagcagcugagcaacaugaucgugagaagcugcaagugcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1841 - RNA, 1462 nt, Artificial Sequence
  mRNA product Design1 comprising derived and/or modified sequence from Homo sapiens__NP_003229.1__HsTGFB2 (opt4)
gggagaaagcuuaccaugcacuacugcgugcugagcgccuuccugauccugcaccuggugaccguggcccugagccugagcaccugcagcacccuggacauggaccaguucaugagaaagagaaucgaggccaucagaggccagauccugagcaagcugaagcugaccagcccccccgaggacuaccccgagcccgaggaggugccccccgaggugaucagcaucuacaacagcaccagagaccugcugcaggagaaggccagcagaagagccgccgccugcgagagagagagaagcgacgaggaguacuacgccaaggagguguacaagaucgacaugccccccuucuuccccagcgagaacgccaucccccccaccuucuacagacccuacuucagaaucgugagauucgacgugagcgccauggagaagaacgccagcaaccuggugaaggccgaguucagaguguucagacugcagaaccccaaggccagagugcccgagcagagaaucgagcuguaccagauccugaagagcaaggaccugaccagccccacccagagauacaucgacagcaagguggugaagaccagagccgagggcgaguggcugagcuucgacgugaccgacgccgugcacgaguggcugcaccacaaggacagaaaccugggcuucaagaucagccugcacugccccugcugcaccuucgugcccagcaacaacuacaucauccccaacaagagcgaggagcuggaggccagauucgccggcaucgacggcaccagcaccuacaccagcggcgaccagaagaccaucaagagcaccagaaagaagaacagcggcaagaccccccaccugcugcugaugcugcugcccagcuacagacuggagagccagcagaccaacagaagaaagaagagagcccuggacgccgccuacugcuucagaaacgugcaggacaacugcugccugagaccccuguacaucgacuucaagagagaccugggcuggaaguggauccacgagcccaagggcuacaacgccaacuucugcgccggcgccugccccuaccuguggagcagcgacacccagcacagcagagugcugagccuguacaacaccaucaaccccgaggccagcgccagccccugcugcgugagccaggaccuggagccccugaccauccuguacuacaucggcaagacccccaagaucgagcagcugagcaacaugaucgugaagagcugcaagugcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1842 - RNA, 1456 nt, Artificial Sequence
  mRNA product Design1 comprising derived and/or modified sequence from Homo sapiens__NP_003230.1__HsTGFB3 (opt4)
gggagaaagcuuaccaugaagaugcaccugcagagagcccugguggugcuggcccugcugaacuucgccaccgugagccugagccugagcaccugcaccacccuggacuucggccacaucaagaagaagagaguggaggccaucagaggccagauccugagcaagcugagacugaccagcccccccgagcccaccgugaugacccacgugcccuaccaggugcuggcccuguacaacagcaccagagagcugcuggaggagaugcacggcgagagagaggagggcugcacccaggagaacaccgagagcgaguacuacgccaaggagauccacaaguucgacaugauccagggccuggccgagcacaacgagcuggccgugugccccaagggcaucaccagcaagguguucagauucaacgugagcagcguggagaagaacagaaccaaccuguucagagccgaguucagagugcugagagugcccaaccccagcagcaagagaaacgagcagagaaucgagcuguuccagauccugagacccgacgagcacaucgccaagcagagauacaucggcggcaagaaccugcccaccagaggcaccgccgaguggcugagcuucgacgugaccgacaccgugagagaguggcugcugagaagagagagcaaccugggccuggagaucagcauccacugccccugccacaccuuccagcccaacggcgacauccuggagaacauccacgaggugauggagaucaaguucaagggcguggacaacgaggacgaccacggcagaggcgaccugggcagacugaagaagcagaaggaccaccacaacccccaccugauccugaugaugauccccccccacagacuggacaaccccggccagggcggccagagaaagaagagagcccuggacaccaacuacugcuucagaaaccuggaggagaacugcugcgugagaccccuguacaucgacuucagacaggaccugggcuggaagugggugcacgagcccaagggcuacuacgccaacuucugcagcggccccugccccuaccugagaagcgccgacaccacccacagcaccgugcugggccuguacaacacccugaaccccgaggccagcgccagccccugcugcgugccccaggaccuggagccccugaccauccuguacuacgugggcagaacccccaagguggagcagcugagcaacaugguggugaagagcugcaagugcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1843 - RNA, 1603 nt, Artificial Sequence
  mRNA product Design1 comprising derived and/or modified sequence from Homo sapiens__NP_001057.1__HsTNFRSF1B (opt4)
gggagaaagcuuaccauggcccccguggccgugugggccgcccuggccgugggccuggagcugugggccgccgcccacgcccugcccgcccagguggccuucacccccuacgcccccgagcccggcagcaccugcagacugagagaguacuacgaccagaccgcccagaugugcugcagcaagugcagccccggccagcacgccaagguguucugcaccaagaccagcgacaccgugugcgacagcugcgaggacagcaccuacacccagcuguggaacugggugcccgagugccugagcugcggcagcagaugcagcagcgaccagguggagacccaggccugcaccagagagcagaacagaaucugcaccugcagacccggcugguacugcgcccugagcaagcaggagggcugcagacugugcgccccccugagaaagugcagacccggcuucggcguggccagacccggcaccgagaccagcgacguggugugcaagcccugcgcccccggcaccuucagcaacaccaccagcagcaccgacaucugcagaccccaccagaucugcaacgugguggccauccccggcaacgccagcauggacgccgugugcaccagcaccagccccaccagaagcauggcccccggcgccgugcaccugccccagcccgugagcaccagaagccagcacacccagcccacccccgagcccagcaccgcccccagcaccagcuuccugcugcccaugggccccagcccccccgccgagggcagcaccggcgacuucgcccugcccgugggccugaucgugggcgugaccgcccugggccugcugaucaucggcguggugaacugcgugaucaugacccaggugaagaagaagccccugugccugcagagagaggccaaggugccccaccugcccgccgacaaggccagaggcacccagggccccgagcagcagcaccugcugaucaccgcccccagcagcagcagcagcagccuggagagcagcgccagcgcccuggacagaagagcccccaccagaaaccagccccaggcccccggcguggaggccagcggcgccggcgaggccagagccagcaccggcagcagcgacagcagccccggcggccacggcacccaggugaacgugaccugcaucgugaacgugugcagcagcagcgaccacagcagccagugcagcagccaggccagcagcaccaugggcgacaccgacagcagccccagcgagagccccaaggacgagcaggugcccuucagcaaggaggagugcgccuucagaagccagcuggagacccccgagacccugcugggcagcaccgaggagaagccccugccccugggcgugcccgacgccggcaugaagcccagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1844 - RNA, 730 nt, Artificial Sequence
  mRNA product Design1 comprising derived and/or modified sequence from Homo sapiens__NP_002623.2__HsPGF (opt4)
gggagaaagcuuaccaugcccgugaugagacuguuccccugcuuccugcagcugcuggccggccuggcccugcccgccgugcccccccagcagugggcccugagcgccggcaacggcagcagcgagguggagguggugcccuuccaggagguguggggcagaagcuacugcagagcccuggagagacugguggacguggugagcgaguaccccagcgagguggagcacauguucagccccagcugcgugagccugcugagaugcaccggcugcugcggcgacgagaaccugcacugcgugcccguggagaccgccaacgugaccaugcagcugcugaagaucagaagcggcgacagacccagcuacguggagcugaccuucagccagcacgugagaugcgagugcagaccccugagagagaagaugaagcccgagagaagaagacccaagggcagaggcaagagaagaagagagaagcagagacccaccgacugccaccugugcggcgacgccgugcccagaagaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1845 - RNA, 1456 nt, Artificial Sequence
  mRNA product Design1 comprising derived and/or modified sequence from Homo sapiens__NP_001020537.2__HsVEGFA (opt4)
gggagaaagcuuaccaugaccgacagacagaccgacaccgcccccagccccagcuaccaccugcugcccggcagaagaagaaccguggacgccgccgccagcagaggccagggccccgagcccgcccccggcggcggcguggagggcgugggcgccagaggcguggcccugaagcuguucgugcagcugcugggcugcagcagauucggcggcgccguggugagagccggcgaggccgagcccagcggcgccgccagaagcgccagcagcggcagagaggagccccagcccgaggagggcgaggaggaggaggagaaggaggaggagagaggcccccaguggagacugggcgccagaaagcccggcagcuggaccggcgaggccgccgugugcgccgacagcgcccccgccgccagagccccccaggcccuggccagagccagcggcagaggcggcagaguggccagaagaggcgccgaggagagcggccccccccacagccccagcagaagaggcagcgccagcagagccggccccggcagagccagcgagaccaugaacuuccugcugagcugggugcacuggagccuggcccugcugcuguaccugcaccacgccaaguggagccaggccgcccccauggccgagggcggcggccagaaccaccacgagguggugaaguucauggacguguaccagagaagcuacugccaccccaucgagacccugguggacaucuuccaggaguaccccgacgagaucgaguacaucuucaagcccagcugcgugccccugaugagaugcggcggcugcugcaacgacgagggccuggagugcgugcccaccgaggagagcaacaucaccaugcagaucaugagaaucaagccccaccagggccagcacaucggcgagaugagcuuccugcagcacaacaagugcgagugcagacccaagaaggacagagccagacaggagaagaagagcgugagaggcaagggcaagggccagaagagaaagagaaagaagagcagauacaagagcuggagcguguacgugggcgccagaugcugccugaugcccuggagccugcccggcccccaccccugcggccccugcagcgagagaagaaagcaccuguucgugcaggacccccagaccugcaagugcagcugcaagaacaccgacagcagaugcaaggccagacagcuggagcugaacgagagaaccugcagaugcgacaagcccagaagaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1846 - RNA, 916 nt, Artificial Sequence
  mRNA product Design1 comprising derived and/or modified sequence from Homo sapiens__NP_001165094.1__HsVEGFA (opt4)
gggagaaagcuuaccaugaacuuccugcugagcugggugcacuggagccuggcccugcugcuguaccugcaccacgccaaguggagccaggccgcccccauggccgagggcggcggccagaaccaccacgagguggugaaguucauggacguguaccagagaagcuacugccaccccaucgagacccugguggacaucuuccaggaguaccccgacgagaucgaguacaucuucaagcccagcugcgugccccugaugagaugcggcggcugcugcaacgacgagggccuggagugcgugcccaccgaggagagcaacaucaccaugcagaucaugagaaucaagccccaccagggccagcacaucggcgagaugagcuuccugcagcacaacaagugcgagugcagacccaagaaggacagagccagacaggagaagaagagcgugagaggcaagggcaagggccagaagagaaagagaaagaagagcagauacaagagcuggagcguguacgugggcgccagaugcugccugaugcccuggagccugcccggcccccaccccugcggccccugcagcgagagaagaaagcaccuguucgugcaggacccccagaccugcaagugcagcugcaagaacaccgacagcagaugcaaggccagacagcuggagcugaacgagagaaccugcagaugcgacaagcccagaagaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1847 - RNA, 841 nt, Artificial Sequence
  mRNA product Design1 comprising derived and/or modified sequence from Homo sapiens__NP_003368.1__HsVEGFB (opt4)
gggagaaagcuuaccaugagcccccugcugagaagacugcugcuggccgcccugcugcagcuggcccccgcccaggcccccgugagccagcccgacgcccccggccaccagagaaagguggugagcuggaucgacguguacaccagagccaccugccagcccagagaggugguggugccccugaccguggagcugaugggcaccguggccaagcagcuggugcccagcugcgugaccgugcagagaugcggcggcugcugccccgacgacggccuggagugcgugcccaccggccagcaccaggugagaaugcagauccugaugaucagauaccccagcagccagcugggcgagaugagccuggaggagcacagccagugcgagugcagacccaagaagaaggacagcgccgugaagcccgacagagccgccaccccccaccacagaccccagcccagaagcgugcccggcugggacagcgcccccggcgcccccagccccgccgacaucacccaccccacccccgcccccggccccagcgcccacgccgcccccagcaccaccagcgcccugacccccggccccgccgccgccgccgccgacgccgccgccagcagcguggccaagggcggcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1848 - RNA, 1477 nt, Artificial Sequence
  mRNA product Design1 comprising derived and/or modified sequence from Homo sapiens__NP_005420.1__HsVEGFC (opt4)
gggagaaagcuuaccaugcaccugcugggcuucuucagcguggccugcagccugcuggccgccgcccugcugcccggccccagagaggcccccgccgccgccgccgccuucgagagcggccuggaccugagcgacgccgagcccgacgccggcgaggccaccgccuacgccagcaaggaccuggaggagcagcugagaagcgugagcagcguggacgagcugaugaccgugcuguaccccgaguacuggaagauguacaagugccagcugagaaagggcggcuggcagcacaacagagagcaggccaaccugaacagcagaaccgaggagaccaucaaguucgccgccgcccacuacaacaccgagauccugaagagcaucgacaacgaguggagaaagacccagugcaugcccagagaggugugcaucgacgugggcaaggaguucggcguggccaccaacaccuucuucaagccccccugcgugagcguguacagaugcggcggcugcugcaacagcgagggccugcagugcaugaacaccagcaccagcuaccugagcaagacccuguucgagaucaccgugccccugagccagggccccaagcccgugaccaucagcuucgccaaccacaccagcugcagaugcaugagcaagcuggacguguacagacaggugcacagcaucaucagaagaagccugcccgccacccugccccagugccaggccgccaacaagaccugccccaccaacuacauguggaacaaccacaucugcagaugccuggcccaggaggacuucauguucagcagcgacgccggcgacgacagcaccgacggcuuccacgacaucugcggccccaacaaggagcuggacgaggagaccugccagugcgugugcagagccggccugagacccgccagcugcggcccccacaaggagcuggacagaaacagcugccagugcgugugcaagaacaagcuguuccccagccagugcggcgccaacagagaguucgacgagaacaccugccagugcgugugcaagagaaccugccccagaaaccagccccugaaccccggcaagugcgccugcgagugcaccgagagcccccagaagugccugcugaagggcaagaaguuccaccaccagaccugcagcugcuacagaagacccugcaccaacagacagaaggccugcgagcccggcuucagcuacagcgaggaggugugcagaugcgugcccagcuacuggaagagaccccagaugagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1849 - RNA, 1282 nt, Artificial Sequence
  mRNA product Design1 comprising derived and/or modified sequence from Homo sapiens__NP_004460.1__HsVEGFD (opt4)
gggagaaagcuuaccauguacagagagugggugguggugaacguguucaugaugcuguacgugcagcuggugcagggcagcagcaacgagcacggccccgugaagagaagcagccagagcacccuggagagaagcgagcagcagaucagagccgccagcagccuggaggagcugcugagaaucacccacagcgaggacuggaagcuguggagaugcagacugagacugaagagcuucaccagcauggacagcagaagcgccagccacagaagcaccagauucgccgccaccuucuacgacaucgagacccugaaggugaucgacgaggaguggcagagaacccagugcagccccagagagaccugcguggagguggccagcgagcugggcaagagcaccaacaccuucuucaagccccccugcgugaacguguucagaugcggcggcugcugcaacgaggagagccugaucugcaugaacaccagcaccagcuacaucagcaagcagcuguucgagaucagcgugccccugaccagcgugcccgagcuggugcccgugaagguggccaaccacaccggcugcaagugccugcccaccgcccccagacaccccuacagcaucaucagaagaagcauccagauccccgaggaggacagaugcagccacagcaagaagcugugccccaucgacaugcugugggacagcaacaagugcaagugcgugcugcaggaggagaacccccuggccggcaccgaggaccacagccaccugcaggagcccgcccugugcggcccccacaugauguucgacgaggacagaugcgagugcgugugcaagacccccugccccaaggaccugauccagcaccccaagaacugcagcugcuucgagugcaaggagagccuggagaccugcugccagaagcacaagcuguuccaccccgacaccugcagcugcgaggacagaugccccuuccacaccagacccugcgccagcggcaagaccgccugcgccaagcacugcagauuccccaaggagaagagagccgcccagggcccccacagcagaaagaaccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1850 - RNA, 847 nt, Artificial Sequence
  mRNA product Design1 comprising derived and/or modified sequence from Homo sapiens__NP_061986.1__HsFGF21 (opt5)
gggagaaagcuuaccauggacagcgaugagaccggcuucgaacacuccgggcugugggugucuguccucgccggacugcuucugggcgcuugccaggcccaucccaucccugacagcuccccgcuccugcaauuugggggacagguuagacagcgguaccuuuauacagaugacgcgcagcaaacggaggcucaccuggaaauucgcgaggauggcaccgugggcggagccgccgaccagucucccgaaagccuccugcagcugaaggcucucaaaccuggcgugauccagauucugggcgucaagacauccagauuccuuugucaacggcccgauggggcccuguacggaucucuccauuuugacccugaggcuugcagcuuccgcgagcugcuucuggaagauggcuauaacguguaccaguccgaggcccacgggcucccccugcaucugccuggaaauaaaagcccgcacagagaccccgcgccucggggccccgcccgcuuucucccucugcccgggcuuccgccugcucugcccgaaccucccggaauccucgcuccccagccuccggauguugggucuuccgacccccugagcauggugggcccuucucaggggagaucccccagcuaugccucuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1851 - RNA, 1627 nt, Artificial Sequence
  mRNA product Design1 comprising derived and/or modified sequence from Homo sapiens__NP_002412.1__HsMMP1 (opt5)
gggagaaagcuuaccaugcacagcuuucccccucugcuccugcuucuguucuggggcguggucucccauucuuucccggccacccucgagacacaggaacaagacguugaucuggugcagaaguaccuugagaaauauuacaaccugaagaaugacgggagacagguggaaaaacggcgcaacagcggacccgucguggagaagcucaaacagaugcaagaauuuuucggccugaagguuacggggaagccugaugcugagacccugaaagugaugaagcagcccagaugcggagucccugacguggcccaguuuguucucacagagggcaauccccggugggaacagacccaccugacauaucgcaucgagaacuacaccccugaucuuccgagagcggacguggaucaugcuauugaaaaagccuuccaacugugguccaaugucacaccccucaccuuuacgaaggugucugaggggcaggccgacaucaugauuagcuucgugcggggagaucaccgcgacaacuccccuuuugauggccccggcgggaaucuggcucaugccuuccagccuggacccggcaucgggggagacgcucacuuugaugaggacgaaagauggaccaacaauuuccgggaguauaaccuucaccgcgucgccgcgcaugaacugggccacucucucgggcugagccauuccacagacauuggagcccugauguacccgagcuauaccuuuucuggcgauguucagcucgcucaagacgauaucgacggcauccaggccauuuacgggagaucccagaauccugugcaacccaucggaccucagacacccaaggcuugugauagcaaacugaccuucgacgccauuacgacaauccggggcgaggugauguucuuuaaggaucgcuucuacaugagaaccaaccccuuuuauccugaagucgagcuuaauuucauuucuguguuuuggccgcagcugcccaacgggcucgaggcggccuacgaguucgcugaccgggaugaaguucgcuuuuucaaaggaaauaaguauugggccgugcagggccaaaacguccugcacggguacccuaaagacaucuauuccagcuuuggauuccccagaacagugaagcacauugaugcugcccuuucugaagagaacaccggcaaaaccuacuuuuucguugccaauaaguauuggcgguacgacgaauacaaaagauccauggacccuggcuaucccaagaugaucgcucaugauuuuccggggaucggacacaagguggacgcggucuucaugaaagauggcuucuuuuacuucuuucaugggacacgccaguauaaguucgacccuaaaacgaagcggauucugacccuccagaaagccaacagcugguuuaauugcagaaagaacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1852 - RNA, 1387 nt, Artificial Sequence
  mRNA product Design1 comprising derived and/or modified sequence from Homo sapiens__NP_002412.1__HsMMP1(1-19,100-469) (opt5)
gggagaaagcuuaccaugcacagcuuucccccucugcuccugcuucuguucuggggcguggucucccauucuuucguucucaccgaggggaacccgagaugggaacagacacaccugacguaccggauugagaauuauacccccgaccuuccucgcgccgauguggaccaugcuauugaaaaggccuuucaacuguggagcaacgugacaccccucaccuucacaaaagucuccgagggacaggcggauaucaugauuucuuuugugagaggcgaccaccgggauaauagcccuuucgacgggcccggaggcaaccuggcucaugccuuucagccugggccgggaaucggcggcgaugcccacuucgacgaagaugagcgcuggaccaauaacuuuagagaguacaaucugcaccggguugcugcccaugaacucgggcacucccugggacuuucucauagcacagacauuggcgcucugauguaucccuccuacaccuucagcggggaugugcagcucgcccaagacgauaucgacggaauccaggcgauuuauggccgcucucagaacccuguccagcccaucgggccucaaacgcccaaggccugcgacuccaaacugaccuuugaugcuauuacaaccaucagaggagaggugauguucuuuaaggaccgguucuacaugcgcacaaauccguucuauccugaaguugagcuuaacuuuauuagcguguucuggccccagcugccuaauggccucgaggccgcuuacgaauuugccgauagagacgagguccgguucuuuaaaggcaacaaguacugggcggugcaggggcagaaugugcugcacggauaucccaaggauaucuacucuuccuucggcuuuccccgcaccgucaaacacauugacgccgcucugagcgaagagaacacggggaagacauauuucuuuguugccaauaaauacuggagauaugaugaauacaagcggucuauggacccuggauauccgaaaaugaucgcucaugauuuccccggcaucgggcacaagguggacgccguguuuaugaaggauggauucuuuuacuucuuccauggcacccgccaauacaaauuugacccuaagacaaaaagaauccucacccugcagaaggccaacuccugguucaacugucggaaaaauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1853 - RNA, 3574 nt, Artificial Sequence
  mRNA product Design1 comprising derived and/or modified sequence from Clostridium histolyticum__BAA77453.1__ColG (opt5)
gggagaaagcuuaccaugaagaaaaacauccugaagauucucauggacagcuacuccaaagagucuaagauccagaccgugagacgggucacaagcguuucccugcuugccguguaucugacgaugaauaccucuagccucgugcuggcuaaacccauugaaaacacaaaugauaccuccaucaagaacgucgagaaacuucgcaaugccccuaacgaagaaaauucuaaaaagguggaagacagcaaaaacgauaagguugagcacgugaaaaauauugaggaagcgaaggucgagcaaguggcuccggaaguuaaguccaaaagcacacugagaucugccuccaucgccaacaccaauagcgagaaguacgacuucgaguaucucaacggccugucuuacacagaacugaccaaucucaucaaaaacauuaaguggaaucagaucaacgggcuguuuaacuauuccacgggaagccagaaauucuuuggcgauaagaaucgggugcaggcuauuaucaacgcccuucaagagucugggcgcaccuacacagcuaaugacaugaaaggaauugaaaccuucacagagguccugagagccggcuuuuaucucggguacuacaacgauggacuguccuaucuuaaugaccggaacuuccaggauaagugcauccccgcgaugauugccauccagaagaauccuaacuuuaaacugggcaccgcugugcaggacgaagugaucacgagccucggcaagcugauugggaaugccuccgcuaacgccgaggucguuaauaacugugugcccgugcugaaacaauuccgcgagaaucucaaccaguacgcgccugauuaugucaagggaacagccgugaaugaacugaucaaaggcauugaguuugacuucucuggggcugccuacgaaaaggauguuaagaccaugcccugguauggaaaaaucgacccuuuuauuaacgagcuuaaggcucugggccucuacgggaacaucacaagcgccaccgaaugggccuccgacgugggaaucuauuaccugagcaaauucggccuuuacucuaccaauagaaacgauauuguccagucccuggagaaggcuguggacauguauaaauacggcaagaucgcguuuguugccauggagcggauuacaugggauuaugacgggaucggaagcaauggcaagaaaguggaucaugacaaguuccucgaugacgcugaaaaacacuaccugccgaagacguauaccuucgauaacgggacauuuauuauccgcgccggagacaaagucucugaggaaaagaucaagagacuguacugggccagccgggaggugaaaucccaguuccaucgcgucgugggcaaugauaaggcucucgaaguugggaacgccgacgacgugcugaccaugaaaauuuuuaauucucccgaggaguauaaguucaacacaaauaucaacggagucagcaccgauaauggcggccuuuacauugaaccuagagggacguuuuacacauaugagcggacaccccaacaguccaucuucagccuggaggagcucuuucgccacgaguacacccauuaucugcaggcgagauaccuuguggacggacuguggggccaagggccuuucuaugagaaaaaccggcucaccugguuugaugaaggaaccgcugaguucuuugccggcucuacaagaacguccgggguucugccccgcaagagcauucugggcuaccucgccaaagacaagguggaucaccgguauucucugaagaaaacccuuaauuccggauacgacgauagcgacuggauguucuacaacuauggcuuugcugucgcccacuaccuguaugaaaaggauaugccgacauucaucaaaaugaauaaggcuauucucaacaccgacgugaaauccuacgaugaaaucaucaagaagcugucugacgaugccaacaaaaauacagaguaucagaaccauauucaggagcuggcggacaaguaccagggggccggaaucccucuugugagcgacgauuaucucaaagaccacggcuacaagaaggcuuccgaaguuuacucugagauuagcaaggccgcuucccugaccaauacgagcgucaccgccgaaaagucucaauauuucaacacauuuacccugagagggacauacaccggagagacguccaaaggcgaguucaaggauugggacgaaaugagcaaaaagcucgaugggacacuggagucucuugcgaaaaauuccuggagcggcuauaagacccugacagccuacuuuaccaacuaucgcgugaccucugacaauaaggugcaguacgaugucguguuccauggaguucucacagacaacgcugauaucagcaauaacaaagcccccauugcuaaggugacgggcccuuccaccggggccgucggacggaauaucgaauuuagcggcaaagacucuaaggaugaggacgggaaaaucguguccuaugauugggacuucggagacggcgccacaagcagagggaagaacuccguucacgcuuacaaaaaggcgggcaccuacaaugugacacugaaggucaccgaugacaaaggagccacggcuacagaaucuuuuaccauugagaucaagaacgaagauaccacaacccccauuacaaaagagauggagcccaaugacgauaucaaggaagccaacggcccuauuguggaggggguuacggugaaaggagaccugaacggcagcgaugacgccgauaccuucuauuuugacgucaaggaagauggggacgugacaaucgagcuuccguacuccggaucuagcaauuucaccuggcucguguauaaggagggcgacgaucagaaccacaucgcuuccgggauugacaaaaauaacucuaaggucggcacauuuaaaagcaccaagggacgccauuacguuuucaucuauaaacacgauuccgccagcaauauuucuuacucccugaacaucaagggccuggggaaugaaaagcucaaagagaaggaaaacaaugacagcucugauaaagcgacggugauucccaacuuuaauaccacaaugcagggaucccugcuuggcgacgauagccgggacuauuacucuuucgaggugaaggaagagggggaggucaacaucgaacuggauaaaaaggacgaguucggagugaccuggacacuccauccugaauccaauaucaacgauagaauuaccuacggccaaguugacggcaauaaggugagcaacaaagucaagcugcgccccgggaaauauuaccugcuuguguauaaguacuccggaagcggcaauuaugagcuccggguuaacaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1854 - RNA, 3298 nt, Artificial Sequence
  mRNA product Design1 comprising derived and/or modified sequence from Clostridium histolyticum__BAA77453.1__HsALB(1-18)_ColG(111-1118) (opt5)
gggagaaagcuuaccaugaagugggugaccuucaucagccugcucuuucuguucuccucugccuacagcauugcuaacacaaauuccgagaaauaugacuuugaauaccuuaacggccugucuuauacggagcucaccaaucugaucaagaacauuaaauggaaucagaucaacgggcuuuucaauuacagcacaggaucccaaaaguuuuucggcgauaaaaacagaguccaggccauuaucaaugcgcugcaggaaucugggcggaccuauacagcuaacgacaugaagggaaucgagaccuuuacagaaguucuccgcgccggcuucuaccugggguauuacaaugauggacugagcuaccucaacgacagaaauuuucaggauaagugcauucccgccaugaucgcuauucagaaaaacccuaauuucaagcugggcaccgccgugcaagacgaggugaucacgucccuuggcaaacugauugggaacgcuagcgccaacgcggaggucgugaauaacuguguuccggugcucaagcaguuucgggaaaaucugaaccaguaugcccccgauuacgucaaaggaaccgcugugaaugagcuuaucaagggcauugaguucgacuuuucuggggccgcuuaugaaaaggauguuaaaacaaugccuugguacggaaagaucgaccccuucaucaacgagcugaaagcccucggccuguaugggaauauuaccuccgcgacagaaugggccagcgaugugggaaucuacuaucugucuaaguucggccucuacuccaccaaccgcaaugacauuguccaaagccuggagaaagcuguggauauguacaaguauggcaaaaucgccuuuguggcuauggaaagaauuacgugggacuacgacgggaucggaucuaacggcaagaaggucgaucacgacaaauuccuugaugacgccgagaagcauuaucugccuaaaacauacaccuuugauaaugggacauucaucauucgggccggagacaagguuuccgaagagaaaaucaagcgccucuauugggcuagcagagaggugaagucccaguuucaccggguggucggcaacgauaaagcgcuggaaguggggaaugccgacgauguucuuaccaugaagauuuucaacucucccgaggaauacaaauuuaauaccaacaucaacggagugagcacagacaauggcggccuguauauugagccucgcgggacguucuacaccuacgaaagaacaccgcagcaguccaucuuuagccucgaggagcuguuccggcaugaauauacccacuaccugcaagcucgcuaucucgucgauggacuguggggccaggggcccuuuuacgagaagaacagacuuacaugguucgacgaaggaaccgccgaguuuuucgccggcucuacgcggacauccggggugcugccucgcaaaagcauccucggcuaucuggcuaaggacaagguugaucauagauacucucuuaaaaagacccugaauagcggauaugacgauuccgacuggauguucuacaacuacggcuuugccguggcgcacuaucucuacgaaaaagauaugcccaccuucauuaagaugaauaaagcuauccugaacacagacgucaagucuuaugaugagauuaucaagaaacugagcgacgaugccaauaagaacaccgaguaccagaaucacauucaagaacucgccgacaaauaucagggggcuggaaucccucugguguccgaugacuaccuuaaggaucauggcuauaaaaaggccagcgaggucuacucugaaauuuccaaagcugccagccugacaaacacgucugugaccgcggagaagucccaguacuuuaauacauucacccuccgggggacauauaccggagagacgagcaagggcgaauuuaaagacugggacgagauguccaagaaacuggaugggacccuggaaucucuugccaagaacagcugguccggcuacaaaacacucaccgcuuauuucacaaauuacagaguuaccucugacaacaaggugcaguaugaugucguguuucacggaguucugacggacaaugccgauaucagcaacaacaaggcucccaucgccaaagugacaggcccguccaccggggcggucggacgcaauauugaguucagcggcaaggacucuaaagaugaagacgggaagaucguguccuacgauugggacuuuggagauggcgccacaagccgggggaaaaacucugugcaugcuuauaagaaggccggcaccuacaauguuacccugaaagucacagacgauaagggagcuacggccaccgaguccuucacaauugagaucaaaaacgaagacaccacaaccccuauuacgaaggagauggaacccaaugacgauaucaaagaggccaacggcccuaucguggaaggggugacagucaagggagaccucaauggcagcgaugacgcugauaccuuuuacuucgacgugaaggaggauggggacguuaccauugagcugcccuauucuggaagcuccaacuuuacauggcuuguguacaaagaaggcgaugaccaaaaucacaucgcgagcgggauugauaagaacaauucuaaagucggcaccuucaaguccacaaaaggaagacacuauguguucaucuacaagcaugacagcgccuccaacauuucuuauagccugaauaucaaaggccucgggaacgagaagcugaaggaaaaagagaauaacgacuccucugauaaggcuacgguuauccccaacuuuaauaccacaaugcagggaagccugcuuggcgacgauucccgcgacuacuauucuuucgaagugaaagaggagggggaagucaacauugagcucgauaagaaagacgaauuuggagugaccuggacacugcacccugagagcaauaucaacgaucggauuaccuacggccagguugacggcaauaagguguccaacaaggucaaacugagaccggggaaguacuaucuccugguguacaaauauagcggaucuggcaauuacgagcuucgcgugaacaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

(The sequence listing continues in the following parts.)

The invention claimed is:

1. A method of treating a wound in a subject in need thereof comprising administering to the subject an effective amount of RNA comprising at least one coding sequence, wherein the coding sequence encodes and wherein the at least one coding sequence comprises a sequence at least 95% identical to the RNA sequence of SEQ ID NO: 259; 356; 453; 647; 744; 841; 938; 1035; 1132; 1229; or 1326.

2. The method of claim 1, wherein the RNA is mono-, bi-, or multicistronic.

3. The method of claim 1, wherein the RNA is an mRNA, a viral RNA or a replicon RNA.

4. The method of claim 1, wherein the RNA is a modified RNA.

5. The method of claim 1, wherein the RNA comprises a 5'-cap structure and/or at least one 3'-untranslated region element (3'-UTR element).

6. The method of claim 1, wherein the RNA comprises at least one histone stem-loop.

7. The method of claim 1, wherein the RNA comprises a poly(A) sequence comprising 10 to 200 adenosine nucleotides.

8. The method of claim 7, wherein the RNA comprises, in 5' to 3' direction, the following elements:
a) a 5'-cap structure,
b) optionally a 5'-UTR element,
c) the at least one coding sequence,
d) optionally a 3'-UTR element,
e) said poly(A) sequence, and
f) optionally a poly(C) tail.

9. The method of claim 8, wherein the RNA comprises a 3'-UTR element and wherein the 3'-UTR element comprises a nucleic acid sequence derived from a 3'-UTR of a gene.

10. The method of claim 9, wherein the 3'-UTR element comprises a nucleic acid sequence derived from a 3'-UTR of a gene selected from the group consisting of an albumin gene, an a-globin gene, a β-globin gene, a tyrosine hydroxylase gene, a lipoxygenase gene, and a collagen alpha gene.

11. The method of claim 8, wherein the RNA comprises a 5'-UTR element.

12. The method of claim 11, wherein the 5'-UTR element comprises a nucleic acid sequence, which is derived from the 5'-UTR of a TOP gene.

13. The method of claim 8, wherein the 5' Cap structure is m7GpppN.

14. The method of claim 8, wherein the at least one coding sequence comprises a sequence at least 95% identical to SEQ ID NO: 259.

15. The method of claim 14, wherein the at least one coding sequence comprises a sequence of SEQ ID NO: 259.

16. The method of claim 8, wherein the at least one coding sequence comprises a sequence at least 95% identical to SEQ ID NO: 356.

17. The method of claim 16, wherein the at least one coding sequence comprises a sequence of SEQ ID NO: 356.

18. The method of claim 1, wherein the at least one coding sequence comprises a sequence at least 95% identical to SEQ ID NO: 259.

19. The method of claim 18, wherein the at least one coding sequence comprises a sequence of SEQ ID NO: 259.

20. The method of claim 1, wherein the RNA comprises a poly(C) sequence comprising 10 to 200 cytosine nucleotides.

* * * * *